United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 6

SEQ ID NO: 25109 - DNA, 522 bp, Glycine max
  Peptide Sequence Number=SeqID_116794
atggctgtcggtcgccgccacggcgcggatggcggcggccagccctttgcgctcgaaaccggagccgacgaagatcaggcagtgcacccgttgtgggatctgatactgctcgcgcagacgttggcgcagggcctcgtcggcgggcgggaatttttgattgtcgatggcgttatagatcaccgtgattttgtcggcgggcacgccaaagtcggcgatgatttcctgcttgatcatctcggcgttgcagatgacggctttcagctccggcgcggcgtacatggcgcgttcggcgcacatcacatagcggtgatagcgattggagaacagccatttgcggcgccattccggcagcagacgcgcacgctgcagcaaccagcggcggtgtacgccgtcgccggcgcggtagatgtcgcagccgggaatgcgctcgtggctttgcaccagatcgaaacgctctttctgccacagcgccctggctgccacggcgaagcctcgctcgcggctgatgcggccgagttttaa

SEQ ID NO: 25110 - DNA, 492 bp, Glycine max
  Peptide Sequence Number=SeqID_116795
atgaatcctaattttaggatgaccgacccctttaatccagtccatataatgtccttttcgggagctagaggaaatgcgtctcaagtacaccaattagtgggtatgagaggattaatgtcggatccacaaggacaaatgattgatttacctattcaaagcaatttgcgcgaagggctttctttaacagaatatataatttcttgctacggagctcgtaaaggggttgtagatactgctgtacgaacatcagatgctggatatcttacacgcagacttgttgaagtggttcaacacattgttacgatatatacagaggttcacgatgcattgccgttagaaatcaagatattggaattggacttatcaatcgatttaaaacccttcaaacccaaccaatatctatccgaactccctttacctgtaggaatacatcttggatctgtcgattgtgttatggccaaagtcctactcatggtcacttggtggaattag

SEQ ID NO: 25111 - DNA, 366 bp, Glycine max
  Peptide Sequence Number=SeqID_116796
atgggtgaccaagaggaagtacaggaacagatgaaagccgacatgtcggctttgaaagagaaaatggcttgcatgatggatgccatgctaggactgagacaactaatggagaataacgcggccaccgccgccgctgttagttcggctgccgatgcagacccaactctcccagctaccgcgcaccaccctatcccaaacgtggtaggacgagaaagaagtacactggggcacatcagcaacccccatccggggtacaaccgagtagcttacccctatggattaccacctaattacacaccaccagccatacgtgacgacgcgggtcatgtccctccccccatccttgaaggggagcctcctcgatag

SEQ ID NO: 25112 - DNA, 478 bp, Glycine max
  Peptide Sequence Number=SeqID_116797
atgtcaaatcgtaaaagcactgagtcagcactgaaaaaccttgaggtccaggtgggacaactggccaagcaaatagatgacaagtcatccaacctggcccctacatcctacacatctgacctgacaatggacagagctaggctgatctttggcctagtttctcgcacggacatgaacataggagctctcatgtctagccagatgacttctatagcccagtctaactcttctagacttgggtttcctgctctgatcatcgccttatgtagagccagaggggttgtctctgacagcctcacttatgggtgcctgagcccagtcattaacttggcctacatcaggaagaactgttggaatcctgatgatctgacaatttctatccgaggggctaggagggcgaggccagctgagcttccttccacatctacaactcctactccagcatccacttcagtagctccttcagtcccagctcaga

SEQ ID NO: 25113 - DNA, 96 bp, Glycine max
  Peptide Sequence Number=SeqID_116798
atggaacaggcgggttttgtggctgatttaggggtggcctttgtggataattgggtgttcttggcttatagggtggtgggtaatgagaagggatga

SEQ ID NO: 25114 - DNA, 231 bp, Glycine max
  Peptide Sequence Number=SeqID_116799
atggcagctcgcctaggcgagctgatgcttagtcctgaagaaactggctcgcctaggcgagctggttccttcagccctaagcaaattggggacccaggcaagccagaggctagcctgggtgagctagggtccacaaaattgcctgaaatgacaattttgcccctccccttgggtattttttgcatccttgaccaaaatgtcgaacgatctcacaccttggtgcaaaactag

SEQ ID NO: 25115 - DNA, 201 bp, Glycine max
  Peptide Sequence Number=SeqID_116800
atggttacccgcacctttcatcaaccaggggcaaacgagcccgttgacgcgaagagactaacatcgtcttctgcaccttttgccatccagggacagcgagtcaggtggcaggcggagataccttttggtcatccacacctttcgtcaaccgaggggaacgaattcgacgatgtcaggatgatgttggtcattcggttctga

SEQ ID NO: 25116 - DNA, 532 bp, Glycine max
  Peptide Sequence Number=SeqID_116801
atggcgcctaccaggcaccctttggatccagataagtccaacagggccctgggatttcccgcgctgatcacaggactctaccagtcgtttggagtccccgttacacctaccaaggtgattcggccgcccatcacccgagcttttattgagaagtactgcacccagagacaggctcagggggatgctccacaggccgcgggcgcgccaccaccacctcatcaagctggcccggctgggtcatttgacatggagcagtatttacggcatttggttcgccggcaggcggccaaccaccgggcacatgtacagacccatgattgtctgtaccagatgagcctcagcatgcagagccagggcttcgcttctttttcatgccctactctagaccagttcagggaagaggtcgcatggcccggggattggctcgaggcccaagcaggagaggcgcccccagaagctcccggcgatggagaggaggcccacgaggacgaggagatggccgatttgcttgacttcttgggagggagtggag

SEQ ID NO: 25117 - DNA, 153 bp, Glycine max
  Peptide Sequence Number=SeqID_116802
atgtcattgcctagcgctgttcatgtgtcctccattatcaagtgcgaagcctctgaagaaaaaagaaggagtaaaggcgagagtcgtcatcatggaaagggcaggatggacgaaatcagtgtcctatctttgctttcctcttatctccgatga

SEQ ID NO: 25118 - DNA, 459 bp, Glycine max
  Peptide Sequence Number=SeqID_116803
atgtcctcaccttcaaaggactacatgtcctcaccttcagaggacttcatgtcctcgccttcagaggacttcacatcctcgcctccagaggactacatgccctcgccttcagaggattacacgtcctcgccttcagagggccacacgccctcgccttcagaggactacatgtcctcatcttccgaggactacatagggctacacaccctcaccttcagaggactacacgtcctcgccttcagaggactacacgtcctcacctttagaggactacacgtcctcgccatcagagggctacacgccctctccttcatagggctacacgccctcacctttagaggactacacgtccttatcttcagcgaaacaccccagcagcctggggacgggcggcagcgggcaacagacgctctaccaccacctctagagttcacctcagctcatccacaaaaaggttag

SEQ ID NO: 25119 - DNA, 310 bp, Glycine max
  Peptide Sequence Number=SeqID_116804
atgcataaggcattatgggctaatgcacctctcccgtatccccaccttgttactctttttctttatcatttcattgttcctttggatgatgaatcatatgtcaaggttaaaaggtctttctccattggtgtcggtgttgttacctcctttggttaccggaaggatgttgatggtcagtgggtttgcaaacaagacttgccaccacctattcctgacgaacttaccccatctcctccaccagaaagggatgcttcttcttctctgctgactaaattcctcacagagctccgtgatcttcaagcatttgtgg

SEQ ID NO: 25120 - DNA, 62 bp, Glycine max
  Peptide Sequence Number=SeqID_116805
atggtgccaaaaacttgttcgcttccggcaagtgcaccagatcgtgcaagtagtataaaatg

SEQ ID NO: 25121 - DNA, 154 bp, Glycine max
  Peptide Sequence Number=SeqID_116806
ggttgccatcatcaaaaaaggggagattgtagaagcaagcttcatgttgatgaatcaagttgactcaagtagttttgatgataacaaagatgatgacaaaaagcccaagagaatgatttcaagattgattcaacaagttcaagatcaagattaa

SEQ ID NO: 25122 - DNA, 360 bp, Glycine max
  Peptide Sequence Number=SeqID_116807
atggaagcaaaaaaattcaaacttgttcccttgacaccttcacaagttgctagggatcaagcacaaataaaactcaaatggagtgaggaaaagaatagaaaaagaaaagaagaacaacctttaatggttaaggaggagtgtaaggaggtaagtgtctcctccaagaggttagctaagaagaaaagtcattttgcaataaagacaaacattaaagaaactcctcttcttagacaacttccacatcttctcctttgtaaaaggaaacttgttagcactgcgacacctcttgggcataaggttattcctcaagtaaaggagttgttggatgagggtttggttctgtcgcaacctagcctttga

SEQ ID NO: 25123 - DNA, 47 bp, Glycine max
  Peptide Sequence Number=SeqID_116808
atgcagtatctaggaagtgatcctaggtcgtctcccaacgagcaatg

SEQ ID NO: 25124 - DNA, 510 bp, Glycine max
  Peptide Sequence Number=SeqID_116809
atgcccactgcaaaaagttttaggatggctagggatagattggcaaatagtcaagtagataatgtcagattaaaattggtagcagctcgtgaaacagatggtcatgtatacaatctaccaaatgttgctgaagttgttgctcttattgttggtgattttgatggaaactcaagaagagatattattgttgaaactcagaatggagaattacagagaatagatgaattacactctagatatctaggactgcagtaccctctactcttcccttatggtgaagatgggtatagacctgacatacttcaccgttctacatctgccaccaaaaaaaggaagagaaatcgtctaacaatgagagagtggtttgcttacagacttcagtccaggccaaacgaagcacaaactttgttgcattctaaaaaactattcctacaattcattgttgaagcatataccatggttgagtctgaaagacttagctacatcagacacaaaccaaaagaaacttag

SEQ ID NO: 25125 - DNA, 189 bp, Glycine max
  Peptide Sequence Number=SeqID_116810
atggctatggacttgaacttctcttcgactacccgggctctctcaagctttgcctttagggcttccgccgatgatcccattactgcttcccctaagctctctgtcctttcaaacacgacgcatcccatgcccttgcgaactccttggagtacccctagcattgtggtcactgaaaacctcgtgcgatga

SEQ ID NO: 25126 - DNA, 633 bp, Glycine max
  Peptide Sequence Number=SeqID_116811
atgatttttgatcatgggttgcaagtgctaaacaagagtgatgatgctgccaactgggcaaacttttgggcccttttaactagggcttcaacagtggctcagcaccttcaggggccttcaaatgtcgacaccctgaaggatcaattgttgaaggctgaactcggcactacaggccaataccaagttggagagggataccaagaccttggagagtcaaaaaaggagaagaccaccactgagaagggaaggattcaacagaaagcttttgatgatgtgtatgacacacacgaggtgagcttcaaccattgccttcgacaggtgttgctcttatgtcaagtctccgatccaagtgtctttgatatcaacaaagacatttatcatggggagctgatgtcaattgatgacattgcaaatgatggaacccctatgctagagaggtcgatgttgaaggtgccaaggtcgatgataaggataatggagaccctagggatcaaaaggacatgggttcttaggtttctatgtgatgacaaaaagatcaaagatcaatcaaagaacaactcaagtgaatcaagaacaagtcaagagttcaagataagaatcaagaagaattcaagactcaagaagaaagtctag

SEQ ID NO: 25127 - DNA, 264 bp, Glycine max
  Peptide Sequence Number=SeqID_116812
atggcaagttcaacatgctttcaacaaatctcttcacagataactatcacaaagcataaaccaaaagtctacccaaacctgaaatttcgaagtcccacacgtagagatgcgcttcacgactctgaaaatgccttcctttcacgatttggagcagaaatggctaccaaaggttggagctttgttggagcttcaatggtggaggaagaagaagagaatggcaacgtgagagagagaggaaagagctttctgaaattttggggctga

SEQ ID NO: 25128 - DNA, 210 bp, Glycine max
  Peptide Sequence Number=SeqID_116813
atgctagatctaggagcatcagttagtgtcatgcctctgtccattttcaattctttatctcttggacctttgcaatctacagatgtggtgattcatttggcaaatagaagtgttgcttaccccgcaggaaacatccatttttatctgatctgcatacttgtcattccttatgcatctgtagaagctaagactttgtcttttatcttttga

SEQ ID NO: 25129 - DNA, 291 bp, Glycine max
  Peptide Sequence Number=SeqID_116814
atggagcttattgaaaacatggctgctagtgatcacgccatcttgtgtgatagagtgcatgttgtgctatttgtggcggagctcacgaatccgggccgttgtatttccactgaagaacacaatcatgaagttaagtatatgggaaatcaacaaaggcagggttacaatcaaggtggatacttaggtttccagcatggtcctaattataatcagcaaggacaatggagatctcatcctggcaaccaatacaacaaagaccagggtggaccttcaaacaggccaccacaataa

SEQ ID NO: 25130 - DNA, 249 bp, Glycine max
  Peptide Sequence Number=SeqID_116815
atgtcacgccaaaatgagtttgttggttactcgttcacaggaaaaaatcccaaaaagtttgacattctcaccggatgtaccatggatgaactgaaggatttgatcaagcaagttgcgcctcgtgggattccccttatggtgttgattgagtctaactactggaaaaagattcggccaatagaaattttagttgttttcaataaacctgtaccgaaaatggaagacgagttgtccttatcacaaaattag

SEQ ID NO: 25131 - DNA, 390 bp, Glycine max
  Peptide Sequence Number=SeqID_116816
atgtgtcataggcaatgctctaacctttttgtggatgagttgaggggctttggaggtggtggcggtgcatctattgcccactgtcggccatccgcagggtgctatggtgtcttgccctgcgcctgcctggaggcacaatacttcttgatgaaagctcgggggagatcggcattgtggtcactgggtagaatgttgctaagtagcaatgtcatccatatctgtgtaagagtggtcatgttggtgcgcatgatctgcactcgtctctttgcagcagcacgggtgaaatcttgccccgatatgcacagtagctacgcgatagcctccctttggttgtgctcgcacagttggccctcctttgagattagggggtggcccaggaaaaggaactga

SEQ ID NO: 25132 - DNA, 336 bp, Glycine max
  Peptide Sequence Number=SeqID_116817
atggcgcgttctgcttcttatctagagaggggcgctgaaatcgttcctatgggtcgtgcgtggcagctgcctttattaaaagggctctctcatgtgaagctaacatggctggctacatacaagtatagccaaatcaagatgagacgtgacggacggccgaatcgggccaccacttgggatgggaatggctcagcccatatgcatcatttgatgaaagcactccagtcgcttcctcgaagtggcttgactccaccccctcgagagcaggatgccggccgagatggagctgggagccaacctatactttcctggggcttgccttgccccaacatctaa

SEQ ID NO: 25133 - DNA, 477 bp, Glycine max
  Peptide Sequence Number=SeqID_116818
atgggtgacgtagaggaggtgcaaaagcagatgaaggtcgacatggaggccatgaaagagcaaatgaccacaatgatggaggccatgatgagcatgaagaagataatggaagccaatgcggttgcagttgccgctatcagcgctgttgctaaggcaaagatttgggaagtacgagcggccaatattatgtgcaaattcaaaacaagcatgccttcccaccatatggcttgcctcccaactatacaccacccaatgtggcatacactcctagtgaggatgtcaataactctgcttccatactcattgaaagccgacaacctcaaactgatcatgcacatgtctctcacaccttttccggtttttccgacgttttcctcaaataaacgttggtggcgactccgcgcatttttctcccatggaagacgcacccgtgagccccgtgtcgtcctcccgccgaagggtaggttacgacaatga

SEQ ID NO: 25134 - DNA, 1164 bp, Glycine max
  misc_feature (3)..(3): n is a, c, g, or t
  Peptide Sequence Number=SeqID_116819
atntacggcttccgcgtgatcgtcaaggatacggcggcctgctacctggccttaggcgccctgcacgccttatacaaaccgatacctggccgttttaaagattatattgccatccccaaggccaatggctaccagtcactgcataccaccttgttcggcccctttggtacgccgattgaagttcagatccgcagccaggaaatgcacaatattgccgatgccggtgtggctgcgcactggttgtacaaaacgaccgatgcccatttgaccaagctgcagcagcaaactcaccagtggttacagcgcctggtggaaatccagaccgaaagtgatgacagccacgagttcctggagaacttcaaggtggacctgttccccgacgaggtgtacgtgttcacgcccaaaggcaatatcatggctttaccccgcggctcaacagcggtcgactttgcttatgccgtgcactcggatgtcggtaatagctgtgtggcggttaaaatcaataacgaactggcgcccctgcgtactgaaatgcgcaacggtgaccatgtggaaatcattactgcgccgctggccaagcccaacccggcctggctcaattacgtggtgactggcaaggcacgttcgcatatccgtcattacctgaaaacagtgaaggtggaagagtctgcacaattgggcgagcgcatgctgaatgtcgcattacgcgccatgcatattgaacccgcagcactgactgacaagcagtggcaaaaagtcatgaatgactatggcgtcaaaacgcgccaagctattttgaccgatatcggccttggcaagcgtaacagcctcatggtggcccaccagttagtcgcgcatccggctgaagcggaagaaaagtctgccaaagtgctggataccatcactatccgtggttcggaaggcatggccgtacaatttgcccaatgttgcaggccgattcctggcgatcctatcctgggctttatcaacaaggataaaggcctggtcattcatacccatgattgcccagccatccgcaaattcaagctggacccggaaaaatggctggatgtggaatgggacgccgatccgaaaaaactgttcagcgtcaacttgcgcgtcaccgtagtcgaccagcgtggcatgctgggtgggatcctctag

SEQ ID NO: 25135 - DNA, 526 bp, Glycine max
  Peptide Sequence Number=SeqID_116820
atggcaaagtttgatatcgcagaagctacgaaggtgaagacgaagaatgaaggtcaacaaacacaggatgttgtgacaaaatatggactagatcctgaagcgtggaaacaatttgaagaaacccgcctgacacctaactgggagggtattaggaaacgagcacaatcaattcaaaaacacaacgactgccctcacgtactttcacgtgggggatatgatttgcttgagaagaaattgttagaccagaaacaaaaaaggatacaagaggaagcattgttgagtgaaaatccagcaagtccttatgaacccccatctccaataaaaagacatgttaagtggaaggttgctcggaccagggctgttggcaatatgacatctgactccgcacaggaaattgcagataaaatagactccttagaagagcaggtaacgcagggttcgtttgtatcccatggtcggcaagacatactgaacactgccattggccgacctgaccatgggggtcgcgttcgggcagcaggctcag

SEQ ID NO: 25136 - DNA, 1011 bp, Glycine max
  Peptide Sequence Number=SeqID_116821
atgtcggacgttctgggtattgccatcgttctattcccctcggttgcttaccaggctaaggcacagggagcggcggtggccaagcaaggtttgagcgagaagcgacttcggtacctctacgaggcggtgctggcgggttcgttgcgatccgcggccgagaagctggaagtcgaaccgtccgtgctcagccggcagatacagctattggaagcggacgtgggcgtccaactgctggaacggcgcggccgcggcgtgagccccacggaggctgcgctcatcgtggtggagcactgcaaagagcgcttctcggcggaggaagcgctgcggcagaaacttgatgatttgaatggcctgcaccgcggcgaggtgcgcatcgccgccggtgaaggtttcatggcccatctgctggttcccatcctggaaaacttttgtgcacgctatcccggcgtcaacatatctctggacctggcgaacgcggccgatgcggtgcggctggtgcagcaggaccaggtccacatcggcctcgccctcagcccgccgcccaatgagcagttgcatacaattgccgcccgcagacagccgctctgcgccgtcgtctggcccggccatccgctcacgcatgaaacacttccgctgacgatggcgcaagcgctggactatccgcacggcttgatggcgcaaggctatggcttgcgccagctcgtgcaactcgccgcattctctgacagcatcgttttgcgcccttccttcaccagcaattccattgccctgctcaagcactacgtgatggcgcgcgccggcatcacctttctgtcccacatcgccgtcgcgacagagaaagaggccggcgccctaatcgcattgccggtccacaacgcagtactggagcaagcacaggcccggctattcgtgcgccgcaaccgaccgatgccattcgccgtgcgacacgtcatcgattcgatacggcagttgggactattctcaggcttcgcacccgaatccggcaattga

SEQ ID NO: 25137 - DNA, 69 bp, Glycine max
  Peptide Sequence Number=SeqID_116822
gacgacgttcctaaatgaaaaaatctacacggttccggaatttcaacaaaaactattgacaacaacgaa

SEQ ID NO: 25138 - DNA, 429 bp, Glycine max
  Peptide Sequence Number=SeqID_116823
atggatatgaacttggggtacctcatctcccaccaaatctctctgattgcacagcatgatacatccaaacttggatttcctgccttgatcacaactctatgcaaggccaaaggagtccagtcagattctagatccgtggagaacataagccatgccattaacttggcatatattaagaagaactattggaatcttgatgatccaacagtgacatttagagggccaaggaaggccatgggtaagagatcagaggtccccactacttcagcaccacctgagacaccagctccttcttcttccacagctccagtaccttcctcagctccagttattcctcctacacctacacagataccacttctagctcctatatctgtaggaccatcagactttatatttacaccttacatgcttcattccatgctctaa

SEQ ID NO: 25139 - DNA, 186 bp, Glycine max
  Peptide Sequence Number=SeqID_116824
atggatggtttcattgaaccgatgaaagaacgtaaattggaaacattggaagaaccctcatcctctcccttgaagcaaaggacggcggaatcccctcaagggagagcgaatagaatgctaaaacccgatttcccaaagaaaggaatggaaaagaagaaatggaaagacaggaaaagaaaaagatga

SEQ ID NO: 25140 - DNA, 549 bp, Glycine max
  Peptide Sequence Number=SeqID_116825
atgccgaccattcgcggcgccgaacagggcagcaagaagcgctacgccggcctgatcgcgcgcggcggcggcgaggaagagatggtgtacaaaggcctggaaacggtgcgcaccgactggacgccgctggcgcagcagttccagcagcagctctatcagcgcatcttcaaacggcaaccctaccaggactatgtgcgcgactacgtcggcaaaaccctgaacggcgacttcgacgatcagctggtgtaccgcaagcgcctgcgcaggaaactcgacgactatcagcgcaacgtgccgccgcacgcccgcgccgcgcgcatcgccgacgattacaaccgcagccaggggcggccgctgcagtatcagaacggcggctggatcagctacgtgatgaccgtcgccgggccggaaccgctggaaacgcgccattcgcccatcgactatcagcattacctcgaacgccagctgcaaccggtggcagacgctatactccctttcttgcacgacgatttcaccacgctggtcaccgggcagatggggctgttttga

SEQ ID NO: 25141 - DNA, 297 bp, Glycine max
  Peptide Sequence Number=SeqID_116826
atgggagactcgctccgggcaggttcggattacaatacacggctctacgaaggaaggggttggtgggttaggaacgttttcaatatgattctttttccgtatttgttcgatgagaaatgcaagacgaaaaaggaacccatcttttcgactgggaaatgcgagtctgttttgtccactttctccatccctctctatcaaaatgatccaacaaaaaggaaggcgagcttgttattctcgtgttcgatctctgccccgctcgttgtcacctatgttgaagaaaggtttggaaccctgtag

SEQ ID NO: 25142 - DNA, 222 bp, Glycine max
  Peptide Sequence Number=SeqID_116827
atgccggaagtcgaaagggggcattgtcgcaaaatccgtaaagttctacaacattccagaggtcaaaaaaggggattattgcgtaatccgcccacttgggccttccggggtgttccaacagaaggcggtgccttctggtggaagcaacagctcgccagggcaagcttggcggcaaccacctcccttttttcccctataaataggggaaaaagggcagagtaa

SEQ ID NO: 25143 - DNA, 231 bp, Glycine max
  Peptide Sequence Number=SeqID_116828
atgtatgaatatcctaggagaggggacgtgttaacgcgtaagcattcctttcaaaattcgtgtggatattcgtgttttgttggagaaagggaaatggctccaaagaaactctctacgaagaggtctagaagagatgccacaggagaaggatccagtgctgccccagagtttgatagtcatcgtttccagagtgtcgagcaccagcagtgcttcgagggcgatcaaggatgg

SEQ ID NO: 25144 - DNA, 699 bp, Glycine max
  Peptide Sequence Number=SeqID_116829
atggatggtttggtagacctagccgcgattgatgctttccttgcatatcaccatagcaaagagagcccggtggtagccgtcttggcgaacttatttgatacatttgaccaaaggtgcgagaagagtagcacacgaatcatctgttgcttgcccgctctttgtgtatggttggtttcgcacctattccaacaagacataaggcatccatgtccactccgaagccatcgctcgtgtgtcaaaaagagaagagtagattgggaccaacacttggctgggataggaggcagaacaatcaactggtttcctcgatggaagaaaggaaaggagggagttatcttctcatgtggggactacccaaacatcccgttaataggaacgaggggttgcattaactacaatctcgcacttgctataagacagttagggtaccccatgaggggagcaccggcggaagaaagcctttctcctttccttgtgagagattttggcacgcaaggtttcaaggttatacaaagagtccataaggcgtgggaaagctcgttaaggaaagataaagaacttaggggcatctataatggcattatcggtggttatcatgaatggctgaaagttcgtacacgagggttagactggctctccaagttgaaaattatcaatgaggagaactttgaagctccggaagaggatgaagaagtctga

SEQ ID NO: 25145 - DNA, 303 bp, Glycine max
  Peptide Sequence Number=SeqID_116830
ggggagtttgggagaccctcgaaggcaatgagaagtgccgattctgtggcacaatttcgactcactgctacttcattagctacatccggaggaacccgcacgcactttcagcagcctgtggagtggatactatctacacctactccatatcgacaagtggagccagttcaagtgatagaggatgatgaagaccccctccctgatgttgattccccagaggatgtcatgtcagcatctgaggcagactccacagaggagagcggccctagagggacagcgaatagtgatgactcttcatcgtag

SEQ ID NO: 25146 - DNA, 144 bp, Glycine max
  Peptide Sequence Number=SeqID_116831
atgaccctcaggcgtaaggattttcaagtgcaagccattggtcagtttgctcaagcgacctgtgctcctgagtttggacttccaagatcgttcaatcagagattactcgtcttgcacgttggtggggttgccgtaaaacaatga

SEQ ID NO: 25147 - DNA, 487 bp, Glycine max
  Peptide Sequence Number=SeqID_116832
gtatggcgtctaccagtgcaccctctggacggataagtccaacagggccttgggatttcctgccttgatcacaggactctgccagtcgttcggagtccccgtcgcacctagcaagagacaggcccagggggatgctccgcatgccgtagatgcaccgccacctcatcaggctggtccagccagatcgtttgatacggagcagtatttgcggcatttggttcgccagcaggcggccaatcaccgggctcatgtacagacccatgattgtctttaccagatgagcctcagcctgcagagccagggttttacttcttttccgtgccctactccggaccagtttagggcagaggtcgcatggcctagagattggcctgaggcccgagcaggggaggcaccagcagaggctcctgacgaggcagatgaggcccgcgaggacgaggagatggccgatttacttgatttcttaggagggagcggaaccacatga

SEQ ID NO: 25148 - DNA, 555 bp, Glycine max
  Peptide Sequence Number=SeqID_116833
atgccatatgtggaagccgcggaggagtcattggaaacagccttccaatcttttgaggtagtgagcattgcctccgtagattccttctctggacaaccttgcctatccgatatgacaatgatggtgggccgagtaatgttggggaatggctacgagcccgaaatgggtttaggcaaaaacaacggcggcagaaccagcctgataagcaccagaggaaatcgtgggaagtttggattaggctataaacccacgcaagcggacataaggaaaagtgttgcgggaaggaagagcagaagcaaaggttcgcaattgggacgaaaagtcgaagggggtctgccctgccacatcagtaggagctttataagtgcgggtctaggacacgaaggccaagtcgttgcgatatgcgaggatgactctttgagtgggtcagatttggtacgaccatgccctcctggttttcgactgggaaattggcgagtggaggagcgcccagacatttacgcgacaagcataatgttaccctttgtggcttttaaactctacggttgggcctag

SEQ ID NO: 25149 - DNA, 651 bp, Glycine max
  Peptide Sequence Number=SeqID_116834
ccagtcaggatcgtactggtggccgcatcggggcgggcagcaagagggcgtgttacttgaaaagctaaaagctggtgaagttagcgccgaaggtctgcgcattgtgctggaagcgggtattcgcgagccgatgatcatgcgggccaatcaggcgctgtatgcgcaattacaccccataaaagaatccattttctggcgtcaggttgacggcggacatgatgcgctttgttggcgcgggagcgttttacatattgcgcaatgcgcaggggcaattcagtctgtggccgcaacaatgcgtcttaccggcaggctgggacattgtgtgtcagccgcagtcacaggcgtcctgccagcagtggctggaagcccactggcgtactctgacaccgacgaattttacccagttgcaggaggcacaatgagccagcatttacctttggtcgccgcacagcccggcatctggatggcagaaaaactgtcagaattaccctccgcctggagcgtggcgcattacgttgagttaaccggagaggttgattcgccattactggcccgcgcggtggttgccggactagcgcaagcagatacgctgcggatgcgttttacggaagataacggcgaagtctggcagtgggtcgatgatgcgctgac

SEQ ID NO: 25150 - DNA, 318 bp, Glycine max
  Peptide Sequence Number=SeqID_116835
atgtattccctggattggaagaaactactcaagaagtgcaactatagaggaatcacaaagacaaggatatactcaaggaggatttttaggcttccagcaagcaagtcggacaacggggataaactaccctcattctttgattcatttaatacatgggaacttattccaaggattacctcaaacgagcgacctgcacatttggcaacattcattgaaatttgtaacactgtaaagattgcaggagaagccaaaaggtggctccactcatttaagggtaacagtctgaaaacctgggaagaagttgttgaaaagttctaa

SEQ ID NO: 25151 - DNA, 156 bp, Glycine max
  Peptide Sequence Number=SeqID_116836
atgaccctctacaggttggtgttcgctttttcgaacccactcaaggatactaggctgccttgcagcggcgttttccgtttgcccaaagccaggaagggacaacgatctgttggtcgtgaccctagcctctatttgcgtccgttcctaagtacctga

SEQ ID NO: 25152 - DNA, 120 bp, Glycine max
  Peptide Sequence Number=SeqID_116837
atggataagagcttgaaggtaggagaagatggtggagggagagggagagaaggagcacaaaattttgtgcctcaaatgagagccaaattttggagccaaaatttcactaatgatgattag

SEQ ID NO: 25153 - DNA, 210 bp, Glycine max
  Peptide Sequence Number=SeqID_116838
atggaagattgcaaaaatacaagtggtgaggatgtctccttcacctctaggatctcacaatcactcacaaactcatctcaagctctcaaaccggctcctgcttcaagctctggtggccttgttcatgctcttgcgcctagcgcacgtatggaccgcttaacgcatgttaatgatttttggcatagtgcgcctttcttgcttagcggatga

SEQ ID NO: 25154 - DNA, 774 bp, Glycine max
  Peptide Sequence Number=SeqID_116839
atgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaa

SEQ ID NO: 25155 - DNA, 315 bp, Glycine max
  Peptide Sequence Number=SeqID_116840
atgaagagaagagttttagagaaattcttccttgcatccagaacaacatccattcggaaagaaatttgtggtataaggagtataattgatgcagctagtggaggtgctttaatggacaaaactcatgttgctacaagacaattgatttctaacatggcagccaattatcgacaatttggtactaaagtggctacaacatccaaggctgttgtaaatgaattttttgtttctaaagttgctgataaccaaaggatggagaataaactaacaaaattaacatcctttgtgagacaactagccattggtcaacaatag

SEQ ID NO: 25156 - DNA, 179 bp, Glycine max
  Peptide Sequence Number=SeqID_116841
atgggggaagcaacctggctcgctgggcgagctgagctcgcctgggcgagctgggcggcaaccacctcccctatttgctataataggggaggaagtgaaaagaaagggaatttcgcaaaggttttgactgttcttcgacgttcttcattcgttcctcatcgttcttcgatcttcaacgg

SEQ ID NO: 25157 - DNA, 168 bp, Glycine max
  Peptide Sequence Number=SeqID_116842
gttacaggttgtgccatatgtggtggtacttatgaatccggtcttttcattccttttgaagagaaaacgcaagaggttagctacatggggaatcaacaaaggcaaggatacaatcaagatggattcttaggttttcagcagggtccttacaaccagcaaggacagtag

SEQ ID NO: 25158 - DNA, 279 bp, Glycine max
  Peptide Sequence Number=SeqID_116843
atgtcccttgccactttatttggaaagttgcaggaacacgagatggaattattgagattacaccaacatgaagaaaatgtcaagaaaaagaaaggaattgctcttaaagcatcatcctcaattcaagaagaaagtgatcaggaaaatgatccagatgatgatgatgatctaagtctttttgtaaaaagattcaacaagtttcttaaaaaaaagatgaaaaatctgaaaagaaaaatcttagtgaaagaaactgaagaaagcatacatcacatgggatga

SEQ ID NO: 25159 - DNA, 384 bp, Glycine max
  Peptide Sequence Number=SeqID_116844
atgactgtgccattctttcacatcactcttttcagtcttagatgcaccaaaaaggctctcgaaggccggcagcaaaagaagagttatagcgggcgaagtaggaacccaccccatatgggccatcttcaaaggggcgtagcgcttgcttactcgaaagaggggaggaataagtcagagacattagtagagttcgttctgtgtgggacggaatcctgcctttcctggcgtaacaactgctccgtactcctaaggatctctatgccacttgtgattcccagccctaaggtttcttttatcggccgattccactgccgtagggctctcttggaaagctaccgcctaggaatgcactttctccagaacctgaaaggtgccccacaataa

SEQ ID NO: 25160 - DNA, 1180 bp, Glycine max
  Peptide Sequence Number=SeqID_116845
tcaaggttaaaagtctagatgtcactagcctcaaggaattgggacgattgatgggacctctccaaaggcgagccttccgcaaagtgtacgggaagattctagatttggccgcagcggaggtatttacagaagctgtcgtatccctcgcccaattttatgaccagccgttgaggtgtttcacgtttggggacttccaaatggtaccaactattgaagagtttgaggaaatattaggatgccctcttggggggagaaaaccgtatcttttctccggctttcttccttccttgagtaagattacggctgtggttggtgattcagcgaaggagttggattgcacgaagaaaactcggaacggtgtagtgggcttgcctcggaaatacttggaaggtaaggcaagggatatggcaagccaagagaagtggggcccgtttgcagatattttagccttgctgatttttggggttgtcctcttcctgaacgtcgacattgtttacacctttgaccggaggtgtgagaaaaatagtgcgcggatgtctgtgtttacctgctctgtgtgtgtggttgatttcacactattccatcaagacatgagacacccgtgtccgcttcaaagctattgctcatgcgccgaaaaagggagagtcgattgggatcaacatttggctaggatagggggcagcacgatcaattggtttcctcattggaaggaaggcaaggaaggagttcttttctcgtgtggggactaccctaatattccattgatagggactagggggtgtattaattataatcccgcactcgccataagacacctagggtaccctatgaggggagcgccaaccgaagaaagtctctcgcctttccttgtgaggaatctaggcgcacaaagtctcaaggcgatacaaagagtccacaaggcgtggagaagtccgttgaggaaagacaaggagcttaggggcatccgtaatggcgtcatcggaggttatcatggatggctaagaattcacacacgggggttagattggctctccaatttgaaagttatcgatgaggaggacttcgaagctccggaggaagataaagaagttcgagctctaaaattagagttagggaaggcaagactcgccaaggagaagttcaagtcagctgctacacacatccggaaggagtgcaccga

SEQ ID NO: 25161 - DNA, 732 bp, Glycine max
  Peptide Sequence Number=SeqID_116846
atggcagagccatcgaagaagagaaagggatcatcctccaccgccgctgctgctgcccatcgccgccacggaccttctgaagcatccacagcacctattcatccatctttatcatctccaagatcatccacattgttttctttcgatgatcagcgtctacgggtcttctactgcaatttgaaaattcaggatgacattattttctctgaggtgcatggtattcctatgatcattgatcagtccttattcttttctttaactcatttacccagtcaaggtgcaccttttgagggcaccattgttgatgactggaaatttgattattctagtcatgatgctcgccgtatggtctgcaatgaccaggctgaaatgaccggtagattgctgaccggatcattaacttttgataatcgcatcatgcattatatcattgttagaattttgcttccccggtcttcaaatttagcacaagcctctgaggaggatttgattctgatgtgggcttttctcaccggtcgtcagatcgactgggcccatttggttcggtaccgaatgcataaggcattacgaaccaatgcacctctaccttacccacagttgataactttgtttctgcgtcattttcaaattccgcttgatgatgagccatttgttcaagtcaagcgttcctttgcaattggtgctggtgctgtgacttcctttggttactgtaaggatcggaatggtcaatga

SEQ ID NO: 25162 - DNA, 278 bp, Glycine max
  Peptide Sequence Number=SeqID_116847
gggcaggatcgtctcgagctaccttttggggtagagacgaagttaaagcagcagaaaaccaatcaagggtcatgactgaccgatcgtcgtctcttcccggcgttggacaagcagaggacgtcgctgcaaggcagcccaaaatggcctcgaggaaacttgcctcaaagagatccaggaaggataaggcggccgaaggaactagttccactcctgagtatgacagtcaccgctttcggagcgctgtacaccagcagcgcttcgaggccatcaagggatag

SEQ ID NO: 25163 - DNA, 139 bp, Glycine max
  Peptide Sequence Number=SeqID_116848
atgagtaaaatagaggaggtgcatgagcagatgaaggctgacatggtggccatgaaagagcaaatgaccacaatgatggaagccatgataagtacgaaaaggatgatggaggtcaatgcgtctacagttgttgtcgcaa

SEQ ID NO: 25164 - DNA, 465 bp, Glycine max
  Peptide Sequence Number=SeqID_116849
atgcccccgactgtccctgttaatcattactccgatcccgaaggccaacacaataggatcagaatcctgtggtgttatcccatgctaatcaccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcagctctctctccggaatcgaaccctaattctccgtcacccgtcaccaccatggtaggccactatcctaccatcgaaagttga

SEQ ID NO: 25165 - DNA, 252 bp, Glycine max
  Peptide Sequence Number=SeqID_116850
atgcacgtggctaaactggtctctgatgccatctactatttgcaaggatcgcgcccgcaagacacccagtggacccgaagaagtccaatagggccctgggattctagctctgattacgggcgtctgtactgggcccgtgatcaacaaatcaccatcccgtgtctggctcaagacgttaaagaagcgctactaggaggcaacctagtaccttttaaatttctgcttgttattttgttcacctatgtttcttaa

SEQ ID NO: 25166 - DNA, 255 bp, Glycine max
  Peptide Sequence Number=SeqID_116851
atgaaaaactctacacagttccggaatttcaacaaacactattcacaacaacgaaacaagtaccgacgtaacaactcaaatgatatgaaaaaatggaaacaaaaagaaatacggatcaaggaatctcccaatcatgtggctccgcatgccaccgggctcttgggtcacggtaacaaaaagtggggtggtcgacaaaagcagggcttttgctcctacgtatcctcaatttgtgatgaggaactcagacctacgtag

SEQ ID NO: 25167 - DNA, 505 bp, Glycine max
  Peptide Sequence Number=SeqID_116852
atggaggggaagaaaaagaaacaactggaggaagctgataaatctgaaagcactgacaccatcattgatcctccacctcccatcagacgacatgtgaagtggaagatgtctcacaccaagaaaactggccaaatgattaaaccaataaatgtatttgttataggattccttggaggagcaagcctcataggcttcctttgtctcccatggacccggtgtcacaatcaaacaatactttggaccgactccaaggacctcctacacttcttcgtccatgactcacaaatacttggagcaactaatgcaaaagatcagtcccaatttccatcacagatgcaatcacagggactcgcactgcctcctgagcctgaggttgatccttcagttgcttctgtcagcacaaaggagagttgtcttgatctgtcaaggaacaatccagatgcggtcaaggttggtgttgagaagttagagatgttgatgctcccattccagtacccaatgaaga

SEQ ID NO: 25168 - DNA, 395 bp, Glycine max
  Peptide Sequence Number=SeqID_116853
tggaatggcaccagccggatagagtcatgagacaatttggaatgcagcaacctattccggaaccagtaatgcaacccaacaacatacatgacttgacattaaagggaaaagaaggaaaaaattggatgcgactaatgcaacccgcgcttaatgaatggaatagtgaaatcgccgaaacactacattttatggtgtcgcttgttgggagaagggtttgtacttttgacgatttactgccatgtgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaag

SEQ ID NO: 25169 - DNA, 288 bp, Glycine max
  Peptide Sequence Number=SeqID_116854
atgtctataaaagctgaaccatacaaccttgatctgaagcatgtcaagaaccatgtccttgatgtagggtttcagaagccgcggctcgtgagaaaccaaacttatcaactctgcaaacgtgcttctgaagtagcttccttcgaagacatgcaggagcatgaagatgccgaccatgaccatgcagaggagcttgtggaacatcgagggcctgaagaacaagaggatcatgccgatgacggcgtcgaacgccacaatctggacataagggcaggacgacaacgacagtga

SEQ ID NO: 25170 - DNA, 249 bp, Glycine max
  Peptide Sequence Number=SeqID_116855
atgaaggctattgaagtggaagaaattcccaacaaatggaggagcgtggccatggaatgtcatgacactgatatgtctgcaagcgaacattcgttcggtggtgttgcggaaacacatcctcatttttcatggacgactattaggggtgaaaatgaaccgagcagcttgtcgagggcctttggctcggcctatgtaaggctcgactcggctcagcttgtttactataaaggccaagctcaagctttttaa

SEQ ID NO: 25171 - DNA, 528 bp, Glycine max
  Peptide Sequence Number=SeqID_116856
atgtggcaacccctaggaaggtttatctttgaggctctacaaaaaaggaggtgtgattcccatggtgggtgtaaggaggattcctgtctgctacactccggcgagatgcatgacatggagacgtgtttggaagtaaaggaattgttacagcggatgatagatcaaggtcgactggaagtcggcattgaagaaaaaaaagagcagcatatatgcatgcaatctacggaggggagcggtgttgcgaagcccaaacccttggtgatatacttcactaaaaacgcagcttcgcaaaagcccggacaccccttaatagccaaacctgttcctttcccgtaccaaaatagtcacgcggtcccgtggagatatacacctccggggaagaaggaagaagaagtcactgacgtcagctcgctgtcagctaaagtaacaaatatcacgggactgagtggtgtgacccgtagtggtcgtgtgttcgcacctccggacctaccagtccaatccgccgacgtcaagggaaaaggaaaagtg

SEQ ID NO: 25172 - DNA, 222 bp, Glycine max
  Peptide Sequence Number=SeqID_116857
atgtttaacaagttaacaaaatcagaggatttgcacatgcagggtactcaaagatttttgcaacgcttggagttgtatgcaagtgttgtgatggggttggaggcgcctgcactaatttttgaaactgaaccctttttggatgttatggttaaaactgagttattatcggagtccactgctttccatgttcagtcccttgattcagttcatatgaatttttaa

SEQ ID NO: 25173 - DNA, 324 bp, Glycine max
  Peptide Sequence Number=SeqID_116858
atgatcgaaagttttcaacaacaacaacaaatgttagttctagaattgtacgtagaaaaggatgttgttggtggttctatgtttcgtgctgcaaattctgttacgtcatgtagacctaatgtatctcatcatgactcggaactgccaagaaatataagtaatttacatgatgatgatgatgattatcttgcgtctaactcatacgttgaagagtctttcgatgaagatgatagtgttgatggaatatctgatacagacaatgaagtcaccgacatcgttgaaccagtttcaattgttcacccaaccgaaggagtagtttcttga

SEQ ID NO: 25174 - DNA, 564 bp, Glycine max
  Peptide Sequence Number=SeqID_116859
atggacagagctaggttggtctatggcttggtaaccaacatggacatgaatattggagcccttatctcaggtcagatttcttctattgctcagagtaactcatctaggctcggatttctagccttgattacttccctatgtagagctagaggagttacctctgacagtctgacctatgagagcctgagcctggctattaacttggcctacattaagaaaaactattggaatgtggatgatctaatagttaacttcagaggggcaaggaagccaagagttcgaccagctgatgttccttcttcttctactctaccagctccttccacttctgctactcctacaccagctcctccagactcatctactcaagactctcagcactttgagttcatgcttcagagtcttcataaaggacaaattttgttaatgcagagcttgcaggttgtagctcctctaggatccattctgacaatggagcagtttttagagagggtatcctggccaggaaccctgccttctcttgagagaaaaggtgggggtctcagtgctcagctacctcagcag

SEQ ID NO: 25175 - DNA, 171 bp, Glycine max
  Peptide Sequence Number=SeqID_116860
atgggcccaaaatctaccctaaggctcatgagaaccctagggccttctcttgcatctctggcccaatcttcttggagtcttctatccaatgcccttgggggggtaaggtctgaaaaccccttttctgggcatcttcccatgagggaacatggttcctcaccaactcaatga

SEQ ID NO: 25176 - DNA, 275 bp, Glycine max
  Peptide Sequence Number=SeqID_116861
gggttgtgcccacaagacacccagtggacccgaaggagcccaacatggccctggggtttccagttctggttacgggcctctgtcagtcctacagggcgcccgtccccccagcaaattcatgccatcgtgacataggtaaggatcgtgcccgcaagacgcccagtggacctggagaaggccaacagggtcttggagttgccagctctaattataggcctctgctagttctacgaagtgcctgtcgcccccagcaaggtcatcaggccccttactaa

SEQ ID NO: 25177 - DNA, 327 bp, Glycine max
  Peptide Sequence Number=SeqID_116862
atggatttcaacagtgatgatttcatggacaaattgcgtgaagccttaaggaacgttgacatgagagatgaacgatggaggcctagaagggatgaaccacgtccaaacgtggatgagttcaaaatcaccgaactacctgaatttaatggtagtgcagacccggaggatcttgatgatgagaaacgttgcaaatatgctatcctgaaacttagcaaaagtgcatcgttgtggtatgagggattgaaggctagaaggacacgagatggaaaggagaaaatccactcttgggagtccttgaagaagaagttgcgccaaatcaccgactga

SEQ ID NO: 25178 - DNA, 333 bp, Glycine max
  Peptide Sequence Number=SeqID_116863
atggaagcgcagttaatccatgatcgcgtgaggaacccgcacgcacgcacgcttcagcagcctgtggagtggatactacctacacctactccatatcgactaatggagccagtccaagtgatagaggtgtcatcctctgaagaagatccagaggaggacccagaggagttacctcctgagcctgctgtggatgctcttgacttacctgaggatgatgaagacccactccttgatgttgattttccagaggatatcatgtcagcatctgaggcagactctatagaggatagcggccttggagggacagcgaatagtgaagactcttcatcatag

SEQ ID NO: 25179 - DNA, 114 bp, Glycine max
  Peptide Sequence Number=SeqID_116864
agaaagaagaagaagagacggaggtcatcatggactaattacggaaagggcgaagacggacgaaatcagtgtcttatctttgctttcctcttatctccgataaaaggtaagtaa

SEQ ID NO: 25180 - DNA, 294 bp, Glycine max
  Peptide Sequence Number=SeqID_116865
atggagcgttatctacagcacttggttcgccagcaggcggccaaccaccgggggcaggtgcagatacatgagtgtctctaccagctcagcctcagtcagcagggacagggtttcgttccttttgcgtgccctactccagagcagtttagggcagaggtcgcatggcccgaagattggcccgaggcccatgcaggggaggcgcctgcaggagctcccggcgatgtagaggaggcccgtatggatgaggagatgacagacttgctcggtttcttgggaggaagcggagccacgtga

SEQ ID NO: 25181 - DNA, 285 bp, Glycine max
  Peptide Sequence Number=SeqID_116866
atggcatccttaggacttcaaacaactcatgcttgttgcctgtttcatcatccaccacccttaccttctctgacttctcatctggtagacgatgaagaaccacggattagtgctgattgttctagtgtaacctctaataaatctgagatttataacgaggaagcagggaatgcaacacagaagcataaaccaaagagagtggagagtgtcaatgttgatgcagaagcctttggtgatcactggaaagttcagattggcctatgcattttgaagctgaagcactaa

SEQ ID NO: 25182 - DNA, 792 bp, Glycine max
  Peptide Sequence Number=SeqID_116867
atgtcctcaccttcagagggctacacgccctcgcccatcagaggactgcatgtccctcaccttcatagggctacacgccctcacctttggaggactacacgtcctcaccaacagagggctgcacgccttcaccttcagaggactacacaggactacacgtccttgctgtcaaagggacatgccctcacctttagaggactacacgtcctcgccaacagagggctgcacgccctcaccttgagaggactacacgtcctcgccaacagagggttgtacgccctcacctttagaggactacacgtcctcaccaacagagggctgcacgccctcaccttgagaggactacacgtcctcaccaacagagggctgcacaccctcaccttgagaggactacacgtcctcgccaacagagggttgtacgccctcacctttagaggactacacgtcctcgccaacagagggctccacgccctcaccttgagaggactacaggtcctcgccaacagagggttgtacgccctcaccttgagaggactacacgtcctcgccaacagagggttgtacgccctcacctttagaggactacacgtcctcgccaacagagggttgcacgccctcaccttgagaggactacacgtcctcgcgaacagagggttgtacgccctcaccttgaaagggctgcacgccctcacctttagaggactacacgtcctcgccttcaaagagccatgtaccttcaacttcagaggactacacgtccttgctatcaaagggacatgccctcacctttag

SEQ ID NO: 25183 - DNA, 183 bp, Glycine max
  Peptide Sequence Number=SeqID_116868
atgaagcagaagaagaaacaagaacgaaattctcggggaaggtctaccaacctttttttccccgatggtacaaccccaatgcaacctgcgcctatcatggtggtgttctggggcattctattgagccttgaaatggttccccgatggtacaaccccaatgataaaagtaaaaggaccgtttaa

SEQ ID NO: 25184 - DNA, 434 bp, Glycine max
  Peptide Sequence Number=SeqID_116869
gattgcacgtccttgccatcataggactacactccctcgccttcgaaaggcgacacgtcttgaacttcagagggctacacgccctcgcctttagaggactacgcgtcctcactttcagggccagtagtttccttttaacggttcctgggccaccccctgatattggaggagggccaactgtgcgagcacaaccagagagggaggctatcacacaactactatgcataccggggcaagatttcacccgtgccgctgcaaagagacgaggatcgcacccacaagacacccagtggacccggaaaagtccaacagggccctggggtttccagccctggttacgggcctctatcagtcctacagggtgcccggattgtgcccgcaagacacctagtggacccgaagaagccaacagtgtcttgagttgccagctctaa

SEQ ID NO: 25185 - DNA, 372 bp, Glycine max
  Peptide Sequence Number=SeqID_116870
atgaattgcgttttcgttcatttgtcctccaccttcgagtttggagccatgcgtagtgattgcttagtgcaagtctccattctcaccctttttcggaaccccatgaattgtggtttttttcatgtgtcctccattatcgagttcggagctatgcgtattgattgcttagcgcaattctccattctcaccctttttcggagccccatcaattgcgttttcgttcatgtgacctccagcttcgagtttggagctatgcgtagtgattgcttagtggaattctccattctcaatcttttcggagccccacgaattgcgtttttgttcatgtgtcctccaccttcgagtttggagctattcgtactgattgcttag

SEQ ID NO: 25186 - DNA, 600 bp, Glycine max
  Peptide Sequence Number=SeqID_116871
atggcatccttcagccagcttcagtcacagatgcaatctcaggcacctcctgagcctctggttggtcctggtccctccggtcctcgggtgagcacaaaggggagttgtgttgatccctcaggaaacgatcctgagacgggtgactctgacaggtgcggcttgtacatagaagtagatcctgcccgcttggttgtcgtggggagagtttatgagggatcgactcttgtgagtgtggacgaggttaaagatgcagatgctccagttcctgtacccactgctgatgtttccttagtggggcaggcacttcacaccttccttgcttggccgacacatctgatcaagtctttatcacaccaggtagctgtgtctccgccaaaaccacctccgaagcccgatctggaggtcgatgatccgctttatctgatgacattgaccatcccagagcttttcttgaggccttatcaggttagatgggatgccaccgtgtttggggtcgttaattcagatttccccctgtacataaagcacgaagacctctccaaaatcgcacacggttgtcaatgtctcagcatatcagtgttacaattgtggattctgtaa

SEQ ID NO: 25187 - DNA, 189 bp, Glycine max
  Peptide Sequence Number=SeqID_116872
atgagagagaacgagacttacctcgacgcgatggatctctattgtggaaatgcaaatggcgtggcagcatcgatcactggtggcactaatggcggcaacggtgaacgagttggtgcccaaagcaaaatcccatatcttattgctatagcccatatcaatattaatcaattttgttgtaagaaagaataa

SEQ ID NO: 25188 - DNA, 216 bp, Glycine max
  Peptide Sequence Number=SeqID_116873
atggggtgcagaaaagttgtgttctatgccatgttcatcgctgtcgcaacatgccctttcgcgggtgagcgaaggcgaggctcacgggtgcgctttccaaaggaggaaagatgcgcgaagtcgccaccaacgtttatttgtgggaaacgtcggaaaaaaccaaaggaaaccggtcaaaatgaaaattctaagttcgggagttgtatttacgtttga

SEQ ID NO: 25189 - DNA, 254 bp, Glycine max
  Peptide Sequence Number=SeqID_116874
gctctgggctgtggaggccccaccccctccagaggaagaaggctggtctcctgggcaggcccacctaggagctggaagtggaatttatgaaggtgctggaggaatcattgggatctctgtggaggaagaggaaggaagtgtagaagaagaaggtgttggtgcctctgattgtgcagtggaaggggcctcagatctcttacctctggccttcttgggtcctctgaaagtgactgttgatcatcaagattccaaca

SEQ ID NO: 25190 - DNA, 1155 bp, Glycine max
  Peptide Sequence Number=SeqID_116875
atgcgctggttgctcgatcgctgcgaaggggggcaacggatggcggagaacggagaaatctgccttggcaccatcgatgcctggctgctgtggcagttgagcggaggacaggcattcggctgcgatacctccaatgccgctcgcacccagctgttgaaccttgcctccggcgattgggacgagcggatgctggcgctgttcaacattccccgccaggcgctgccgacgatctccccctccagccatgtgttcggcgcgacgttgggattggaaggcattgccgacggcattccgattggcgcgatggtcggtgattcgcatgcggcgctgtacggccatgcgctcggccaggcggggcaggttaaggccacctatggcaccggttcatcggtgatggcgccgatcgccgaagcgcaatgcgacacgagcgctctggcaacgaccgtcgcctggcacgatggcgagcgtatgcagtatgcgctggagggcaatattccccacaccggcgacgccattgcctggatgctggatatcaccgccatgccggcggggggcgagacgccgttaagtgaactgcctgtttgcgtggccgacagcggtggcgtctattttgtgccggcactgaccggggtcggcgcaccctggtgggatgagcaggcgcgcggcgtgatctgcggcctcagccgcggcacgcggcgggaacatttggtgcgggccgcatttgagtcggtggcttatcaaatcgccgatgtgatcggcgtattgcggcaacagccgggttttgcattgcaggggttaatggccgatggcggccccagccgcaatgactggctgatgcagtttcaggccgatctgctgggttgcccgcgcctggcggcaggcggtgcagcgcaccttgtggcggccgcaggcgagctcatcgatgacaggagaacaaccatgaatcgtgatttcacggggaaaaccgtggtgattaccggcgcatgccgcggcattggggccggcatcgccgagcgcttcgcccgtttgggcgccaatctggtgattgcatcgaatgcggaacgcattctgaccacggcggaaacgctgcgccagcgttatggtgtggagattctgccggtgatcctcgacgtcacgatgagcgcaggtggttga

SEQ ID NO: 25191 - DNA, 285 bp, Glycine max
  Peptide Sequence Number=SeqID_116876
atggttggagggatcgcaccccacaagacacccagtggacccagaaaagtccaacagggccctgggtttcccagctctggttacgggcctctatcagtcctacagggtgctcgtacccccgacaagggatcgcgcctgcaagacacccagtggacccgaaagaaagtacctgtcacctccagcaagggcatcaagccccctagtaatcgagctttcatcaagaagtactgcgtctccaggcaggcgcagggcgaaacaccacaacaacattgggatggccggtag

SEQ ID NO: 25192 - DNA, 420 bp, Glycine max
  Peptide Sequence Number=SeqID_116877
atgacatttgaagcagcaaatgaaattgttgacaagattgatgcgcttgaggagcaggcctcacagggttcctttgttacccatggacgtcatgatatgctgactgctgccattgggcgaccagaacaccctagtcgtgtgcgtgttgtaggagccggtataaccatcaaacaatactttggatcagcttcaaggacctccttcattgctcccgaatacctgcaacagttcacgcaacaaatcaaggaccaactagaggattcaatcacagaaaaagtcactcgacgactaatgttatccctcagccaaatgcaatcacagggactcgcactgcctgctgaacttgatgttggtccttcagctgctcgtgtcagcacaaaggagagttgtgtgatccctcagggaacaatccaaacaccg

SEQ ID NO: 25193 - DNA, 393 bp, Glycine max
  Peptide Sequence Number=SeqID_116878
gcccgatgatacgcggagataccttacggttatccgcacccttttgtcatccagaggcggcgggcccgatgacaagcagagacaaaatttggtcattctgcacccttgtgtcatctagaggcagcgggcccgatgatacgcggagataccttacggttatccgcacccttttgttatccagaggcggcgggcccgatgacaagcagagacaaaatttggtcattctgcacccttgtgtcatccagagagacaaaatttgggtcattctgcaccccttgtgtcatcccagaggcggcgggcccgatgatacgcggagatacccttacggttatcccgcacccttgtgtcatccagaggcggccgggcccgatgaatccgcggaggtgccttacg

SEQ ID NO: 25194 - DNA, 498 bp, Glycine max
  Peptide Sequence Number=SeqID_116879
gataaagccacgacaaccgcctccagtacagttagggaagcggaaccggtgttgcagccctccttaaatacgggtcgagatagaaacacggcagtgtttggtcgaaggtatagcccgcaagcttatccttatggcttgcctctggacttcactccccgtgccaccccggaagatttaagccaagcccctactttcgaggggcagctcccaccttatgacgactatcccgggcaagacgatgaggaaggagatacccatctcggtcccctcctccacctcaaagatccgtccccccatgaactaccccaaccaaacatagtccgccatattccgacttcatccacacccgtaaaagaatctgttcccttcggggaagataagggaaagattgaggcgcttgaaaagaggttgagagcagtcgagggcctcagcaattacccattctcggatctagcggacttacttgtgcccaacatcgtcatccctcccagactttga

SEQ ID NO: 25195 - DNA, 237 bp, Glycine max
  Peptide Sequence Number=SeqID_116880
atgaaaagagaaaaacatgcctcctatagtagtcataactcttgcaagagcctaagtgaagaacttcatgactattacgaaggaaggcataggtcacatcttagacctcactctcatagaagagaaaaggaaagaaagcctcaagaggctaacattaacctctcatacttccatgggaaggacaatgtagaggctaacttagattgggaaatagagggtagaggtgggatcctctag

SEQ ID NO: 25196 - DNA, 219 bp, Glycine max
  Peptide Sequence Number=SeqID_116881
atgccctttggcctatgcaacgcccctggtaccttccagcggtgtatgcttagcattttcaatgattttttagaaagttgcatagagggttttataggcgttttatcaaggattttagcaaagtggcccttcgactatccaatctgctgcaaaaggaggtggagtttgattttgatgaccgatgcaaagaggcttttgattgccttaagcgtgtggtga

SEQ ID NO: 25197 - DNA, 320 bp, Glycine max
  Peptide Sequence Number=SeqID_116882
atgggtctgggcaaggacagccacgggaatgccgatgtggtcgacattagggggaacccgtacaaatatgggttggggtatgaacccgaaaaaccgggaagaaggaatgcgccgtcaagactccgggcagatagggcatggcccgaccatgtcagccagtgtttcacaagtgccgggataatgtttgaggaaaaggtggcagcaataggagaggagtctccacaagatccgccaagtttcgtacgaccgtgccatcccaattcccaagtggggaactggcgcgtgatgagccagtcggatgcctataccgctgattcaat

SEQ ID NO: 25198 - DNA, 231 bp, Glycine max
  Peptide Sequence Number=SeqID_116883
atgggtgcgcttccaagggaggaaggcgcgcggagtcaccaccaacgtttattcgaggaaaacgtcagaaaaaccggaacatgtggtctacgaactttaagtgtgaaaggttcgggagttgtttttacacacggggaaggaatggtcgacaaaagcggagcttttgctcctacgtatcctcgatttgttgtgagaaactcatacctacgtagttcttgcgaaaagcggtaa

SEQ ID NO: 25199 - DNA, 135 bp, Glycine max
  Peptide Sequence Number=SeqID_116884
atgatgaagagatatgagcaacaagcaaagaggcatgcaagggagggttcagggcacgagcaacaaaagatgtcgtcattcctagctataataaaggaagaaagagaaagaaacaaaggaaatagtgggaactag

SEQ ID NO: 25200 - DNA, 663 bp, Glycine max
  Peptide Sequence Number=SeqID_116885
atggtcattgatcagtcattgttcttttctttaactaatttacccagccaaggtgcaccttttgagggcaccattgttgatgactggaaatttgattattcgagtcatgatgctcgtcgtatggtctgcaatgatcaagctgaaatgaccgcacaagtctctgaggaggatttgattcttatgtgggcttttcttaccggtcgtcagattgactgggcccatttggttcggtaccgaatgcataaggcattacgggccaattcacctctcccttatccacatttgattactctgtttctgcgtcattttcaaattctgcttgatgatgaaccatttgttcaagtcaagcgttcctttgcaattggtgctggtgcagtgacttcctttgggtaccgtaaagatcagaatggtcaatggctgaagaaggatgcactccctcctcaagatgaacgtactccttcacctcctcctcagcgcgatgattcaacactcatgaatgaagtcctctccgaattacggggtcttcgttcttatgttggtgaccgtttcgactcattagatacacgctttgccggcatggacattcgcctcacacagcttgaagaggatgtaggttacattcgtcagagtttcgatcttccaccaccacctccaccttcttag

SEQ ID NO: 25201 - DNA, 333 bp, Glycine max
  Peptide Sequence Number=SeqID_116886
atgaaggtgaggacgtgtagtcctctgaagatgaggatgtttggtcctctaaagatgaggatgtgcatccctctgatggcgaggacgtgtagtcctctgaaggtgagggcgtgcagccctctgatggtgaggacgtgtagtcctctaaagacgagagcgtgtagccctccgaagggaaggacatgtagtcctctaaaggtgaggacgtatagtcctctgaagattgactgtccttttgaaagaggtgatagtccatgcaacctcatcctatcttttgcaaatctctccgggaactccctgagagtgtatgttctgtttgatttagtcacttga

SEQ ID NO: 25202 - DNA, 360 bp, Glycine max
  Peptide Sequence Number=SeqID_116887
atgtgtttaccattgtcgcaacctacccttcggcgggagggcgacgcgagggctcacgggtgcgtcttccatgggaggaagatgcacggagtcgccaccaacgtttatttgaggaaaacgtcagaaaaaccggaaaggtgtggtctatgtactttaagtgtgaaaggttcgggagttgtatctacgcatggggaagatttggaaacttacccgttgaagaacgaagaacagatgaagaatcgtgaagaacggaggaaaaccttcacggatttgcttacggaacatctcgaaagcattacggaagcacctcggcttggattttcttcacgaaaacaatttttttcacccaaaatagcttaa

SEQ ID NO: 25203 - DNA, 375 bp, Glycine max
  Peptide Sequence Number=SeqID_116888
atgagacctgatgaggttgttcttccagagcaaattgtgccagttatacatgagactgctgaagcaggtgagtcacagttaaggcaggaggttgctactcctgagaggacatcacagaccctagaaggtccactctcaccagggatggaactatcttttgctcaacaggtaacagatcctcctacacgagtacaggagagacaggcaaatcctcttacacccatcatggagatgccagaagaccatactctgccagtcttgagactgtcatctactcctccaactaccccagttttacatctgacagatgaagaggatatgcagaaccaggacacagggcacacaggaccagtcacaggaattctaaattcctga

SEQ ID NO: 25204 - DNA, 305 bp, Glycine max
  Peptide Sequence Number=SeqID_116889
atgattgtttggcctaactctctaaaaacagtccccagtggagtcgccaaatgtcacaatctaccctttggcgggaggacgatgcgagggctcacgggtgcgtcttccaagaaaggaaaatgcgcggagtcgccaccaacgtttattcgaggtgtcgcaacctacccttcggcgggagggcgacacgtgactcgcgggatgcgtgttccacgaaaggaatacgcgtggagtcgccaccaacgtttatttgaggaaaacgtcggaaaaaccggaaaagacgcgatctacgaacttttaagtgaaag

SEQ ID NO: 25205 - DNA, 135 bp, Glycine max
  Peptide Sequence Number=SeqID_116890
atgacggaagggtgtggggaagggtttgttggtgatttggaggggagggacgaatcaaagcgacaagggctgaatctcagtggatcgtggcagcaaggccactctgccacttacaataccccgtcgcgtatttaa

SEQ ID NO: 25206 - DNA, 204 bp, Glycine max
  Peptide Sequence Number=SeqID_116891
atgacttccttttgcgattggagtagaaatggtgagcaaagtttggagctttgtgggcaacaatggtggatgagaaggggagaagaaaagcaacatgagaagttatgccatatgtctccttttgagtggagcaaaaagggacccacttttcctcttgatgtgactcatactcagccacaagaagagaaaaatttgactttttga

SEQ ID NO: 25207 - DNA, 597 bp, Glycine max
  Peptide Sequence Number=SeqID_116892
atgcatggatcatctgttgtttacccgctctgtgtatggttggtttcacacttattccaacaagacataaggcatccatgtccgctccgaagccatcactcgtgtgtcgaaaaaagaatagtagattgggaccaacacttggctgggataggaggtagaacggtcaactggtttccacgatggaaagaaggaaaagagggagttctcttctcatgtgggggctacccaaacatcccgttgataggaacgaggggttgcattaactacaatcccgcacttgctataagacagttagggtaccccatgaggggagcaccgacggaagaaagcctgcctcctttccttgtgagagattttggcgcgcaaaatttcaaggttatacaaagaggccataaggcgtgggaaagcccgttaaggaaagataaagagcttaggggcattcgtaatggcatcattggtggttatcatgaatggctgaaagttcgtacacgaggaagacttaccaaagaaaaattcaagttcgtcgctacagatgtccggaaaaagtgtgccgggttacgagaagaaaatgcagctaccgcgaaagcccttgaataa

SEQ ID NO: 25208 - DNA, 250 bp, Glycine max
  Peptide Sequence Number=SeqID_116893
gtcgactctagaggatcccacggttcgccagcaggcggccaaccaccgggggcaggtgcagatacatgagtgtctctaccggttcagcctcagtcagcaggggcagggtttagctccttttgcatgccctactccagagaaatttggggctgaggcgcatggcccagagattggcccgaggcccaggcaggggaggagcccgcaggatcccccggtgaggcagaggaggcccgtatggatgaagaaatga

SEQ ID NO: 25209 - DNA, 360 bp, Glycine max
  Peptide Sequence Number=SeqID_116894
atggcggagatgggctcggcatatcgtaaggaagagggcgggatctattcgtggatgaaccgcagcgtcgggccgcgctttgcgtttatcggcacctttatgtggttttcctcttatgtggtgtggatggtcagcaccgcggcgaaaatttgggtccctttttcgacctttctcttcggcgcggataaaacccagagctgggcttttgccggcttaacctcgacgcaaaccgtcggcgtgctggccgcctgctggatggtgctggtgacgctggtggcggcgaaagggataaataagattgccaaaattaccgccgtcggtggcatcgcggtgatgtgcctgaacctggtgcttctgctg

SEQ ID NO: 25210 - DNA, 1119 bp, Glycine max
  Peptide Sequence Number=SeqID_116895
atgtcaccagccttccgcaaagtgtacggaaagattctagatttgaccgcagtggaggtatttacagaagctgtcgtatccctcgcccaatactacgaccagccgttgaggtgtttcacgtttggggacttccaaatggtaccgactattgaagagtttgaggaagtattaggatgccctcttggggggagaaaaccgtatcttttctctgggtttcttccctccttgagcaagattgccactgtggttagggattcggcaaaagagttggatcacatcaagcaaactcgcaacggcgcagtaggcctgccacggaaatacttggaaggcaaggcaagggatatggcgagccgagagaagtggggcccgtttgcggatatactagctttgttgatttttggggttgtcctctttccgaacgtggacggtttggtggacttagccgccattgacgctttcctcgcgtatcaccatagcaaggagagtccagtggtggctatcttggcatatttgtttgatacctttgacaggagatgtgagaaaaatagtgcacggattgtctgttgtttacccgctctctgtgtgtggttggtttcacacctattccaacaagacacaagatacccgtgtccacttcaaagctatcgctcatgcgccgaaaaaggaagagtcgattgggaccaacatttggctggaataggaggcaacacaatcaattggtttcctcgttggaaggaaggcaaggaaggagttcccttctcgtgtggggactaccctaatgttccattgatagggactaggggttgtattaattataatcccgcactcgccataagacagctagggtaccccatgaggggagcgccaaccgaagaaagtctcttgcctttccttgtgagggatctaggcgcgcaaagtctcaaggtgatacaaagagtccacaaggcgtggagaagtccattgaagaaagacaaggagcttagatgcatccgaaatggcgtcatcggtggttatcatggatggctaagagttcacacgcgagggttagattggctctccaaattgaaagttatcaatgaggagaacttcgaagctccggaggaagatgaagaagtctaa

SEQ ID NO: 25211 - DNA, 119 bp, Glycine max
  Peptide Sequence Number=SeqID_116896
atggatacctcagagccctacactgtggcaatgaaaggcaccatgcaaaaaggtgtgcggaatgaccataatttgtctctacgtgccatcggacacgattgtcttcgaatggcgaaaag

SEQ ID NO: 25212 - DNA, 240 bp, Glycine max
  Peptide Sequence Number=SeqID_116897
atgctcgtcaggggggcggagctatggaaaacgccagcaacgcggccttttacggttcctggcctttgctggccttttgctcacatgttcttcctgcgttatcccctgattctgtggataaccgtattaccgcctttgagtgagctgataccgctcgccgcagccgaacgaccgagcgcagcgagaaacagctatgaccatgattacgaattcgagctcggtaccctgaccatggcataa

SEQ ID NO: 25213 - DNA, 122 bp, Glycine max
  Peptide Sequence Number=SeqID_116898
ttattgctgttggaccttgtggcctcaataacaatgtgaatgtatgtatacatgattttgatgatgtcaaagaagaatctaacaaggctgcttcaaatgataagcatttgcttcaagaataa

SEQ ID NO: 25214 - DNA, 651 bp, Glycine max
  Peptide Sequence Number=SeqID_116899
ccagtacgacagcgccagcacggaaagaatctccaggtgcgatgccgcaaaggccgggccgatgggcgcgcgcttgagcaaggtcatccacgagaaaaaggcgccgatgtaacccacgaaggcgccatagatccagggctggccgaacacgcgcgccagccagtccaccgagaactccagcggcagcgccgcattgccggcctgcttgaagctcagctgggccagcgtgtcgaaggccatgagcaccagaaagccaatgaaatagaaacgtttcatctcagttattcacggggctgcgcgccgcccgcatcgtatgaaactggggagccccaaagccagggacaccgaggaagggccgccccgcaccgagggtgtcgtccccctcccgcgaagcgagagagggcgccgtgcacacgggggaaggcgcgaagcgactcagggggtgctgtttcatctcaatgcaggcccacgatggcgacgccgatggacaccagaacgatgcctgccacgcgcatgggtgccagcttctcggcaaacagcagccggcccgcgatcatgatggccacgatgttgatggagcccagcagcacaccttcggacagcggcaccagcgagagaaaggccagccacagcacgaactcggccacatag

SEQ ID NO: 25215 - DNA, 204 bp, Glycine max
  Peptide Sequence Number=SeqID_116900
ttttggggtcttttcatgagagttgatgcactcccgagggttattgtgaccgacaaagatttgtctttgatgaatgtagtgaaaactgtattcctggatgctacgaacttgctgtgtcagtttcacattgacaagaatgtgaaggcaaagtgcaaaaacctgattgctcaaaagaatgcatgggattatgtgatggagggttga

SEQ ID NO: 25216 - DNA, 1077 bp, Glycine max
  Peptide Sequence Number=SeqID_116901
atgctgcaaaaacttagacaaacgtggttttccaacgtccgtgccgacgtgctcgcggggctggtggtcgcactcgcgctgatcccggaagccatcgccttttccatcatcgccggggtagatcccaaagtcggtctctacgcctccttctgtatctgtgctgtcatcgcctttgtcggcgggcgccccggaatgatctcggcggcgacaggcgccatggcactgctgatggttacgctggtaaaagagcatggactccagtacctgctggccgcgacgctactatgtggcgtacttcaaatccttgccggctacctgaagctcggctcgttgatgcgctttgtttcacgctcggtagtcaccggcttcgtaaacgcattagcgattctgatttttatggcgcaattgcctgagctgaccaatgtcacctggcatgtctatgccatgaccgctgcgggcctgggaatcatctacctgttcccgtatgtaccgaaaatcggcaaggtgattccctctccattggtgtgcattctgacgctgactgccatcgccatttacctcggtttggatatccgcaccgtcggtgacatgggccaactgcctgatacgctcccgatcttcctctggcctgaagttccgctgaattttgaaaccctgcgcatcattttcccgtactcggctgcgttggcagtagtgggtctactcgaatcaatgatgaccgcgaccatcgtcgacgaccttaccgacaccaccagcaacaaaaaccgcgagtgcaaaggccagggtgtggccaacatcgctgccggcatgcttggcggcatggcaggttgcgccatgatcggccagtcgatcatcaacgtgaaatctggtggccgcacccgtctctcgacattgtgtgccggcgctttcctgctgctgatggtggtatttcttggcgagtggctctccaaaatccctatggcggcactcgtggctgtgatgatcatggtgtccatcggcacctttagctgggattccttgcgtaatctgaaagagcatccgctgtcgaccaacctcgtcatggtggcgacggtcgtg

SEQ ID NO: 25217 - DNA, 223 bp, Glycine max
  Peptide Sequence Number=SeqID_116902
gtcgactctagaaggatcccacgggctacacgacctcgccatcagagggctgcatgccctcaccatcagaggactacacgtcctcgacatcagaggactacacgtccttgtcttcagaggactagacatcctcgcctttagaggactagacatcctcgcctttagaggactacaagtcttcaccttcagaggactacatgtcctcgccttcagaggactatag

SEQ ID NO: 25218 - DNA, 210 bp, Glycine max
  Peptide Sequence Number=SeqID_116903
atggagaattggcgaacagcgctacgcaataacttcgcggggctccagactcgaagagaatggagaattggcggacaacgctatgcaataacttcgcgcggctctagactcgaaggtggaggacacatgaacagcgctaggcaattacattcatgggtctctccaataaaagtggagaatggagaattggcgaacagcgctacgcaataa

SEQ ID NO: 25219 - DNA, 306 bp, Glycine max
  Peptide Sequence Number=SeqID_116904
tactgcacccagagacaggctcagggtgatgctccacaggccgcaggcgcgccgccaccacctcatcaggctggcccggctgggtcgtttgacatggatcagtatttacggcatttggttcgccagcaggcggccaaccaccgggcacataccagttcaggggtagaggtcgcatggcccggggattggcccaaggcccaagcaggagaggcacccccagaggctcccgacgatggagaggaggcccacgaggacgaggagatggccgatttgcttgacttcttgggagggagtggagctacatga

SEQ ID NO: 25220 - DNA, 132 bp, Glycine max
  Peptide Sequence Number=SeqID_116905
atggctcgtgacggtcaccaatggttagtggtggtggaggaagaggttgggggtgttgggggagggtttaggggaagagatggagcctgcaagactcgctcaagcaaactttggctcatctgggcgagctga

SEQ ID NO: 25221 - DNA, 630 bp, Glycine max
  Peptide Sequence Number=SeqID_116906
atgtcgctctgggaatttttccagagcctggggaaaaccttcatgctacccgtggcgctgctatcgttttgcggcatcatgctagggatcggcagttcactcagcagccatgacgtgctgacgcttattccgctgctcgaccagccgttcctgcaatacctgtttatctggatggcgaaaatcggctcctttgcctttagctatttgccggtgatgtttgccatcgccatcccgctgggcatggcgcgcgaaaacaaaggcgtagcggcgtttgccggcttcgtcggctttgcggtgctcaatctcagcgttaacttctggctgaacatcaacgggattctgccgactaccgatgcggcagtgctgaaagccaataacgtgcagaacattctcggcattcagtccatcgacaccggtattctcggcgcggtgattgtcggcatttgtggtgttctggctgcacgagcgttttcacaatattcgcctgccggatgcgctggcattcttcggcggcacgcgctttgtgccgattatcaccaccgtggtgatgggtctgctggggctggtggtaccgctgatctggccattctttgcgcgcgcgattaccggtcttggctggatgatcaatag

SEQ ID NO: 25222 - DNA, 246 bp, Glycine max
  Peptide Sequence Number=SeqID_116907
atggatgattacgtaatccgtaaggttccgcaacattacggaaagaaaacaagtatcgttacggaaaaaagaatcaccaaaaaaaggcaggagggtgtatttagtaaaaaagggggttcaaatagcaaccagcccacttgggccttccaggatgttcctccagaaggcggttgcttctggaggaagcaacctagctcgcctgggcgagctgggtggcaagctcctcccctattttcctataaatag

SEQ ID NO: 25223 - DNA, 387 bp, Glycine max
  Peptide Sequence Number=SeqID_116908
atggggtcctttggagaagctggttgggagtgggaattctcatggagaagaaatcttttcgacaatgagttgggaagagcttcagcctttattgaacaggctacaacactaagccctaatgcagctttgaaggattattgggtgtggggagctgacccaaagggaatctttactactagaactgcctatctttgtattaaaggtgatcagccaattggctacctaaatcgtggcttcagtcagctgtgggaaatcaaagtacctcctagagccctatcctttgcttggagactactttgggataggttaccgactaaggaaaacttaactagaaggcaagttgtaattgaaaatgatctttgcacctttttgccaaagccaagttga

SEQ ID NO: 25224 - DNA, 315 bp, Glycine max
  Peptide Sequence Number=SeqID_116909
atgctactcacaatactgcggatcttcttatccatcttcgggtctacttccctaggacttgttgcaatgctaggtttttcaggaacaggggctggaccaggaattatttgtatgggttggatattgaattcaggtcgttcctggtttgatggtgctttggtggatgatggagatgatggtacagagggtgaaccaggagctgacgtttcttttggtgaggtagccatggaggagcagagcttttggagtggtttcgggaatatcagagaggtgttgaggaatgctgatgaaaacgagattgcctctaaaatatga

SEQ ID NO: 25225 - DNA, 165 bp, Glycine max
  Peptide Sequence Number=SeqID_116910
atggatttcaacagtgatgatttcatggacaaattgcgtgaagccttaaggaacgttgacatgagagatgaacgatggaggcctagaaggggtgaaccacgtccaaacgtggatgagttcaaaatcaccgaactacctgaatttaatggtagtgcagacccggag

SEQ ID NO: 25226 - DNA, 210 bp, Glycine max
  Peptide Sequence Number=SeqID_116911
tccccagtggagtcgccaaatgtcgcaacctacccttcggcaggagggcgacgcggggctcacgagtgcgtcttccaagaaaggaaaatgtgcagagtcgccatcaacgtttattcaaggaaaacatcggaaaaaccggaaaagggtgtttccctcgctcctatgtatcctcaattgcaatgtggaaatcagacctacgtagttctttga

SEQ ID NO: 25227 - DNA, 959 bp, Glycine max
  Peptide Sequence Number=SeqID_116912
atggcaacgatcaataaagaagcacgggcaaaccgcaagcagcaaattctggaaacattggcaggcatgctgcaaaatccacgcggcgaaaagattaccacggcagccctggcagccaagctggaggtctctgaagcagcgttataccgccactttgccaacaaggcaaaaatgttcgaaggcctgattgagtttatcgagggcgcactctttggcgtcatgaataaaattacgacggacgaaaccgatggcctcaaccaggtacagctgatgctgcagaccatgctcaagtttgccgaacgcaatcctggcatgtcgcgcgtattgatcggcgacgcactcgtgaatgaagatgaatccttgcaggcccgcattaaccagttactggaccggcttgaggccagcctgaagcagtcattgcgtatcgccgaagcacaaggccataaggtcgccgatgcggggattgcagccaacaccctcatcagctttgtgctgggccgttggcatgcctttgccaaaagtggattcaaacgtaaaccgagtgacaaccttgaacagcatatggaaaacaccgtttttgggatgaacgaagcccagctcaccgagtttggcatgagttggggcctcgctggtctgattctgttcatcgtgtttattgttggcaacctggcctggaagtccaaagcgggtaaaaccgggacatttgcggagtttctgcactgcggccatcgttcacaaggaacgtttatgcagcagatactcgtctattctgactcactgagttggggcattattcccaacacacgccagcgactaccatttgaccagcgctggcccggcgtgttggaaatcacactcaatcagtccggtagccatttcagggtcattgaagactgcctcaacggacgtcgcaccgtgttcgaagacccgtataagcctgggcgcaatggtctgcaaag

SEQ ID NO: 25228 - DNA, 528 bp, Glycine max
  Peptide Sequence Number=SeqID_116913
atgtattccccattgaagaaaaaactcaagaaattcattatatgggaaatcaacagcgacaagggtatactcaaggaggattttcaggcttccagcagggtccttataatcaacaaggatagtggaggtcacaccctggcaatcagtttaacaaagagcagggtataccttcaaaacaggccaatccaacaagggcctaacatctttcagaggactactaagttggaggagactttgactcagtttatgcaggtaacaacgtcaaattataaaagaactgagtcagcactaaagaaccttgaggtccaggtgggacaactgaccaagcagatagctgacaagtcatccaacaattttatgacaaatacagaaaagaatcccaaggaggaatgcaaaactgtcatgacaaggagtaagaggtttgtggaggctgaggatgaggagagtgttgtgcacaagaagaaaggtactgatggcaagaaaaatcatatatgcctgctccagaacaatatgtttgcttacaggtaa

SEQ ID NO: 25229 - DNA, 285 bp, Glycine max
  Peptide Sequence Number=SeqID_116914
atgactcatcaagattttcaagtttatgccactattgtaaaccacactggaatgtgggtgcaagccattgagagaagtgagttatcaagaataagagtcattcgacttaacatgtcaactgaaaaaatccttcaactatttctcatccttgaaaaattctttttgcgaggatcaaccgcttttttcattcttccttgctacaaggttgtggaaacaaaacaacgatgggtacctcaaagccttacactggggcaaggaggggcaccgtgcatgagcctcaagtga

SEQ ID NO: 25230 - DNA, 513 bp, Glycine max
  Peptide Sequence Number=SeqID_116915
atggggtgtattttcaataaaaacaaggggtggcaacagccattcggcctgtttgctattttgctggcagtattcagccagggtgttgctgaaacttctctggcggcagattcaggctggctgatgcatgacctcgctggtcggactcaccagctcgcccagtataaagggcgatgggttgtggtgaattattgggcgccctggtgcccgccttgtctggaggagatgcctgagctcgtgaccttttatgacgcacatgccaaagaagccatggtgctgggggtcgcagtgcaatatacaactgagcaatcggtgcggaattatattgaagatatgctgatttcttaccccatcatccttggcgaccagcaaaaacatctgcccgtaactcccgaggtgctgcctaccacttacatttatgcgccagatggctcgctctataaaataaaagcgcggtgccttgagcaaagtttggttggaatccttactcaaagtcgccgcgccggtggctaa

SEQ ID NO: 25231 - DNA, 590 bp, Glycine max
  Peptide Sequence Number=SeqID_116916
atgagcgtccatgtagctcagttgattgctgattccatctatttatttgcaggtatgccacccaccaggcaccctctagacccggataagtctaacagggccctagggtttccagcattaatcacgagcctctgtcagtcattcggggttcccgtcacacctagtaaggtgatccgaccgccaatcacccgggccttcattgagaagtattgcatgcctaggcaggcgcaggatgatgcaccgcaggccgcagacacaccgccaccacctcatcaggctgatcccgctgggtcattaggcatggagcggtatctacaacacttggttcaccagcaggcggccaaccaccgggggctggtgcagatacatgggtgtctctacctgctcagcctcagtcagcagggccagggttttgctccttttgcgtgccctactccagatcagttcagggctgaggtcgcattgcacggagattggcccgaggcccaagcagggggggcgcctgcaggagctcccggcgatgcagaggaggcccgcatggatgaggagatgacagacttgctcggcttcttgggaggaagcggagccac

SEQ ID NO: 25232 - DNA, 117 bp, Glycine max
  Peptide Sequence Number=SeqID_116917
atgaggaccaccacgggggaggagcttgccacccagctcgcccaggcgagcaaggttgcttcctccagaagtaacaaccttctggaggaagaatctggaaggcccaagtgggcctga

SEQ ID NO: 25233 - DNA, 567 bp, Glycine max
  Peptide Sequence Number=SeqID_116918
atgggggccaatgactacattctgaaaaccacaccgcctgccgtcctgcttgcccgcctgcgcctccatttacgccagcacgccagcatcgaacgcgaagcaccggcgccgtctctgacaccgcataaagccatgcggtttggtacgctgtcgattgatccgattaaccgtcaggtgttgctgtccggggaacttatagccctctctaccgcagactttgacctgctgtgggagctggcaacccatgccgggcagatcatggaccgtgacgcgctgctgaaaaacctgcggggagtaagctatgacggaatggaccgcagcgtggacgttgcgatttcgcgactgcgcaagaaactgcaggataatgccaccgagccctatcgcatcaaaaccgctacccttaaccacgcctccccctcacgcaccgatcaaaaagcgctctttgacctgctggagctgatccagtcatacgaaatactcctggacctcattcgcgaattcgggacggatgtgattgatatgcacattgcggaaggcctggccgtgacggaaaaactcatcgccaag

SEQ ID NO: 25234 - DNA, 144 bp, Glycine max
  Peptide Sequence Number=SeqID_116919
atgactttttcgcagtctctggtcacggaagacgcaaacatctacggggaagcaaatgagactttctcgctgtctcggtcggaagacgttgacatcctcggggtgaaggtgacgatgttgtcatcgcatgctatcaggctttga

SEQ ID NO: 25235 - DNA, 441 bp, Glycine max
  Peptide Sequence Number=SeqID_116920
atgctcctatcatacctgccaagagttcctcccaatttgcctttcccgttttggcacacatgcgatgaccttgtaagggatagacaggtctaccttcatgacgaaaaaagtgggagaccaaccatacataaaagagggtgtacatataataattctcccactgctcttttcacatctcaggtcgaatgtgtcacaggcatcggcaaaaatggcaatggctttgctttccttgctatggtgataagcaagaaaagcattgatcgctgcttgtcgcaacgtgcccttcgcgggcgagcgagggcgaggctcacgggtgcgctttccaaaggaggaaagatgcgcggagtcgccactaacgtttatttgtggaaaacgtcgaaaaaaccgaaggaaactggtcaaaaggaaaattctaagttcgagagttgtatttacgcttga

SEQ ID NO: 25236 - DNA, 186 bp, Glycine max
  Peptide Sequence Number=SeqID_116921
atggccactgttcaacacttggtgatggacgacaagaagaggaggcccattatctgcagaaccaagccagacctcaacaaaactttcaaggaagctaccaaggctataggggtggctcaggtccttctaacaactcttatggaggttcttcaaataaaggtccacaacaacaacaagctcaactag

SEQ ID NO: 25237 - DNA, 270 bp, Glycine max
  Peptide Sequence Number=SeqID_116922
gttgaaattgctggtgttggcagcttgaacatacgaacttgtataaattactgggaattgataactaagtttttggagctgaaatttttactgcattttctagacatctggaccaaaattacggagaaaagaaccaagcgatttggtgatatgaatggcagcataaaggagaaggaagagagagaggagatgccacttcaaggagaagatgagtctagaagaagctcaccaccacaggaggccatggataagagcttggaggaagaatga

SEQ ID NO: 25238 - DNA, 271 bp, Glycine max
  Peptide Sequence Number=SeqID_116923
atggctcacaaatattgctttcaagcacttgatcaaaatattggagatggagttattgggaatcaaaatgatggatatgctacggttgaaattcctgagtacctactgattactgaatataatgaccccattgatgctatagtcagatcagcattcccatatttatatcaacaccatagtaatcctgaattcttcaaatgtagagcaatattagcttccaccaatgaaacaattgaagaggtcaatgattatatactttccttgattccag

SEQ ID NO: 25239 - DNA, 258 bp, Glycine max
  Peptide Sequence Number=SeqID_116924
atggctccgagaaagctttccgcaaagagatctaggaaggacgtcgcggctgaagggaccaatgccgcccccgagtttgacagccatcgtttcaggagtgctgagcaccaacaacgtttcgaggccatcaaaggatggtcgttccaccgagaaagacgcatccagctcagggacgatgagtacgctgattttcagggagagatagctcgtcggcgttggacatcactggtcactcccatggctaagttcgacctagat

SEQ ID NO: 25240 - DNA, 216 bp, Glycine max
  Peptide Sequence Number=SeqID_116925
atggcatgtccatgctgggatgctgatgggttagggggaaagttgcgcaatgacgatcgcaataagggtaagagtcatgagaagcacaagggtgagaggcatgaagatcacaataataagggtgagaacaatgagggggacaaaagagagaaccgtagtgggaagatgaaggagccagaaaaaagctatgatgagtatctgcatgaaaaaatatag

SEQ ID NO: 25241 - DNA, 228 bp, Glycine max
  Peptide Sequence Number=SeqID_116926
gaagctgggtgtttcggtcttttcctcttttgttcatgtggggtggggatatccccagtcgagaatgactttggaatggagattccgtcgtcctttgcttcgggggaaaggatgaggattcttttgatagaccaaggttcaaaaaagtctaaggttgtgtttcaatggggtcttttatcgtgggaacccaatcttgatatctggggtaaaacaaatttgggtgtcaag

SEQ ID NO: 25242 - DNA, 294 bp, Glycine max
  Peptide Sequence Number=SeqID_116927
atgttgctaagtagcaatgtcatcctatatctgtgtaagagtggtcatgttggtgcgcatgatccgcactcgtctctttgcagcgggcacggggtgaaatcttgcccccgggtgtggatatggagcccactgaaagtgaggacgcgtagtcctctaaaggcgagggcgtgtagccctctgaagttcaggacgtgtcgcctttcgaaggcgagggagtgtagtcctatgatggcaaggacgtgcaaacctatgaaggtgagggcatgcccccctttgaaaatggggaacatgtag

SEQ ID NO: 25243 - DNA, 258 bp, Glycine max
  Peptide Sequence Number=SeqID_116928
atggcaagaaagaagggtgaccttacattcataagcaatctcttgaagaggaaggcagtgttgaagaaaaggaaaaatgatgatgacaaaaggcccaagagaatgatttcaagattgagtcaagaacaattcaagaatcaagagaaatttgatttcaagattcaagaatcaagtttcaagaatcaagaatcaagaataatcaagatcaagattcaagactcaagattcaagaatctagaaaagactcaatcaagataa

SEQ ID NO: 25244 - DNA, 219 bp, Glycine max
  Peptide Sequence Number=SeqID_116929
atgtaccctcccttgttctctttgaacaacctagtggatgtaccctccactagaactgatccacaagagatggaatgggaagaatcaaaagaattctcaaactgtgtcattttgaattctttgacaagggagaagggagacacaaaagaattcaggcgattagtcctttgttcttttggaaaagggagaagagagatacaaaaagaattcaggcggtag

SEQ ID NO: 25245 - DNA, 255 bp, Glycine max
  Peptide Sequence Number=SeqID_116930
atgttgagtgatgttggaaatgctttggcatggtctttggcactttctttgggccacgttcatacgttggatgttgtgtatgttcgtgggggggagggcgggcgggggaagtgcactggccttccagggtctttggcacttgctttgggccactttcatatgttggatgttgtgtatgctcgtggggggcgaagtgcactggccttccagggtctttggcaatttctttgggccacgttcatacgtcgtatgtag

SEQ ID NO: 25246 - DNA, 303 bp, Glycine max
  Peptide Sequence Number=SeqID_116931
atgccttgcaggtcgactctagaggatcccacgtccaaggatgccctgattgctgaactcaaggacacatgcaaggtgctggaagcaaccatcaaagccaccacagaaaagaagatggagctagaacggctgatcacaaggctctcagaaagtggcattgatgatgaagaagcagctgaagaagaggaagaggcagctgaggaagacaaagaagcagctaaagaagaagaagaagctgctgaggaagaggaagatgcagcagaagagacagaatcagatgatgattctgaagccaccccatga

SEQ ID NO: 25247 - DNA, 1155 bp, Glycine max
  Peptide Sequence Number=SeqID_116932
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgaccacggcagcttgcccagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcgggtcgttcgactgcggcgagcggaaatggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtgactgcgctcctccaagccagttacctcggttcaaagagttggtag

SEQ ID NO: 25248 - DNA, 272 bp, Glycine max
  Peptide Sequence Number=SeqID_116933
gggtgtattcattgatggttcatggactgacgacccacacaaggtgaagaaagaggtgaaatcctttttcttccataggttccaagaaccaattggtcagcgacccaagattgatggaatcaggtttcaaactgttaatctacagcagaataacgagcttctggcacctttcatggacgaagaaattcagaaggcaatttttaaagctacagcgaagttttttatgaaggaaggcaattcacaaaaggattgcatggatttaatggaaatcg

SEQ ID NO: 25249 - DNA, 258 bp, Glycine max
  Peptide Sequence Number=SeqID_116934
gcggccaaccactgggggcaggtacagatacatgagtgtctctaccgcttcagccttagtcagcaggggcagggtttcgctccttttgcgtgccctactccagagcagtttagggctgaggtcgcgtggcccagagattggcccgaggcccaggcaggggaggcgcctgcaggatcctcgggcgatgtagaggaggccctcatggatgaggagatgacggattttctcggttttttaggagggagcagagccacatga

SEQ ID NO: 25250 - DNA, 297 bp, Glycine max
  Peptide Sequence Number=SeqID_116935
ggtttcgttctctaccgaaaccgtgagccaagttggaagatttcgcttcggttgaagggttcctctcggtgtggggttgcaacggaaaacaacagtggtttgtggtggttaatggtggctgtgggtgatggagaaagtgcttgggacgttagaaatggctttggaagaaagaaagaagaagaaatggtgtttttcctaagctacacgaaggcaaaggctgaaaacgctcaagtgagaaatggtctcggacacgaaaacctcccgcacactccagaaatcttctcaaagatcccaaag

SEQ ID NO: 25251 - DNA, 297 bp, Glycine max
  Peptide Sequence Number=SeqID_116936
atggcttctaggaaaagaaaggcaccatctacacccacccaagatagatttgacagatcaagatttacttcccaagaggcttgggaaagatatacagacattattgtgcctaggaagcttctaccagagaggaacgtggtggtctattatactgagtttgatgagttcaaggaggaactcgaaagacgctgctgggacaaggagttgactgactttggggatggcaatattgatgttgccattgtgaaggaattctacgccaacctctatgagcccgaggacaaatcacctaagcag

SEQ ID NO: 25252 - DNA, 214 bp, Glycine max
  Peptide Sequence Number=SeqID_116937
gtcgactctagaggatccccggttctacggggtgcctgtcgcccccagcaaggtcatcaggccccctactaatcgagctttcatcaagaattactgcgcccccaggcaggtgcagggcgaaacaccccagcagcctagggatggccggcagcgggcaacagacgcaccgccaccacctctagagttcacctcagctcatccacaaaaaggttag

SEQ ID NO: 25253 - DNA, 201 bp, Glycine max
  Peptide Sequence Number=SeqID_116938
atggaaaccattaggtctttccaagaatggactcgggaaggttccaagttagtgtaccagcaagaggggctcttcccaccacaaaatgcaagggttgcggttgtgggcgaaaatgagggccctccgaagtgtttgcaggggtataccacgaattgcttgccctttagtggcacatccaaggcaaggcttgaagtcagctag

SEQ ID NO: 25254 - DNA, 852 bp, Glycine max
  Peptide Sequence Number=SeqID_116939
atgcggaggatttccaaatgttcccttgatggggatgaggggttgcatcagctacaatcccgttcttgctataagacaacttggctaccctatgagaggggcgccactagaggatgcgccaacatggagacacttcagaaggtccgcaaggcatgggaggtgttgcaaaagaaggacaaagaactcaggggcagtaacaataggcccatcggtgactaccgtaagtggttgaaagcccacgtgcaaggtttggtttggcttttgagtttgagaactactaaaagagaggaagttgaggcaccggaggaagacgaagaggtgcaggcccttagggtggaactcgagcaagcccaaacagttaaagaaaggttcaaatcagcagctctgaaaatccaaaaggagaatgccgaactgagagatgtaaatgtggctaccaccaaagccttggaacgagaaaccaagagggcttgtagggaagaacacggccgaaacaagttccgaggggctctgtggggcagcaacaacgagcttaaactacgaagagaggaaaaggaccaatcacgagtagacagtttgatcttgaaaaatgaattgaaggcttgctcgaggtccaaaagaagtttgtctcagcggttatgcgagacagagaccaacatgttagctatcatcaccaggtaccaagaagaactaaatctagctgcggcccacgagcatagagtggcggacgagtatgcccaagtgtacgcggaaaaggaggctagaggaagggtgatcaactcgctacatcaagaggcaacgatgtggatggaccgatttgcccttaccttgaacgggagtcaagagcttccctga

SEQ ID NO: 25255 - DNA, 582 bp, Glycine max
  Peptide Sequence Number=SeqID_116940
agcgcctgctcgacgctgagcgtgatgccgttggcgaacgacttgctggccaccaggaattgcgtcgccagctggctgtcgctgtcgcggttgacgtcgccggccacggtgcggtccggcaggatgctgcccgagctgcccaggttgccggtgcgcacgctgacgtcgtccagcccgaactgcttgtagaacggctcgccgccccccagcagggccgtgcccaccgacagcagcagggcggcgtcgctgccgctttcgtcggggccgcgccccagcagcagccacgacagcttctcgacgtcgctgacgtccgggtacgacaccaggtcgatgcgcgggcgctgcgcgggcctcgatgtccagcagcgggttgtccagcgcccctggaaagtcagcgtgccgcgccgcaggcgcagcttctggccgtaggcctcgatgccgccgccgcgcgtgcgcagtgcgccgacgccagtcaggcggccgtcgttcagcaggatctggatcgaccccagcaggccggcatccagccccatgcccgtgatgtagaagcgcggccccatgtcgaacttcagtttcatgctg

SEQ ID NO: 25256 - DNA, 459 bp, Glycine max
  Peptide Sequence Number=SeqID_116941
ggcgcagaagacgacgttagtctctgcgtgctatcaggcttttcgtcttacagacaacaaaaagtttatacggataaccactcgggtatttccggccgtcagcgtgactcaaaagtcgcagaagacgatgttagtctctgcgtgttatcaggattttcgtcttacagaatgcaaaaagtttatacggataaccactcgggtatttccggccgtcagcgtgactcaaaagtcagtatgacagatcttgtgagcgcggaagatgacgcttttcgtcttacagacaaaaagtttatacggataaccactcggggcgcagaagacgacgttagtctctgcgtgctagcaggcttttcggcttacagacagcaaaaagtttatacggataaccactcgggtatttccgcccgtcagcgtgactcaaaagtcagtatgacagatcttgtgagcgcggaagatgac

SEQ ID NO: 25257 - DNA, 637 bp, Glycine max
  Peptide Sequence Number=SeqID_116942
atgacaaactcttcattctggttcacatgtactcatgtggttctcttttctgccaccctactatgtttgcaacctaagagcactcctagtgccttaggaaatgacacagaccaattatcatctctcagattcaaagaagcagtagaaaacaacccttttaatgtcttggcttcttggaatagttcaactcacttttgcaagtggcatggagtcacatgcagcctcaagcctcaaagggtcagtgcccttaacctacaagggtatgccttaaaggggttgataacacctgagataggtaatctcaccttagatgcttcttctacagttaaaaaactaaagttcattaaagagtgtataaggcagtggagtctatccaatggtgatgtcaatgctagaaaagtcccgaatttaaaaagggagttgaatgctttggaggttggtttcaatgatagaactctatctcaagatgaagtgagccttaagaaatcacttcaggacccactttggaatgcagcttatgcatttgaatctatgttgaggccaaaggctagagtgaagaggttcacagaaggggacaacaactctaactactttcctagattgatccatcatagaacgattccaaatgctattcaag

SEQ ID NO: 25258 - DNA, 342 bp, Glycine max
  Peptide Sequence Number=SeqID_116943
atgaatctatggaagagaatgggctcccaatggttgtcttctaactctagctcaagctttaggtctctctattcttctgaacacgaacttcctttttcttctctatgtttttcacttaaaaaccctcttgagcttgagatttcgcgaatatgcactgagcgtgtttgcgccctaagcacgaattctccatgctgcttcttcgcactaagcggaaaccctcctgctagcgacaacagctacctaagggtgcttggtgcactgagcgcgaatcttcagccttcaacttcttttcctatcccttgcctgtatttctgcaaaagaaaaaccatcaaaataatatga

SEQ ID NO: 25259 - DNA, 108 bp, Glycine max
  Peptide Sequence Number=SeqID_116944
atggacattaagaacgataggggatacaactgcactggatatgcaattggatgggctgccggagatgatcttaaaatcattatgtcaagaagttttgaagagggatga

SEQ ID NO: 25260 - DNA, 207 bp, Glycine max
  Peptide Sequence Number=SeqID_116945
atgtccctgttgtgtttattacttatgaccttatctatgaatcttgggaatagtcatttgtttcaacagggtcaaggatactcattacatgcagatatacagtatcttgatgctagatgggaagttcttgttgtgcttcctctgcgtgattgttttgcccaagagatcaacatgctatgccgccttgatgggtttgtagtcctctag

SEQ ID NO: 25261 - DNA, 234 bp, Glycine max
  Peptide Sequence Number=SeqID_116946
atggccacaatgatggaggccatgatgaacataaaggagataatggaggttaatgcggctgcaatagccgctaccagtgttgttgctaaggtgaactcgacgcccccatctggcctcaaccaaatgaatcatccaacctcagatatgatgattggcagcggaatggagaaggaagagagagaagagatgccacttcaaggagaagatgagtctagaagaagctcaccaccataa

SEQ ID NO: 25262 - DNA, 626 bp, Glycine max
  Peptide Sequence Number=SeqID_116947
tgagaggactacacgtccttgccatcagagggttgcacgccctcaccttcagaggactacacgtcctcgccttgagagggctacacgccctcaccttggggctgcacgccctcacctccagaggactacctgtcctcgccttgagagggctacacgccctcaccttggtactagttaccctcaccgttgagaggactacacggctacatgtcctcgccatcagaggacttcatgtcctcgccatcagagggctgcacgccctcacctccagaggactacctgtcctcgccttgagagggctacacgccttcaccttgggtactagttaccctcaccagttgagaggactacacgtccttgccatcagagggttgcacgccctcaccttcagaggactacacgtcctcgccttgagagggctacacgccctcaccttggagggctacacgccctcaccttgggtactagttaccctcaccgttgagaggactacacgtcctcgccttgagaggactacatgtcctcaccttcagagggctacagccctcacctcagaggacttgcacgtcctcgccttgagagggctacccgccctcaccttgggtactagttaccctcatcgttga

SEQ ID NO: 25263 - DNA, 232 bp, Glycine max
  Peptide Sequence Number=SeqID_116948
aaacgttggtggcgactccgcgcgcattcctttcgtggaacacgcatcccgcgagtctcgcgtcgccctcccgccgaagggtaggttgcgacagaaaggaagagcagaggccaaggttcgcggttgggacgtcaagtcgaaggggccccgccctgccacatcagtaagagcttttatgagcgcggggtctaaagacacgaaggcccaagtcatcgcgatatgtgagggatga

SEQ ID NO: 25264 - DNA, 216 bp, Glycine max
  Peptide Sequence Number=SeqID_116949
atgaagatgaaagcaaacaatacaagaaatgaattgaaagtctcggattggaacacttactggttgaagaacgaagaacgaacaaagaatggacgaagaatggtgaagaacggaggaaaatcttctcagatttgctcacgaaaatgtctcggaagcgttacggaagcacttcgactagatttttcttcacggaaacgtgtcttttacccaaaatag

SEQ ID NO: 25265 - DNA, 387 bp, Glycine max
  Peptide Sequence Number=SeqID_116950
atgcataaggcattacagaccaatgcacctcttccgtatcctcagttagtcactctttttcttcgtcactttcaaattcctctagatgatgaaccttttgttcaagtcaagagatctttggccattggtgctggaacgtggattaggaaacaagatttaccaccgccgattcctgatgagcgtactccgtctcctctgccacaaagagatgcttcctctactcttatgaatgaagtcctttctgaattacgtggccttcgagcgttcgtaggtgaccgtttggatgccatggatgctcattttgaaggcatggatacacggattactcagcttgaagatgacatgggtttcattcgtcgttgcttcgatccaccggctgccccatag

SEQ ID NO: 25266 - DNA, 201 bp, Glycine max
  Peptide Sequence Number=SeqID_116951
atggtggtgagattgttcttgactcatcttctccttgaagtggcgtgtctccaatcacctttcctccttctctatttcattgttgatcttcaagaagcaaaggactccattgatgaagaagatccaaggcctataagctctacatggagctacataatctggtgcgatgaatgtgttgagtggtgcaaccctcttttgtaa

SEQ ID NO: 25267 - DNA, 171 bp, Glycine max
  Peptide Sequence Number=SeqID_116952
atgactaaagaacgccaaaagggggtacagaaagaaaataggggagaagcttgccacccagctcgcccaggcgagctcgggttgcttcctccagaagaaaccgccttctcaaggaatattctggaaggccccagtgggcctggttgctatttgaacccccatttttactaa

SEQ ID NO: 25268 - DNA, 855 bp, Glycine max
  Peptide Sequence Number=SeqID_116953
atggaaccagaatactgggacaagaatcctttcaaagcaaccgccaaagtattttccccgggattccattacaggccaatagccacaaacaaaacccgtaaattctacgaattcatcctaatagatacaaactcagtatctattaaacacttcaaagaccccaaagatccaaatctaaatacccattccacaatccaaatcttgaaagttatgcagccacgacattatggctcaaacttaaaccaacccaaaaaattctctgcaccatttgaccctgcaggatataattattgggattacattgacgcctggaccaatgtgttctggcatcaaaatagtaaattcaagcattcatggctaatttacttcaaaaataatactgcatataattttccaaattggttcctccaatggtggaactacttcggaccaattcccaaatatttccagaagaagtccaacagggattcgaacaattcaacaagctctataatagcaaggaatcacagacacgcctttgtaaatggtggtcacaatttgatacttcaaagggctgctccagatcaagtcaagaactggttccagagcaatcctgagttccttaaacctgctgatccggagacatctttgtttctaaatcagaagtcgcaactggcagcattcttagcaagctcaaaatctaaagagagtcttgctcagaatctcaaagaagttctccaactacttcaacaggaagtggaagaagaaccttccaagaaggaagctgaatcatccgagactaatgatgaccaagaagatgatccattctaccagaatgaagatgaatgttttggtatatcattggacgacgattaa

SEQ ID NO: 25269 - DNA, 537 bp, Glycine max
  Peptide Sequence Number=SeqID_116954
atggcatcaagaaagagggctagaaccgatgacatcccttcatcatccatcctagctcctcagtcagcagccataggaccagatgtccaacactcacaaaccttagtccctatgctacaaagcttattcagaggacagcttattatcatgcacagcctgcgagagttggctcacaacaggccaatcatacctatggagcattttcttgagcaagtatcctggcttgaagctcaacttccattggtgagacccaatgaggctactcctcctgagcctgcaccaacacgggttgaaccaatgccagctgagctacgatctccagtggtgaatccacctccttctccagagcttgaagtagttcccccatctccacctttgattatcatctctgatgcatcatcagatgaaaccgctgcccctcctgattcaccagctggagaaacagctaatccccctgattccccagttgaaggaattgtcgatctttctgattcgtcatctagagaagctgttgctttcactgattccccattttag

SEQ ID NO: 25270 - DNA, 444 bp, Glycine max
  Peptide Sequence Number=SeqID_116955
atgacaaaaagatattggaacataatcttggaagagatgatggaagcaggagttcattttggccacgaaacacgacttcaaaagttcagggacttgagaatgcaacaaaagacggggagactcaatagttttccaaaaagagatgccgctatattgaagagacatttagctcatttggaaacatatcttggcggcattaaatatatgacggggttacctgatattgtaataatcgtcgatcaacaagaagaatatacggctcttcgagaatgtataactttggaaattccaacaatttgtttaatcgatacaaattgtgacccggacctcgccgatatttcaattccagctaatgatgatgctatagcctcaattcgattaattcttaacaaattagtatttgcaatttgtgagggccgttctagctatatacgaaattcttga

SEQ ID NO: 25271 - DNA, 525 bp, Glycine max
  Peptide Sequence Number=SeqID_116956
atgacgtgtaatcctctaaaggcgaggttgtgtagccctatgaaggcgaaggtgtgcagccctctaaagaggagggcgtgtagccctctgaaggcgagggcgtgttgccctctgaaggcgaggaagtttagtcctccgaaggcgagggcaagtagccctctaaaggaaaagacgcgtagtcctctgaagccaagcacgtgcagccctttgaatgcgagggcgtgtagccctcagaaggcgagcatgtgtaatcctctgaaagcgagggcgtgtagccctcggaaggcgaggatatgtagccctctgaaagcgagcacttgtagtcttctaaaattgagggcttgtagccctctcatggcctggacgtgtagtcctcagaaggcaagggcgtgtaggcatctgaagatgaggacatgtagtcctctgaaggcgagggcatgtagcccttcgaaggctaggacgtgtagtcctctgaagccgaggacgtgccatcctctaaaggcgagaatgtctagccctgtaaag

SEQ ID NO: 25272 - DNA, 324 bp, Glycine max
  Peptide Sequence Number=SeqID_116957
atgagggttcactgtaatcaagcaagtcggagacctagcatgatcacagattcacctctactccttatgttcccacgaacccggattaaatggcctaactctctaaaaacagtccctagtggaggtcgccaactgtcgcaacctacccttcggcgggaggggcgacgcgagactcgcgggatgcgtgttccacgaaaggaatacgcgcggagtcgccaccaacgtttatttgaggaaaacgtcggaaaaaccggaaaagacgcgatctacgaactttttagtgaatgtttcgggagttgtatttacgcacggggaaggtattag

SEQ ID NO: 25273 - DNA, 360 bp, Glycine max
  Peptide Sequence Number=SeqID_116958
atgttaaccgataaaagcaaagaggaccgtttaaggcgttggaccttaaaacggtttttagtgatttttcggacaaaacttgattttctcggattcgaaaacttacccgttgaagaacgaagaacagtgaagaacgtcgaagaacggtcgaaaaccttcgcgaaatcactcacggaaacgttacggaaacgttacggaagcgcctcgacttggattttcttcacgaaagttgggggagaagcttgccacccagctcgcccaagcgagcagggttgcttcctccagaagcaacaaccttctggaggatcttctggaggcccaagtaggcctggttgctatttgcacccccatttttactaa

SEQ ID NO: 25274 - DNA, 222 bp, Glycine max
  Peptide Sequence Number=SeqID_116959
atgacgactgaggccgcaaaggaaatcgctaagaagatcaattcctttgaggagcaggccatacaaggatccttcgtcccccatggacgtcaggatgttctcaccgctgctattggacgtgtccgtgctgctggagccggtgtcaccatcaagcaatactttggatcagttccacggacgtcccacagctcttcctccctgcctcccgaagaattgcaatag

SEQ ID NO: 25275 - DNA, 432 bp, Glycine max
  Peptide Sequence Number=SeqID_116960
atggcagcgcaattaatccatgatcgagtggaaatggagtgcctagagggagtttgggagaccctcgaaggcaatgcgaggtgccgattccgtggcacgattcaactcacggctacttcattggtacatccagaggaacccgcacacacgcttcagcgaactgtggagtggatactacctacacctactccatatcgactagtggagccagtccaagtgatagaggtgtcgtcatctaaagaagaccctgaggaggacccagaggagttacctcctgagcctgctgtggatgctcttaactttccagagggtgatgaggacccactccctgatgtggattctccagaggacgtcatgtcagcatctgaggcagactctacggaggagagcggccctggagggatagcgactagtggagactcttcatcatag

SEQ ID NO: 25276 - DNA, 930 bp, Glycine max
  Peptide Sequence Number=SeqID_116961
ctttctgagatttacgaaatcattccaaacgctctgcttttccatggctacctcaacaaaagaaactgcagcttctggttcacccgcagtaccatcatctccgcaccaggaacaaccggaattcaacatccaacccatacaaataattcctggatcaagcttctgtccctgagaaactgggttcccagaagacaacagggagggaagattgctgaaaaccctagccttgcacaagtcctagggaaatgtccaacatcgtccaacccaaatgtttctgtgcctgatgtcaagaaagatgttccaacatcttccgctccaaatgctgaagcactcccttcacccggtgaagagggatcaactgaggaagatgatcaagccgcagaggagactcctgcaccacgggcaccagaacctgctccaggtgatctcattgacttagaagaagtcgaatctgatgaagaacccattgccaaccggttggcacctggcattgcagaaaggttacaaagcagaaaagggaagacccccattaagaggtctggacgaatcaaaacaatggcccagaagaagagtactccaatcactcctgccacatccagaagaagcaaggttgctatcccctccaagaagaggaaagaaatttcgtcatccgattctgataaggatgtcgaactagatgtctcgacatctaagaaggccaagacttcagggaaaaaggtgcctggaaatgtccctgatgcaccattggacaacatctctttccactccattggcaatgttgaaaagtggaaatatgtgtatcaacgcagacttgcggttgagagagaactgggaagagatgccttggattgcaaggagatcatggacctcatcaaggctgctggactgctgaagactgtcagcaagttgggagattgctatgaaggctta

SEQ ID NO: 25277 - DNA, 346 bp, Glycine max
  Peptide Sequence Number=SeqID_116962
tgctggatttacgagcactttccctcagtcacaaactccattgctgatcaggaatacgatgaggattccccgcatcccatatggggagcaccgatcggttcgagacttccatgtcatatcatgctattccaatctcttgtgctcggggcctgttgttgtttattatcgaccagagagggtcgtgcgccagtttggatacacgcagaccattactgctcctcctgtcgtttcatgggtgtcgtatgatgatatacacgataggtggatgcactactcggatcatatcgttccagcaggtgaggtgtgcgctatgccaggtcagtgtgccagtgactacatggactag

SEQ ID NO: 25278 - DNA, 228 bp, Glycine max
  Peptide Sequence Number=SeqID_116963
atgggaagcttccctaagaagcaaggaagttacactcagctcaccatttgggctcagcgcgcatccaacgctaagtgcaacttcagcgtgcttagcgcgacagaagaatcttgcaaagcatcaatttcagggttacgccctaagcacgagatttgctcgctaagcgcgatggttgtctttagccaggctcagtgcatgactgacgctaagcccactaacttgcgctaa

SEQ ID NO: 25279 - DNA, 237 bp, Glycine max
  Peptide Sequence Number=SeqID_116964
atgaaggaaggcataagacacatcttagacctcactcccataggagagaaaatggaagaaagcctcaagaggctaacattaacctcccatacttccatggaaaggacaatttgccaaagaaatggacaaggtaggcatcttagggcacatcccttaagcccaaagaatgataagtgggaagcaatagaaaaggcaacccccttaagagctagtatgcaagaaaagatagctctataa

SEQ ID NO: 25280 - DNA, 165 bp, Glycine max
  Peptide Sequence Number=SeqID_116965
atgggtagatggatatgggcttttgcatctggtcagcagcagctttggattgggtttctgccaaaaatggagaagatgatctccagcttgccacatttcagcaaccaatcagttttgattaagtgggatagcccatctaaggagttcaacccctcaagaggctga

SEQ ID NO: 25281 - DNA, 839 bp, Glycine max
  Peptide Sequence Number=SeqID_116966
ctaattcaaagaagaaggtctcagccttttatgtgtttggagactccacagtagacccaggaaacaacaacttcatagacacggctttcaggagcgattttcctccctatggtagagattttgttaaccaggctgccactggaaggttcaccaatgggaagcttggcactgattttcttgcttcatatctgggcctaaaagagttggtgccgccatatttggatccaaatctcagcgacaaagaacttgtaactggtgtcagttttgcctctgctggttctgggtttgaccctctcactccaatgctggggaatgtaattccagtagcaaagcagttggaatatttcaaagaatacaaaaagaggttagagggtacgcttggtgcacggaaaatagctttggttggagtacctccaatgggatgcttgccgatcatgatcaccttgaattcccataatgtctttctcgaacgtggttgtgtggacaagtattctgctgttgcaagagatcacaatatgatgcttcaacatgaattgttcttaatgcaactaaatttctccaatactaaccctgccggtgctaaaatatcttacctcgacatatatggacccttggatgacatgattcaagcgcatcaaaacctaggttttgatgaggttgatcgtggttgttgtggaagtggttacatcgaagcaacttttatgtgtaatggggtttcatatgtgtgctctgatccatctaagtttgtcttctgggattcaatacaccctacggagaaggcatactatgacctatttatggccgcccgtcccacaattgatgcccttatcaatggctag

SEQ ID NO: 25282 - DNA, 150 bp, Glycine max
  Peptide Sequence Number=SeqID_116967
atgctcatggtggcacaaacggaggttgaggttgcatgcgcaaggagcctcaaagggaaaaagggagggagaattaagaggggtaagaagaaggataggttaccccattataagcaagatgtgttggatatcttggcttgcctcacttag

SEQ ID NO: 25283 - DNA, 396 bp, Glycine max
  Peptide Sequence Number=SeqID_116968
atggcgcaacaatcgtcacctccacggcggcaaactcctccgccatcgcagtacctggaggtcaactgcagaagctccggcaagatacggcggtttgcggcgggcaccggcgcggggtttgcggtggcgctgatcaatcggaagctgaagggaacggtggtggctgcgtcgcacatagaagcagtgaaggatgggaaagaagaagaaccaatcgcttttggccccacttcgcttctttctaacttcggcgaagaagtggggaatggacaatttcaacagatggcaatgcagaaaccaggactaatttctgaggtagctgaagcaaggctgcaatattcaactgcagtaggtggccacaacagtttgttttttgtgctactaggactaggagactag

SEQ ID NO: 25284 - DNA, 6651 bp, Glycine max
  Peptide Sequence Number=SeqID_116969
atggagctctcggattccaccggcggtgaccgaaacctcaacgcgccgccgccactgccgccgccgcacaacaaccacaaccaagacgcgcgttccggcctcggaatcgacctaaacgagatcccgtcgccttcatcttcgtttccagaaaccctaccgggctccgtcaccgtcgacgtcgtccgctcatatcacgacaacccggcgccgcctccgggaggtcccgccgccctcccccgcagtggctcctctccctgcgccgcatgcgccaagccctcccccgccgccggcagccaccaccaactcgtcgtgtgcgacggctgcgagcgcggcttccacctcgcctgcgccggaattcgcggcggaggccggcaggcagcgagcctcgacgaatgggtctgcggcgagtgcgtcgccgccggagtgaagagcaagcggtggccgttgggcgttaagcagcttctcgatatcaatgctccgccgccgagcgacgccgaaggcgacggaggcgacgatgaagtgcagttaaaccctttaaggaggtttttcagtgaggatgttgggaatgagtggtatggcttgttgcacgctctgggtgataattcttttgctgccaatccatttggtgccctagtgacgaattcaaacttcaacaatgggaatgctaatggcttcgaaaaggcatctgaagttgtgacacatgctgttagagtcggttttgaggatatattgaaccatactcagtcaattactagaagctttgaggaggctcttagagattttgtatctgaacggcgtggtgtactagaggaaggttggcgagtggaatttagacaatcagtgagcaactctgaactgtatgcagtttactgtgcaccagatggaaagatatttgattctgtgtatgaagtggcttgttatttggggctaacgtctggctacaactctattgaatctgaactaaggagtgagaggtctctcccttctttaggtgggcctccatccagaaaaagaaagtcaacaaggactacagtagccaacggttctatggaaaatcggggaacctcgacgaatagtaattgtaaggatcctccttgtgatggtttaaatgtggaatgtgctagtgctaggggaaatatcccaaaaccctctgaaattggaagaaaagaggattgccactcctgctctcaacaatctgctgatggacttcctctacagttcaaggacttctttgttctttctttggggaaagttgatgggagaccttcatattatgatgttaatcttatctatcctgtaggttataaatcttgttggcatgacaagatcactggctctctttttacatgtgaagttttggaaggtggtgattctggacctatatttaggatccgaaggtgttcctgttctgaatttcctgttccagttgggtcaaccatactctcaatgtcaaaactttgtcaagttgtgagtcaaaccaatgaaggtgagagaaaaactaatgctaatatggatttagattatgatgaaggtctccaaatgatgcttttagactcttgtttgccaacggaaaatgatatcctaagttgcttcccaagctgctcgattgagtcacgtgatatgtcagatgtattacaccctattactagttcagttcaagataatgctagcaattcattagctgataacttggggtttaatggccttggcgaaattttggtggaagagcggtcgtcattctctgcgtggagagttatttctcaaaagctagttaatgcttgcaaggatatcttaaaactgaaaggaactctcaagttctattgtaaccatgttgataagtgggatttaaggaatggaaaaagtgatacatactgtacttcgttggataaattttgtggttctcttggttcagttggcatcccagatgtaatttattcagacaatgatctggaaggtatctacgtggcattgggaaaatggttggagcaggatagatttggattagatgttgaatttgtgcaagaagtattggaacagcttcctagtgtccaagactctttgcagtatgaacttttaaataatagaaataatagctcgtcattgccaacagttgaaaatggtttcttagtggttgaatggagagatggatcaaaatatcaggaagaagcagttcaagctttatatggaaggtccaagaaggtgactgaaaaaagtattaaggaaagttgtcatccaccacttgggaagccattatgctctagggctcctggtgagctcattggtgacatttttcaggcttgggagcttttaaagcgatttcatgaaattctggacctgaaagaaccattgacattagatgaacttgagaaagaactcattaacccctggtttgatggatcaaattttcttgagaaatctgagagggacatggatgaaagtcaagtttttatttccctaggagctgatggtaatggtagaccattattatccccaagatgtgaagttgatccatcagtttccatagaaagttctcatgcatttattcatgtggaaacagaagcaatgaaagagacagctcaagttaagcttgcctctttcacatatgccagatgcttcggtgtagctttgaccaaggctcataaatcgttgctaagagttctaataggtgaattgctgtcaaaggtggctgccctggtagatccaaattctgaacctggagaatcacgaacaagacggggaagaaggaaagatatggatagtgcagttcctgctaaacgaaccaagctcaatatgcttcctattaatgaattgacttggccagaattagctcgtaggtatatgttggcttttttgtcaatggatggtaaccttgagtctgcagaaattactgctcgcgagagtgctaaagtatttcgttgcttacgtggtgatggtggtttgctgtgtggttctcttactggtgtggctgggatggaagcagatgcacagctgcttgcagaggctacaaagacaatttttggttctttaagcagagaaaatgacatactaaccatggaagaagaagagtctaatgcaaagggtgctcctgaaatttttttggcaaatgatggtaatgttcctgaatgggcacagatgctagaacctgtcagaaagctaccaacaaatgtaggcacccgaatcagaaagtgtgtttatgaggctctggaaaagaatccaccagaatgggcaagggaaatactggagcattcaatcagtaaggaagtgtacaagggcaatgcttctggaccaacaaagaaagcagttctttcagtgttggttaaagttggtggtgaaggattgcaatcgaatcccaataaaagccagaaaaagaaaattgttatatcaatttctgacattatcatgaaacaatgtcgcattgtattacgtcgtgccgctgctgcagatgattcaaaggttttttgcaatttgttgggaagaaaattaataaattcttcagataatgatgatgaggggcttcttggatctccagccatggtagcccgtcctcttgacttccgcactattgacctaagattagctactggagcttatggtggatctcatgaagcttttctggaggatgtccgcgagctgtggaacaatgtccgtgttgcttttggggatcaacctgatttagttgagctggctgaaaaactgacccaaaactttgaatcattatataatgaggaggttgtcacctatgtccaaagatttgtggaatatgctaaactggaatgcttaagtgcagaaatgagaaaggaagttggtgattttattgagtcaacaaatgagattccgaaggccccttgggatgagggagtatgtaaagtatgtggcattgatagggatgatgatagtgttctactatgtgatacttgtgatgctgagtatcatacatattgcttgaatcctccacttgcgaggatccctgagggaaactggtactgtccttcttgtgttgttggtaaacatgcaactcaaaatgttacagaacgtacacaggttattggcaaacggcaaagtaaaaaattccagggagaagtcaattctctttacttagaatctctagctcatttatctgctgcaattgaagaaaaagaatactgggagtacagtgtgggcgagagaactttccttctcaagtttttatgcgatgagttgcttaattcttccctgatacaccagcaccttgagcaatgtgcagagttgtctgcagagttacatcagaaattgcgtgcacactctgcagagtggaaaagtctgaaaactagagaggatattttatccacaaaagctgccaaaattgatactttctcactaaatactgctggagaagttggtcttaaggaagggtttgcttctttgttatcaaatactggtaaatgtctggtccagccacatactgcagttgacaatcctagtaattttggggtatttgttgatagtctgccttcagaagaggttaccaaagataagtataggtttgatagtgttgataaaagcatatctgtgacaaattcagattctgatagccaaaatatgaattccatagatgtagaggggcaatttagaaatgtctctggcgctgtggagtctcaatgtacagacaaatcccccaagtcttttccattgccaaatcatatgcctcaagaaacaaatggtgctggtggagcatctcttgttcagggtaaaaaccagaaatgtgagggaaaggacatacctactcctgtgtcttaccagcaaggaatgcctgttgatgttcctcagatttctgtgaatgagtccgaaccctaccaccttgagctcattgccatcaaacgtgatatttcgctattgcaggactccataactagtgtagcatcacagctgctgaagctctctgttcgccgggaatgtttgggtattgattccattggtcgattgtactgggcttcggctttgcccggaggacgttcacgtatagttgttgatgcaagtgctgctttgctgcatggaagaggaatgacatttagcagagactatgtggagaagttttctgttctgcagcattgtgcactatctgacaaggattcctctttaatgtctcagcctagtaatcctttgggcaatagttctccgtggattgcttatgaaactgatgttgaaattgaagagctcttaggttggctggatgatagtgaccctaaagaaagagaactgaaagattccattatgctggggccaaaatcaagattccaacagtttattaatgcacagactgaagatcgggccaaggaccaaggaaatgtttctatgccaagaaacagagagaaaacagtatctaattctcttgttaccaaggcaacttccttgctggaaaagaaatttggtccctttgttgagtgggataatagtgaagtgttaaagaagcaaaatagaaagaccagaacaactaatgatgaaaagttgtataggtgtgagtgcctagaacccatattgccttctaggaaacactgcacacattgtcacaaaactgttgcgagtgacattgaatttgatgggcacaatgatggcaagtgtaatgcaggtcttctggccatagagaagaataaggataaaaatggatcttctaaaggaagagggaacttaaaatgtgataccttacatgaaaaattcagagctgatgcggaaacagctttgacctcggttagtggatcttctaagcttagctcaagattgattaaattttcaaatgaagaatccacatgcccatttaattttgaagatatatgttccaagtttgtgacaaatgattctaacaaggaacttgtcagcgaaataggtcttattggttcagatggtatcccatcctttgttccttctgtatctccttttgttagtgaatatacactctcagctcaaaaggatgaaagcattgttggtggtgtgtccatagtgtcagaaagccgggtttctcagggaaacactgatggagctggcacatgccttgaccataaatctggcatttctactggaaaattggctgcaaatgaaagcaataaatccaacaaatcatccttgagagaacaaagagatggaaaattctctttttgtagtcctgcttcagttatgggagccgatgggtgctgtgtggttccttcgccttcattgagaccactagttggaaaagcttctcacattttgaggcagctgaagataaatctacttgacatggatgctgcactcctggcaattgctcttagaccatcaaaggctgtgccagacagaagacaggcttggcgtacatttgtaaaatctgcaaagactatatatgagatgattcaggcaacatttacactggaggatatgattaagacagagtacttgaggaatgactggtggtactggtcatcattctcagcagctgccaaatcttctactttgccttcccttgcccttcgcatatactcccttgatttagccattatatatgagaagatgcccaattcaagctttactgacagctctgaaccttctgtcatagcggaaccaaaaccactgatgaatgtggacacagaaaaatccaaagcaagccggaagtcaaccaggaaaaggaaggaatcagatagttga

SEQ ID NO: 25285 - DNA, 705 bp, Glycine max
  Peptide Sequence Number=SeqID_116970
atggggagggagaatgtggagcttagtgagttcacttcctgttccgcgttgaagtctggtgcttctttgaaggccttggagcttgggaggcagggttggaagaatgatatgatgtataactcaatggtttttcggatttcgcatgctttgtcggtgtttgatggaatttctgagaaggatgtgatttcttggacttgtatgattgatgtgtatggaagaaatgggcaaggaggtgaagctgttgagatgtttcaggagattaaggaggatggaacctgtggtcactctggactgatggaggaagggaaaaattgtttcaaattgttgagggagaagtatggtcttcaaccagattcggagcactatgttttctacatagatattttaggtcgagcgggtaatatagaagaggtaaggtctacatatcacactatggttgagcagggtactgggcctactacaggagtatgggtagcattgttgaatgcttgcagccttaatcaggatgtcgaaagaggtgaactggctgcaaagcatgtcttacagttggagccctataaagctagcaatattgtgcttgtatcgaatttttatgcagccactgacaggtgggattgggttgatgaactgagaagcatcatgaggacaaaagggttggtcaaggaagttgggaatagctggatcaatgttctaggcttcaattga

SEQ ID NO: 25286 - DNA, 1203 bp, Glycine max
  Peptide Sequence Number=SeqID_116971
atggtttatccaggtgctgtgcattccagatttgagcattctcttggcgtgtattggcttgccagtcaatgtgtggaaaagcttaaaacttatcaaggcttggagcttggtattgatagatttgatattcaaacagtgaaacttgcaggacttctgcatgatgtgggacatggcccgttcagtcacttgtttgaacgcgagtttcttccccaagttattagtggttctgattggtcacatgaacaaatgtcagtcgatatggttgattatattgttgatgaacaccatattgatgtttacccccaaatgataagaagagtcaaggagatgatactggcaagctctgaatatgctccttcaatgagctcaagtgagaaaagtttcttgtatgatattgttgcaaatggccgaaatggaattgatgttgacaagtttgattatcttcttcgtgactgtcgagcttgtggtctaggatgcaactttgaatttcaaaggttattggagacaatgcgggttttggatgacgagatttgttatcgtgctaaggacttgtttctaattgtcccttgctttcggctgtgcaatttgctagaccttaccatccacaaaatgtttgccactcgtgctgatctttatagaacagtttatacacatccaaaagtgaaggcaatagagcttatggtggttgatgcacttgttcacgctaatagttatttggggatttcgtctaatatacatgatccttctgagtactggaagttttgtaatgagtatcccgtaccaaaggatatgctggacaattataagaaggtcactgctcaagatattgtttgttctcaggtcttcaatcttgttaaaccttctcatttgcataagagtggtggagttacactgaaggaggaggatgtagctgtttgtaatgtcaaaattgatttgactcgtggaaagcataatcctctggaaagcatccactttttcaaggattatgaaagtgatgagaaatttacaatacctgatgaccgtgtaagccacttactacctacatcttaccaagatatgatagttaaggtgtatgccaaaaagccagaactggtggaggcaatttcagaggcttttgaaaattttcagttgaaaacttatgggatcaaaacacaggcacattcaacaccacagaagaagcgtcgatacaattcatttatataa

SEQ ID NO: 25287 - DNA, 582 bp, Glycine max
  Peptide Sequence Number=SeqID_116972
atgaaggtgaaattgatgttcgagcttgctacactgccatttctagaatcttgttggaaccaggttgcaagtgttttgaacattttggatgatgagctgatccagaatgttggagactacattataagctgtcaaacatatgagggtggcattgctggtgagcctggttctgaggctcatggtgggtacaccttttgtggattagctacaatgattctgattggtgaggttaatcacttggatctgcctcgattagttgactgggtggtattccgacaaggtaaggaatgtggattccaggggagaacaaataaactggtggatggatgctattccttttggcagggaggtgctgttgctctattgcaaagattatcttccattatcaataaacaaatggaagaggcatcacagacttttacgatatctgatgtatctgaagcaaaagaaagtttggatgggacctctagtcatgcaacatgccatggtaagcatgaaggtaggttgacttcgaagtacccaaatccaaaaattggagataaattaggagaccaaaaatgcaattttgccatgttattatag

SEQ ID NO: 25288 - DNA, 522 bp, Glycine max
  Peptide Sequence Number=SeqID_116973
atgtctggtggaaccccgcgtgggggaggtggattaatgaggcagaggcatagccaggggtatgcaagcagtggtgatgacctagaggatgatgcatgctcaaggcaccgcccctttttggccccgagtcctccgcctaggacgtggattgagatgctggaaaatttcctttggcttgcttctgctgctttcattctatactttggtgatcaacattccaatttgatatatctattgtgccatgacaaccgaattaaaagaccgcctttatatcttgggatgatcggtattggtttgaatataatgattttcatttatacaactaccttggcctggagtgctcgaagtatcccttgcctctctaggttctcctttgctttgtggccaatatggagtttcttgacacttcctcttctgtacaaccaaaagtttacactatttatggcttgcatggtagtaatcccttgcctcatttttgggacgctgcggcctcaatattacgatgaactccgtacagattaa

SEQ ID NO: 25289 - DNA, 1406 bp, Glycine max
  Peptide Sequence Number=SeqID_116974
atggagggtgagaaacagcacaagtttgatgtggacctcggcaacctcatggctttcgattcctatcacaccttcccttctcaaccatctctttccagggaggacctcatcaaacagtgtttactgaaaggcactcacttggttcaagctatcgcagatgccctctttatcttaccatcgaccgaagatttggatggaccccttgtcaccttgcctcccccactcactaaattgcctagagaaaaacatctgccaaaaccaaagcctcctactaaatgggaagcttttgccaaaaagaaaggcatacagaaacggaagaaagacaaaattgtatatgacgagcagtctggaacctggaaacgcagacatgggtatgatcgtgcaaatgatgaagaagctatacctatcattgaggcaaaaccaactgatgctttgcctataacaggaactcaagcagcgcccaagaaagttacaaaggatgaactaggtaatgtagcaggaattgcagcaactgcaacagccagtgggggaaagtttgacaagaaattggcaggtgaaaagcctcagaaacatgaaggaaaatatcggaaggttgtgcgctgtgctctcgctgatatatgtttctcttgtccgttggtggaaggaaccgggataggatccctggagagggagcaaactgaaaaaatattgaacaagatcatctccaagaattctcataacatactcaacgttgaaaaggctgtcacgatgcacaatgtgaagaaagagaagaaacgaaggagcgagaaaggaaaggcttcagcaactactgacaagaaattgaaaactcagaaaaaagaagcaacttcgtatattggtattgaaaacttggtattcatgggtagaggtaggttgcaagtgcaaggtgttgaatctggaaatgatgatgtagcaatatgtagttctggaatcaagttgggacggtattcacttgagagtaaagttcgtccaactagtttatttgcaggcgttggtcaagcaggatttggttttgggatttcaccaaatcctccaactgctactactagagacagcggcaccaaacctccattgattaattcttccacgaaatatgttttaatgcctgaaacggttgaagttgatgaggaaggccatggcatgaagaagggaaaaaagatgaagggattggaatccatcattgaggttgatgagtgggcaattgctggtgcagtgtcaagaacatcagtggcaccgttggagaccataaggacccatttgatggtggggagctgtggacatagtacaattcaagtgtttcaatctattatggagaacgatggatggaagggctggttcagaggcaattctatgaacatcatcggagttgcgcaagcaaggccattgag

SEQ ID NO: 25290 - DNA, 261 bp, Glycine max
  Peptide Sequence Number=SeqID_116975
atggttactaactcaaaaggatgttaccgtggagggttgattttggctgatgcccgaatccagagtagcaatagtagatgccccttaaagcaaatttcagaactaacacgaactctcggaagaaacatatcaaattccaaacaacaaagaaagaactggcagagcaaccacaaccaaccaaaagtggaactagaaatgcgtaaggaaatgagtgaggttgctcgtgtatggctaatactcactaccgatcagcacagatag

SEQ ID NO: 25291 - DNA, 1044 bp, Glycine max
  Peptide Sequence Number=SeqID_116976
atggcaaatgcctggaaaagagataaggccaccagactcctctccccaaagctactgttcctactcttctcctccactctcatagtcttcttcttcttcgcattccttacctcacgcccctcaaaccccgccaccaccctcaccgccttcaacacccgcctctccttcaatgcaatctcccccttcgactgcaccgcctcccctcaggcccaccccgtcgtcgccaacaccgtcgagggcgtccgctaccccttcctcttctcgctctccgattttggaaccttaccagacaagccccacaagaacatcgtgaggatgctcaagggcaaaccctttcggaaacccgacatctccgttacggttcaggaggttctcgagaaggccaggactgagggtaaggatgggttttttgtcgacgtcggtgccaatgtcggcatggcgtccttcgccgcctccgctatgaggtttcgggttctggctttcgagcctgtgttcgagaatttgcagaagatctgtgaaggggtttacttcaatagagttgcggatttggtcactgtcttcgaggccgctgcgtcggatcgcgttggcaacattaccgttcacaaggttcggtgttacagaataagaaaagcttatttaaagagccagcatgtctgctttggttggatagacttggatgagtgccataacttgttggacaacagtgcgatttctgccacaggtgcaaagttggcatttaagtccaatgaagagatagcttttcaagtaaggactgttcctcttgatgaagtgattccgaaatcagagcgtgtgcttctgcttaaaatagatgttcagggctgggaatatcacgttcttaaaggagcatcaaagttgctctcaaggaaaggaagccaagccccttatctcatatacgaagaagatgagcgcttgttacgggccagtaatagcagtgcaaaagagattcgagacttcctacgtagtgtgggttatcatgattgcacccaacatggcacagatgcacactgcgtcaagaaggattga

SEQ ID NO: 25292 - DNA, 417 bp, Glycine max
  Peptide Sequence Number=SeqID_116977
atgaagaagccagggaggacaactacaaaatttggtgcagataataaacctatgtgcctgcaatcagatctcgaaggatcaaagtgttccatccacaatattagggtttccttcaactcactaacgcaatatgccatagactccattgtcatcaaaacgacaagacgctccatcaagatcggttcaataaaaacccggaactgggggtcaatagcaggtgctggaagattcctcagggagagaaacccggatattaagctgtatggtgtggagtcagctgaaagtccagttttgaatggaggacagccaggtgcaaatgcaaaacttggacagaacctgcagttaccaagactatgtgcagggtcaatttcaatgtgcttactgcttagacctggagtgtggctctgcattctttga

SEQ ID NO: 25293 - DNA, 862 bp, Glycine max
  Peptide Sequence Number=SeqID_116978
atggacaagcttgatgacattagactgaacaaactccctgatgaaatggtggtctatgtcaatgtgcttggatcattcgtggcagaatttggtcctgacaggatgatgtcatctacatacactagtagaatgactaaggaattccctgaaccaatggtggtaagggaacacgtgtccaagtggaatttgcctcaagagcttggattttctcattcattgcttgacaccattcaggatagggagcagcttgatgataaaattgaggttcatacacaattggaatctgacaagtataagggaggcttagtgtggtgtgtactccttcttaaagtgatagagggcaaagggttagggttaggtaatgtattagtgagaggaatggggataaccaaatcaagtaaggaatcaagaatgacttggttctatgaaatgggtgagctgtgtttcaataatggtgaaggagttctgttgatgagaaaggtggcagtgtctctcaacacagaaaaattgatgaagagtgcctatggaagccaaaaactgagtgagaacaagctccttagaattatcagatctgaggcacttgatagatacaccaaactgagtttgaaccatgagcggccgccaccgcggtggagctccaattcgacctatagtgagtcgtattacgattcactggacgtcgttttacaacgtcgtgactgggaaaaccctggcgatacccaagttaatcgccttgcagcacatcttcctttcgccagctggcgtaatagcgaagaggcccgcaccgatcgcccttcccaacagtcgtgcagcctgaatggcgaatgggacgcgccctggaacggcgcattaagcgcggcgg

SEQ ID NO: 25294 - DNA, 339 bp, Glycine max
  Peptide Sequence Number=SeqID_116979
atggctatgttaacgagatttttgggttgcatttgcttgatcttgattttaagtgcaggaagtgaggcacggcctttgaacccaacaattgtaagggacgtccttggaaccttgaagtggacaccaatacaaccaattgcagaagaaggtggacagcgtgattggggtaccataaaggattgttcatgggaagatgatgattgtatcgacaaatgcttagtgaggcagtccacgagacaactgaaaatatacagtagaaacatgttgaacctgcaaagtgcacaaaaattattgtgtgattcatggaatcgcgctgtgccatattgcattgaggataag

SEQ ID NO: 25295 - DNA, 2421 bp, Glycine max
  Peptide Sequence Number=SeqID_116980
atggccgctgtcatccctcctttgagtacaatcacgatcccacctcgaccctctagcataccaggggcagcacgtcagtctgcatcgtccaccgcgcgcttcaccccctcaaagtcccgctcgtcctccgtgaatgccacctcgatccctgtggcgaggcggatcgcgttgcgcacctcctccagcttctccggcaaccatgcgagaatgaagacgttcgcccttcgccacatcgcggtgcgccagtgccagtccgatgccgctcgatccgcttgtgatgagcacgtgtcggttcttgattgggatcttcacggggcggagaatagttcggaatccaaaatcgccgtggccaatggcggaaaagtaaccaaggctaagaagaaatcgaagtgttcgacaatgccgcggagatcgagtgctcgaattcaagcgttgcaaaaagccgagaaggagctccttgctcgtcaaaaagcggaggtagtagtagttgaagagaaagacaactgcgagaacgcggtgagggcgaagaagcgcaatagaaatagtggcggtgaggagagcgtagcagtggaagaagaggttgtttcgaaaaagcgcaagggtaaggtggaagaagtgaatgggaagcaggaaaatgcgggtgggggtttgggggagaagagtgaccctctcaaggtgaaagagactgtaagactgtttaacaagtattaccttcattttgttcaggaagaagaaaagaggtgtgcagcggctgagcccaaagctgctaaacaaaagggttctagaaaggcaaagaagagaggtgaaaaatcaaaggtcacttctaagcgaccagatctaaaggccatggggaagatggtggataataatgaagtattgtaccctgggaaaagaattggcgacattccaggtattgaggttggatatcagttctattctcgttgtgaaatggttgcggttggttttcatagccactggttaaagggcattgattatatgcccaaatcctatgccaatgtgtacactacgtatgaatttccagttgctgttgccattattttgtcgggtatgtacgaggatgatctcgacaatgctgacgatgttgtatacactggtcaaggtgggcataatctcactggcaataagcgccaaatcagggatcagaagttggagtatggtaacctggctctcaagaattgcgttgagcaatgtgtgcctattagagtcattcgtggtcataaatcttcaagcagttactctggtaaaatatacacatatgatggcttgtacaatgttgttgaatattgggcagagaagggaatatctggattcacagtctacaagtttagacttagcagggttaaagggcaacctaaattaaccacaaatcaggtatattttgtaaatggacgtgtacctcgatctctaacagagatacaaggattggtctgtgaggacatcactggaggtcaagaagatattcccattccggctacaaatttggttgatgaccctcctgttccacccacaggtttcacatattgtaagtctcttaagcttgcaaagaatgtgaagcttccaaggatgaatggcaccggatgtaaatgcaaaggcatttgtaatgacccaacaacctgtgcatgtgcactgcgtaatggctctgattttccatatgtatctcgggatggtggcaggttagttgaagccaaagatgttgtctttgaatgtggtcccaaatgtggttgtgatccaggttgtgtgaaccgaacttctcaaaaaggacttagatatcgtctcgaggttttccgcactgcaaacaaaggatgggctgttagatcctgggattttataccttctggagcaccagtttgtgagtacactggaatactttctaggacagatgatatggatagggtattggaaaataattatattttcgagatagattgcttgctaaccatgaaggggcttgggggaagagagaaacggtctccaaaaggagagatttctgcaaatctcttggacaaatatgatgatcaaagttctgaaagtgcgccagagttttgtattgatgcaggatctactggaaatgttgctaggtttataaaccattgttgtgagcccaatctgtttgttcaatgtgttttgagcacacaccatgatttgagattggctcgtgtaatgctgtttgctgcggacaacataccccctttgcaggaattaacgtatgactatggttatgagcttgatagcgtcttggattctgatgggaagatcaagcaaatgccatgctattctgcaagctatgaagcacggacactccagtctgttgtcgtgtccggtgtccgacacgcgtccgtgtgtccacatgtccgtatccgtgtcgtgtccgatgtccatgtcggtgttggtgcttcatag

SEQ ID NO: 25296 - DNA, 204 bp, Glycine max
  Peptide Sequence Number=SeqID_116981
atgggggcaataaaaaggtttgtgaaaatggaatggaatggaagctggaaaagtgaaaacgggttcttgcagagaggaagaaagtgttttatcagcaagaaaaaatgtagagagagaaatgggagcaataagaaggtttgtgaaaatggtaaggaggagaaggtagtaatgccagaaaaagagagagacaaagggtcactgtag

SEQ ID NO: 25297 - DNA, 441 bp, Glycine max
  Peptide Sequence Number=SeqID_116982
atggtcaaagaagagaatgaagcaaatcctaaagaacaacctttgatgatgatgatgatcaccaatccaaaatctcacaataatgaaatttggtacatagattctgggtgttcaaatcatatgatcggacatcgtgattggcttgttaattttgatgcaaagaagaatagcacaataagtcacaaggcaagatggaagacaagcagtgatctcagatgtgctttatgttcttggaatgaagagcaacttgatcagtatgggtcaactcttggaaaaatctatgacacaacaaagagaatgatcatgaaagcccctttggttagaaatagaaccttcaaggctaagagtgaagtgttcaacatctttaaacgattcaaggctctagtagaaaagcagtctaggaagtgtattaagattctgaggacagatggaggaggataa

SEQ ID NO: 25298 - DNA, 957 bp, Glycine max
  Peptide Sequence Number=SeqID_116983
atgatgaactttgtccctactcttcggtctggagagtgttctgatattggagatcgcccttccatggaggatacccacatatgcattggagacttggcagaaaaatttggcaataacgaactttgcaaggaagctatttccttttatggtgtaagctatctaaccgattatgccattcgcctggtatttgatggacacggagggaagagcgctgcacaatttgttcgtgatcatctgccacgggtgattgttgaggatgctgacttccctttggaattagagaaggtagtcacaaggtcatttttggagattgatgcagagtttgcaagatcatgttctaccgagtcttccctgtcttctggtacaactgcactgactgcaattatatttggaaggtctttactggttgccaatgctggagactgccgcgctgtattgtcccgtggtggaggggctatagaaatgtccaaagatcacaggccattgtgtattaaagaaaggaagaggattgagtctctaggtggatacatagatgacggttacctgaacggccagttaggagtgactcgtgcactaggtgactggcatcttgaaggaatgaaagaaatgaatggaaagggtggaccattgagtgctgagccagaacttaaattgatgacattaacaaaagaagatgaatttttgataattgggagtgatggaatctgggatgtttttcgcagccaaaatgctgtagactttgctcgaaggaggcttcaagagcacaatgatgtgaagcagtgttgcaaggagataataggggaagcaataaagagaggagcaacagacaacttgacagtggtgatgatatgtttccactcagaaccaccacctcctatggttgtagaaaggcctagagtcagaagaagtatatctgctgaggggcttcaaaatctcaagtgcttgctagaaggataa

SEQ ID NO: 25299 - DNA, 147 bp, Glycine max
  Peptide Sequence Number=SeqID_116984
atgaagaaaatgattgaagagaaagaagtgtggaaaaggaagaggcgatggcgtggatcagtgaggcgtagacaaacctggaatcaaagagcagagagagagagagatgcgatgaacaatcggtgtggtggtgtgggaaatgtttag

SEQ ID NO: 25300 - DNA, 309 bp, Glycine max
  Peptide Sequence Number=SeqID_116985
atgattatcctaaaaacaaggtttctagcagtagcacgagatgtcagctatgcttatctgaacacgaagcgtattattgatctacggcacgttgttgtcaacatcggggatgggttccaaagtgggaacaggaatccaacgatgaatgagggtgagccacttggaaagttggcaaatctaggtaagtgggaacaggaatccaacgatggatgggtagtcaagggcgttggatttgaattaggtggcacagatgaaagaggagttaatggagagaaaggatccaagttagatttggtacttggagaatga

SEQ ID NO: 25301 - DNA, 663 bp, Glycine max
  Peptide Sequence Number=SeqID_116986
atgttttcttggggcagaagattccaactctctctacggcatagcataaggccgtttggcagccaatcacaaggctccacgtcatcatcatcttcttcttctttcagctcctttggtgggtccaggcatggtgacaatagggtcagagactttgaggcctttcttagatcaatcacttctggggttgtggttgttagctccaccttaggctattggtattggtcatctttgtcttctcctggtgccaattctcttcagtcatttgctgatggttatgctaatgaagaggatcagtttcaacaaaacgatgaaaacaaacccaagttcctctttaatgatttgttgcatgtgttcgcatttgatgcagatggctatagaagaagagtattcttcaattatgaaaaacgaattcgcttgcagagccccccagaaaaggttttcgagtactttgcatctgttcgaagccctagtggtgagatttttatgacacctgccgatttgatgcgtgccattgttcctgtctttcctccttctgagtcaaaccgtgttagagagggttttctaagaggggagcaggttcctggcgagttgcagtgcgaaccttcacaattttttatgctttttgacactaacaatgatggactcatttcctttgcagagtga

SEQ ID NO: 25302 - DNA, 702 bp, Glycine max
  Peptide Sequence Number=SeqID_116987
atggccttgatgagatcacaaaacagacaaggagctaatcacagaaatggacgacgccttggcgttacagcttctatagaaaatgggggtctcgtggagtatttttttggcaaagatggaaatacatgcttacaacatgaaagatttgttcaattcttaagacagctgcatgatgagatcttgaggttagaattttcccattatgactacaataaaaaaggaacaatttcagccagagattttgccctgtccttggttgcatctgcggacatcaatcacataaacaaactattggatagggtcgaagaattaaacagtgaccagaacctaagacacataagaattacattcaaggagtttcaagattttgcagaattacgcaagaaattgaaatccttctctctggccatattcagttatggaaaagttaatggagtattgacaaaatctgattttcagagagcagcatcacaagtgtgtggtgtttgcattacagatgaagtggttgacataatctttcatgtgtttgatgcaaatcgtgacggaagcttaagtgcagccgagtttgtgagagttgtacaaagaagggaaagcaacaattcatcacgtcatgacagcttcgggggtttaacatcctgttggttgaactgtgtaaaaaactgttcatcagctcagttcaattttgatggaatacgttcataa

SEQ ID NO: 25303 - DNA, 1890 bp, Glycine max
  Peptide Sequence Number=SeqID_116988
atgtcgtccgagatcgaggttgtcgaggaggtgcagtcccgcgacgagcaatcggcggcgtctggcggcggcggcgatggcatgggggcggaggagagcctccggaacgacgtgtacacggcggcgtcgtacgggatttggagaaactgcagagattggtggagcaagagggttgccccgtcaccgagcccgacgggttgggatactacgcgcttcagtgggctgctctcaacaatcgcactgccgctgctcagtacatcattgaggttctttgatcgtagcttagctcagctcagctcagctcagctcagctcaggttggcttgtaggtcatgtttgtgttatggaaatggaaatcgaatgtggtcatgggggagatgtaaatgcaacggatcatactggccagacagccttacattggagtgcggttcggggtgctattcaggttgcggaacttttactccaggagggtgctcgagtgagtgctgccgatatgaatggatatcagacaacgcatgttgctgcacaatatggtcagacagctttcctttaccacattgtttcaaaatggaatgctgaccctgatgttcctgataatgatggaagaagcccattgcattgggctgcttacaaaggttttgccgattctatacgtcttctgttatttcttgatgcacacaggggacgtcaagataaagagggttgcactcctcttcattgggctgctattaggggcaacttggaggccagtaccgtgttagtacaggctggcaagaaggaagatcttatggtgactgataatacaggcctgactccagcacagcttgcttctgataagaatcacagacaagttgcttttttccttgtagcaacaaaaatgccaaagatgacagctgcagcaggccttcttgcatggtttggagttttacttgcaagtgttggtttggtgatgttttacaggtgtagcagcaaggatcctggttatatcagaatgaatatgcatgacactcaggatacaaaagatgatgagcctctattgaagattgagataaataatcctgctttgctagctggaaactggtcccagctttgtgcaacatgcaagattgtcaggcctcttcgagcaaaacactgttctacctgtgatcattgtgtggaacaatttgatcaccattgtccttgggtatccaattgcattggcaagaagaacaaacgggatttctttgtttttcttgttcttgaagtttcagcaatgttggttactggtggagtttgtcttacaagagtgttaactgatccacttgcacctcagtcatttggggcatggattcagtatgttgctaacaatcacactggtgcaatatcatttctaatagccgattttttcctcttcttcggtgtgtttactttgacagttgtgcaggctagtcagatatcacgcaatatcacaacaaatgaaatggcaaatgcactgcggtataattacctcagaggtccaggtggtagattcagaaacccatatgatcatggtatcaagaagaactgttctgatttcttgatcaatggttacaacgaagatattgagtgcattgaagaattaggtagctcagaggagggtataggaatgatgcacatggcaagaagctcgaacttagcaaatggagactcgcataaccattccgaatatgcaaggggcaatggaaatggccatcatgttattaatgtgaattccaattccaacagtacccactccaaaacaaatcatggtcatgttcattctacgcattgtagccataataataaccatggcaaaaccagaaatgacaatgctcccttgggcttaggtcttggccttggacggaacaccagatctgttacaccctcatcatga

SEQ ID NO: 25304 - DNA, 508 bp, Glycine max
  Peptide Sequence Number=SeqID_116989
atggtatcagatggagtagtggacaatcctcattctaaagttgaggagatccaagaatttgatgggcacagagattctgatactggtagggcaaagaaagacaagaaaaaaaggaaaaaggaggagggagaagggtgcaatcaggaggaagtttatattatttcctctgttgacgatgactgctcaaaaggaatgaaaaaatggatcatggaataccatcaaagtagaccaggattggatgtattgcaaaatcaaattgatgactttataacagctcatgaggcaaaactggaagaggaaagagaagaaaaagaagcccttgctgcagaaggggggtggacagttgttgtacaccataagggtagaaagaaaactactgactctgagagtggaattgctgtgggctctgttgctcaagctgctgtagagaataaaatgaccaaaaagaaacataaagaagttggtctagatttctaccgctttcaaagaaaagaagcacagagaaatg

SEQ ID NO: 25305 - DNA, 582 bp, Glycine max
  Peptide Sequence Number=SeqID_116990
atgattattgttgttgttgttgttgttgttatgcatgggaaggtttatcattctagttttgtgaatgaagatggagtgagtagagcttgtgggtgctctcttcttcctctcaagagccacattaagggacctgctcctgtttcagatcaagacagaactgatattgtggatgaagccataaccttcttccgagccaatgtgttcttcagaaactttgacatcaagagccctgctgataagcttctcatatacctgaccttttacattaatgttgctctcaagaggcttgaaggttgcagaaccttggctgaaggaaccaaggcaatcatcaacttgggtctcgaaaaggttcctgtccctggagagtctggctttccatttccgggccttttcccccttcctcaatcacataaggaagcagacaagaaattgtatcactgcttgatcgttttcaattttgagtacacacccaacaaagaatgctattctttggcaaaaactgaaccattcctagtaacttccttgcattatcagttttctgaaagtaaggatgcgggtaactctaggcatgaagctagatag

SEQ ID NO: 25306 - DNA, 300 bp, Glycine max
  Peptide Sequence Number=SeqID_116991
atgggagatgttgcattgcatctaagcattagagtcgatggtcgtgttgtgactggacctatcttcttacattgggatgagttatgcgacgagttactaggggaggtccctccagaaaatgcacgtaagggagttgcactgaagctgacatggttcctgagcattttgcgcgcaccattgcctgaagaaccaacaatacaccaactacaatgcaagtgtagagcttacataatgtacatgattggagccatggacttggtatcgcatgtcttttattgcactaagagtcctacgatctga

SEQ ID NO: 25307 - DNA, 3255 bp, Glycine max
  Peptide Sequence Number=SeqID_116992
atggcaggaaacgattggctgaacagctaccttgaagctatacttgacgtgggtcctggcctggacgatgccaagtcctctcttcttctccgagagagaggcaggttcagccctactcgctacttcgtccaagaggttattggcttcgatgagaccgatctctatcgctcttgggttcgggtaccctcccatactactctctcctttcttctttcttcttttattccatcccttcctctgatttccttcctccaggcttcctccaccaggagtcctcaggagaggaacaccaggctcgagaacatgtgctggcggatttggaacctcgctcgccaaaagaagcagctggagagtgagactgcgctgagagtcaacaagcgtcgtttggagcgcgagcggggtcgcagggaagccaccgctgatatgtcggaggacttgtcggaaggagagaagggcgatcccttgagtgacttgtccgctcacggcggcgtcggcgacttcaaccgatccaggttgcccagaatcagttccgctgatgccatggagacttgggccaacagtcagaaagggaagaagctctacattgtgctcatcagcattcatggcctaatacgaggcgagaatatggagctgggacgtgattctgacacgggtggtcaggttaagtacgttgtggaacttgcaagggcattgggatcaatgccaggagtttatcgggttgatttgctaactagacaagtgtcggcgccagatgtagattggagttatggggagccgacggaaatgttgtctccaagagacacagatgattttggagatgacactggagaaagcagtggttcttatatcgttcgtattccctttggtccaagagataaatatattccaaaagaacttctctggccttacattcctgaatttgttgatggagcgcttaaccacattatacagatgtccaagtctcttggggaacagattggcagtgggcatgctgtctggcctgttgccatccacggacattatgcagatgcaggtgactctgctgctcttctgtctggcgcattaaatgttccaatgctttttactggccactcacttggccgagataagttggaacaacttttaaagcaaggtagactatcaaaggatgaaataaacacaacttacaagattatgcgtaggattgaagctgaggaattggcccttgatggttctgaaatagtcatcacaagcactagacaggaaatagaagaacaatggcgcttgtatgatggttttgatcctgtattggagcgtaaactacgagcaaggatcaggcgtaatgtgagctgctatgggagattcatgcctcgcatggcgacaattccacctggtatggagttccatcatattgttccacacgatggtgatatagaaggtgaaccagaaggaaatttggatcatcctgccccccaagatccacctatttggtctgagataatgcgcttctttaccaaccctcgcaagcctatgatacttgctctcgctagaccagaccctaaaaagaacatcacaactttggtaaaagcatttggagaatgccgtcctcttcaagagcttgccaaccttacattaattatgggtaaccgagatggaattgatgagatgtcaagcacaaatgcttctgttcttctctcggtacttaagttgattgacaagtatgatctgtatgggcaagtggcatatcctaaacatcacaaacaatatgatgttcctgacatatatcgcctagcagcaaagacaaagggtgttttcattaatccagctttcattgagccatttggtcttaccttaattgaggcagctgctcatggtttgccaattgttgctactaaaaatggaggtcctgttgatattcatagggtacttgacaatggtctgctcgtagatccccatgatcagcagtctattgctgatgctcttttgaagcttgttagcaacaaacaactttgggcaaaatgtagacagaatgggttaaagaatattcatttattttcatggcccgagcactgtaagacttacctttctaaaatagccacttgcaagccaaggcatccacaatggcagcgaagtgaggatggaggtgaaagttcagaatcagattcaccaggtgattccttgagagatttacaggacttgtctctaaatctgaagttttcattagatggagagaagagtgagggtagtggaaatgacaattctttgaattctgatggaaatgctgctgatagaggggcaaaattagagaatgctgttttgtcatggtcaaagggcatctctaaggacacacgcaggggtggggctacagaaaaatccgatcagaatccaaatgctggtaaatttcctccattaaggagaagaaaacatctgtttgtcattgctgtggattgtgataccacttcaagccttcttgaaactattaaagccatctttgagtctgctggaaaggatagggcagagagcactgtaggtttcatattgtcaacatcattaacaatatcagagatacagtcatttctaatctcaggtggcttgagtcccattgattttgatgcttatatttgcaatagtggcagtgatctatactatccatccctcaatcccggagatcgcccatttgtggttgacttgtattaccactcacacattgaataccgttggggtggagaagggttgaggaagactttagtgcgatgggctgattcaatcactgataagaagggtgataatgacgaacaaattgtgagtcctgctgaacagctttctactgactactgttatgctttcaaagtgcgaaagccaggaatggctccccctgtgaaggagcttcgcaagttattacggatccaagctctgcgttgccatccgatatattgtcaaaatgggacaagactgaatgtcattccagtgctggcatctcgttcccaagccctcagatacctatatgttcgatggggttttgaactgtcaaagatggtggtgttcgttggagaatgcggtgacacagattacgaaggacttcttggtggcctacacaaaagtgtcatactgaagggagtgggaagcagtgcaatcagtcaactccataataacagaagctaccctctttcagatgtcacgccattggacagccccaacatcgtcgaggcaactgaggggagtagcggtgctgatatccaggctttgatcgaaaaagtgggatatctcaatggatga

SEQ ID NO: 25308 - DNA, 267 bp, Glycine max
  Peptide Sequence Number=SeqID_116993
atgacgtggcatgacacgtggatgtgcatcttaagagatgtcacgtcatttgatgataacaaaacgagaagagaaaaaaccagaggaaaacaaagtggaggagaaaaaagtagagaaagaagagaagaagaagaagagaaaaaaccagagaaatcaaaagatgacaaggaatccaaggaggaatctacgccaccaaaaatcgtgcaaggcacaacctccgcaatgcatgaacactttaagcacgatttcttgcatcttttaagttag

SEQ ID NO: 25309 - DNA, 498 bp, Glycine max
  Peptide Sequence Number=SeqID_116994
atggaatgctccagatgctccatttctgcactattattccccctatttttcgttgtcctttccttcatctttttctctcccttcaaggaacaaaaccatcttacccagtttgctttggctcctcctttggtcctttccactatcaaaaacctaaacaaccacacaaatataacctctccttctccctcaccacaaccaccaccacttgagcttctttccaactttactcctgcaaacgacacttacatgtacagtggcaccgttcaaattcaggacttgactagtttggagaaaatagaagaaagtttagcacaagcacgggcctcaattcaggaatctatcctatcaaggaactacacttcacaaaggagagaaatttttgtccccaaaggatccatttaccggaatccccatgcttttctccagttaagtaaacttaattcaaaatttctgagccaccttcaattgattcatctttttaacaattactgtaactag

SEQ ID NO: 25310 - DNA, 405 bp, Glycine max
  Peptide Sequence Number=SeqID_116995
atggagagtctgagaaacttggaccttagcttaagtgggttcatgggattaatccctcatcaactaggaaatctcttaaacctgcaagatcttaatcttggatacaattatgcttttcagatagataaccttaattggatatcaaggctatcttccttagagtaccttgatttgagtggttcagaccttcataaacaagaactacacttgaagagttgtcaaattgataacttaggaccaccaaaaggaaaaaccaacttcacacatctccaagtccttaatctttctaaatctaataataactttacttgtccaattccctcaccatttgcaaacttgtcatccttgagaactttaaacctggctcacattcgactgaatggaaccattcctaagagttattag

SEQ ID NO: 25311 - DNA, 207 bp, Glycine max
  Peptide Sequence Number=SeqID_116996
atggtacaaaaactgagaaaaggaaagcaggcagtaagcacaccaccaggaacgctgcgctatgtgccaccagaagccggtcacgttgacgtcggtgagggagggcgcagcgcgatccgtgcctgtgaggaagtgagtcaaagatgcgcgttttcgagacaaagcgctggtaagggaggtcgtcgccgccgtgtgatctgtgaataa

SEQ ID NO: 25312 - DNA, 237 bp, Glycine max
  Peptide Sequence Number=SeqID_116997
atgtctagttggaaaatttcgtcatatttccaagacaatgcacttgacatatgtataataggctacaagcatcttagagtctaccaatgcaaaacaagaaaacggatgaatctaacttgcgaaaatgtacttaaatgtgaagaacaaaaagaacagattaacgcgaaaaatatggagagggtagaaaaagctagcatgaaaggaatgtatcatggaggtggggctattagtgagtaa

SEQ ID NO: 25313 - DNA, 2340 bp, Glycine max
  Peptide Sequence Number=SeqID_116998
atggatcttgagtctgtgatccacaggaacacaattaaggaagaatcatggaagacagttttgactttggcctatcaaagcttgggggttgtgtatggagacttgagcacttccccactttacgtttacaaaagcgcttttgctgaggatattcagcattcagacaccaatgaagaaatctatggagtgttgtcttttgtgttctggacactcacactgattccactgctcaagtatgtgttcattgtgctgagagctgatgacaatggtgaaggagggacctttgcactctactcattgctgtgccgccacgcccgggttagcttgttgcctaacactcagcttgcggatgagcacttaaccgagtacaccatggacaatggaactgttcctgtcaataggaaaaatgttgggttggggctgaaaaacttgttggagaaacacagggtgctgcaaagggtgctgcttgttcttgccttgatagggacttgcatggttattggggatggtgtgctcacaccagcaatttctgttttttcagctgtgtcaggtttggagctttccatgtccaaagaacagcacagatatgtggaggttccagtggcttgtgtaatactgatatttttgtttgcccttcaacattatggcactcaccgtgtggggagtctctttgcacctgttgtcttgacctggctgctatgcatcagtgctattggtgtttataatatcttccattggaatccacatgtttatgaagctctctccccatattacatgttcaaatttctgaaaaagacacaaaagggaggatggatgtccttgggtggaattctactgtgtataacaggttcagaagccatgtatgctgatttaggacacttttcacaattgtcaattaagattgcattcacctttttggtatacccttctttaatccttgcatatatggggcaagctgcatatctttccagacatcattcccttgaaagtgactatagaattgggttctatgtatctgtacctgtaaaacttagatggcctgttcttgcaatagccatacttcaagctgtggttggaagccaagcagtcatcacagggactttctccataatcaaacaatgttctgctatgggatgtttccccaaagttaaaatcattcacacatcatccaagatgcatggccagatttacattcctgagatcaactggagtttgatgctgctttgcctggctattacagttggatttagagatactaaacgcatgggaaatgcagcaggcttggctgtcataactgtcatgctggtgaccacttgcttaatgtctctagctatagtcttgtgctggcacaagaacatattgctagcagtttgcttcatagtgttctttggctccatcgaagcactctatttctcagcatccctcatcaaattccttgagggggcttgggtccccattgccctctccctcatatttctcattgccatgtatgtgtggcattatggcacattaaagaagtatgagtttgatgttcataacaaggttccaatcaactggctcctcagtttaggcccctctctaggcattgtcagggtcaagggaattggcctcatacacaccgagctcgtatctgggatcccagctattttctcccactttgttaccaatctccctgccttccaccaagttgttatcttcctttgcattaaatcagtccaagtgccacatgttagacctgaagaaaggttcttggtgggaagagttggcccaaaggagtatagactttaccggtgcatagcgcggtatggctaccatgacattcacaaggatgacattgagtttgagagggatcttatttgcagcatagctgaattcatcagatcagatgcatctgaatatggcttaggatttgggagctttgaagaagatacaaagatgacagttgtggggacttcagcatcaaacttagagggctcaataaggatgactgaagatgatgatcaagtagattctcaaatggaaggcccttcagagttgatggaggttaagtcttctcctgagaaagtgaggaagagagtgaggtttgttgtgccagacagtccacagattgatttggatgcaagagaggagttgcttgagctaatggaagcaaaagaggctggaatggcattcatattgagtcactcgtatgttagagcaaaaagtggatcaagctggttgaaaaaagtagttatcaattatggatatgatttcttaaggagaaactctagaggaccatcatatgctttaagtatacctcatgcgtctaccttagaggtgggtatgatctatcatgtatga

SEQ ID NO: 25314 - DNA, 210 bp, Glycine max
  Peptide Sequence Number=SeqID_116999
atgtgctataagtatgcattggatgtcgtctcgaggacctgctcgaatcgaaaagagaggagagtctttaagaaggaattcccaggttcaaaggagtatttacgaagtacaaagctaagacaagaaagaggacttcgagctattgggcaattcgaactggtgtatggacgagtcgaagtcgaggcagcaagaattctggacttagcgtaa

SEQ ID NO: 25315 - DNA, 138 bp, Glycine max
  Peptide Sequence Number=SeqID_117000
atgacaattggtctacagatgcaatccaatcccgcaagggcattggatagaagactccaagtagattgggccagagatccaagggaagaccctagggttctcatgagccttagagtagatttcgagcccataggctaa

SEQ ID NO: 25316 - DNA, 195 bp, Glycine max
  Peptide Sequence Number=SeqID_117001
atggacgaagaacggacgaagaacgatcacgaaatcgttcacagaaacgaaattaagggtggagattgcacaacagcttgcccaggcgagctgcttgcttcctccagaagtaaccttgctcgcccaagcgagctcagctcgcccaggcgagctagttacttcagccttaagctttctagtgggcccaggggctaa

SEQ ID NO: 25317 - DNA, 204 bp, Glycine max
  Peptide Sequence Number=SeqID_117002
atgcctcaaaatgttctttacgatgccattggatatatcaacggtggtgctccagtggctttctgttttctatcagctgtccctccctgttcagctactgacgggggtgggtgcggtaaccggcaaaaagccccccccggacatcagcgctggcaaagtgtagcggtccccgctgcgcgtaaccaccacacccgccgcgcttaa

SEQ ID NO: 25318 - DNA, 432 bp, Glycine max
  Peptide Sequence Number=SeqID_117003
atgttggaaaaaccatctcctttgaggctcattctctggagaataaaaacctttcctaaaggtatgctagaagtagtgtctaatccttggaggtttacagtagggaactggttatgtgactcagatctggttagtcctactggaattgaatgggttctaaccgaaaaagaccttctggatgactcgtattcagacctagaggcttctatctttgatgagaaagaatttctcctattgaaggttatccctacctttccggagttatcttgcttaatatgctctatggttggagcgggtcggggaatagacggtgtggccttatccatgacccatcttacgggaagagttacttcatcccattttattttttttgggagagaaacgttagcctttgtcatatcagtgataaacaaggttgtttctcctctttga

SEQ ID NO: 25319 - DNA, 475 bp, Glycine max
  Peptide Sequence Number=SeqID_117004
aagttacggaaactcatggattgggcaacaatacttccttttggttgccgttgcattatggaatttcacggatcgcgtaaccctacttccttttgatttctggcgcgtctcgggacttacatattgtgcaagaaagggtgccgagtatcttgaagcagccaatcaaaggttgcacgtcatcaagttcaacaagtttctcaaagtaagaggaaatcaaaggcgacccaattttaaatctaaaagaaggacaaaaacttcatccattactccaaagtgctttgagtgcaatcaacctggacatctgagggttgattgtcctatcttcaagaaaaagatggagaagtctgaaaagaaaaactttagtgaaaagaaattgaagaaagcatacatcacatgggatgaaaatgatatggaatcttctgaagattcagaaaatgaagagataaacctctgcctaatggctaaaattttatga

SEQ ID NO: 25320 - DNA, 411 bp, Glycine max
  Peptide Sequence Number=SeqID_117005
atggcttccgtaagagaaagccacaactttagtgtctcagatgacaagtttcccaagcaagttagggtaggagggcacctgataaaatttgatgttaattccctcaacatcttcttggagactccagtggttgtggagcaaggggagagcttacctttttactctaggtttgctagactgaggcctgatcctcaggagcttgcagcccggctgtgtatccctgggaggggatttgttcttaatgccgagggtctaccgtggaagctcttgaggaaagatcttaccactctggcccaaacctggagtgttctatcttattctaacttggccctgacatcccatacttctgatcttaatctggaaagggcccagttagtctacggacttgtaatgaagatgaatacaacttag

SEQ ID NO: 25321 - DNA, 369 bp, Glycine max
  Peptide Sequence Number=SeqID_117006
atgtatgattctgagtttttgttcagactgatggcatgtattgctaacaagataaaaaccattgatggatctaaagaaactctaaaactctttttaaggatatctgagctctggtttgttgggacgccaggcaggtctgaacaagctgagatgcaattagttagatatttttattattcacagggtgatcaaatccatgtggtttgtaagcaagaccaattaaagacatggaaaatggatttgaaggaaggttgtacttatatgatgcacaattttagagtctgcaagaatgatggacagttcagagtttgtgatcatccatataaattgacatatattggagttacggttgtcagacagtgtgaatag

SEQ ID NO: 25322 - DNA, 298 bp, Glycine max
  Peptide Sequence Number=SeqID_117007
gtcgactctagaggatccccagcagccacgtgatgattcaagattcgtggtaggcgtaggagctgggcgaagcggtagcgaagctcaggtggtgatgcaagtgcgcggtgagcgtagtagccccctcgggcatgctctttgtacaaccaagcgaagagctagtgagggccggaaatatccgaagcgcacctgcgtgaagcagcctagcatcactttagataggagcagaatggatgacttacaactgaaagttcttcggatcgatatatcgtacgacgtaatggagatcttggtctag

SEQ ID NO: 25323 - DNA, 981 bp, Glycine max
  Peptide Sequence Number=SeqID_117008
atgcgctgcgaagaatccgtgccacagggtgcccacggtgtggtggtgcaggtcactggaaaggtagccgattcttgggcggccgtgccgacgggcagctgcccgtggcaacggttgccggccggcctggatcgatgcggccgcatgatccagcagctgcctgtgcaggtcgttgcccaatggcagcgtcgcgaaggtgaatggttgcggtacgtcgttggctgcgggcgtggtcacgcgcaactgtgcaatgagccgcgccacgatccggtccgtggcatcgaactcgcacagctgtgcatggacatgcgcgagccagcacattacgtccatacgtgcgggctgcagcgtgtgaagttgcgccagtacgtcacgtgcggattcccaccggccgaggtgctgaaggcactgagcgatgttgatgagctccatgggaagttgggcggctacaacttcatagctcttgatcgcctcctcgtacctgcccgtttcctgcagggcgagacccagcaggtggtgggcctcaagaagggtgggatccagcgcgagcgcgcgttgcaggctgtcgacagcagccatttgttggcccgtgcgttgctggaggtcaccaagcagcatccattgccatgcttgcggttctgccgtcgtgattgcctggcgtgcgggttcaagcgcctctcccgcacgatggctgtcacgcaggcagatcgcaagaggggcgcgtgccggttgccaggcggtggacgcgggatggatctgctggaacagtactgcggcttcttgtgcgtggccgagttgcatcatgcaaagggctgcgtcgtagcgaagaacatcgtcagacggatccagcagcagtgctcgcctgtagtgcgggagggcgtcatccagccgagctgcatggtgataacggcgagcctcagcggcctcattcacgtactgcctccaacgcccagcccatgtttaccccgcgatacatcagag

SEQ ID NO: 25324 - DNA, 402 bp, Glycine max
  Peptide Sequence Number=SeqID_117009
atggagcttgcttgtgaagcttctatagaggctggatctctgatcttcaatggtgattctccatcatggagatgcagcggaaggaaaaggagaagaggagaggggaggcaccatccacaagggaataagccatggaagaaggagcttcaccacaaagaatgtgccttggataaaaagcttgaaaaggatgctttaatggaggaaaagaaagagagaaggggggagcacaaaattgaaggaataaaagagggagagaagtggaactttgaggtgtgtctcataagactttcattcatcaaagttacaacaagtgttacacatgcttctatttatagactaggtagctttcttgagaaaacttccttgagaagcttctttgagaaaacttcctttagaagctag

SEQ ID NO: 25325 - DNA, 252 bp, Glycine max
  Peptide Sequence Number=SeqID_117010
atggaggttgatgaaccttggctggggtttatggctaccattgaattatcaagtggtgttcatcattggaagtgcggtagagcagactttgtggttgatttaggtattgtctttgtggataactgggcggtgggtaaggataaggttggtgggaaatttggccatataggaatggcagtcacagcatgggtttctccctcattctcaccctcttcatttgccccagttttctcattcgtccaagcaagatga

SEQ ID NO: 25326 - DNA, 177 bp, Glycine max
  Peptide Sequence Number=SeqID_117011
atgaggactttgagtcctatgaaagataaaggcgaggactttgagtcctatgaaagggttttcccctttccttttaaaaactttgattattctgcacaacaagaaaacataaggcttcgagatcaatcatgtgccccattgaaggatggcaatgaattgtcacactttggtatgtga

SEQ ID NO: 25327 - DNA, 75 bp, Glycine max
  Peptide Sequence Number=SeqID_117012
atggtcagatgccaggatgaagttggaggccgaaacccatcaaggtacttagggacggacacaagtagaggctag

SEQ ID NO: 25328 - DNA, 468 bp, Glycine max
  Peptide Sequence Number=SeqID_117013
atggcacggagcgtgtttgctctttgcccctatttgggaacctatgggataatatctaggggtttgctaataactaacttcccaacaatttacaactcacacggccgttctctagaggtatcatcactcaagataataatattgtggcggtatggaataccagcgacaacacattatggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcataa

SEQ ID NO: 25329 - DNA, 366 bp, Glycine max
  Peptide Sequence Number=SeqID_117014
ggccagggtgatgctctgcaggccgcaggcgcgccgccacctcatcaggctggcccagctggatcatttgatacggagcagtatttacggcatttggttcgccagcaggcggccaaccaccgggcgcatgtacagacccatgactatttttaccggttgagcctcagcctgcagagtcagggtttgacttcttttccatgccctactccggatcagttcagggcagaggtcgcatggcccggagattggcctgaggcccgggcaggaggggcaccagcagaggctcccgacgaggcagatgaggcccgcgaggacgaggagattaccgatttgcttgatttcttgggagggagcggagccacatga

SEQ ID NO: 25330 - DNA, 402 bp, Glycine max
  Peptide Sequence Number=SeqID_117015
atgagtgaagtagaggaggtgcaagagcagatgaaggccgacatggaggccatgaaagagcaaatggccacaatgatggaggccatgatgagcatgaagaagataatggaagccaatgcagttgcagttgccgctaccagcgttgttgctaaggtgaacccgatgccctcatttgatattaaccaaatgaaacatccaacctcagatatggtaggcaaagatttgggaagtacgggcggcccccattatgcgcaaattcaaaacaagcatgccttcccaccatatggcttacctcccaactatgcaccacccaatgtggcatacattcccaataaggatgtcaataactccgctcctatactcattgagagccgacaacctcatcatgcacatgtctcttaa

SEQ ID NO: 25331 - DNA, 54 bp, Glycine max
  Peptide Sequence Number=SeqID_117016
atgactgtggacacttcatttgttcacttaactgctgcagtggcaagcttggtg

SEQ ID NO: 25332 - DNA, 541 bp, Glycine max
  Peptide Sequence Number=SeqID_117017
atgacaggtactagtacccacactttcaaagggctacacgccctcgcctttagagggctacacgtcctcgccttcaaagggctgcacgccctcactttcagagggctacatgccctcgccttcagagggctacatgccctcgccttcaaaagactacacgtcctcgccatcagagggctgcatgccctcgcctttagaggactacacgtcctcgccttcagaggactacacgtcctcaccttcagaggactccacgtcctcaccttcagagggctgcacgccctcactttcaaagggctacatgccctcgccttcagagggctacatgccctcgccttcaaaagactacacgtcctcgccatcagagggctgcatgccctcgccttcagaggactacacgtcctcgccttcagaggactacacatcctcaccttcagaggactccacgtcctcgccttcagagggctacacgcactgggccactgggcgtggagcgctatctacaacatttggttcgccagtaaacagctaaccaccgtgg

SEQ ID NO: 25333 - DNA, 132 bp, Glycine max
  Peptide Sequence Number=SeqID_117018
atggatattgattcgtatagagaaacaatctttggtagttgttcgccgcaagctaaagatgttgttcttgctagttttatctctatgggtttgggcgatcttaagttgccaaaatcaagcctgctttcataa

SEQ ID NO: 25334 - DNA, 561 bp, Glycine max
  Peptide Sequence Number=SeqID_117019
atgtctggaggattagtgacagccgcatacattgttgctgcaatcctgtttattttcagtctggcggggctttccaaacacgaaacgtctcagcagggaaataactttggtatcgccgggatggcgattgcgctgattgccaccatcttcgggccggataccggcaacgtggcgtggatcctggtggcgatgatcatcggtggggcgattggtattcgtctggcgaaacgcgttgaaatgaccgagatgccggagctggttgcgattcttcacagcttcgtgggcctggctgcggtgctggtgggcttcaacagctacctgtaccacacgccgggtctggaaccgattctggtgaacatccacctgacggaagtgttcctcggaatcttcatcggtgcggtcaccttcaccggctccattgtcgccttcggcaaactgcgcgggaagatctcctcaaaaccgctgatgctgccaaaccgtcataagctgaatctggcggcgctggtggtctcgtttgtgctgctggtggtcttcgtgcgtaccgaaagcgtgggcctgcag

SEQ ID NO: 25335 - DNA, 2031 bp, Glycine max
  Peptide Sequence Number=SeqID_117020
atggatttatgggttgttgcagctgctgctggagctggttatttggctaaatattggaataggatttcaaaaaatggtgacggcttgtgtcacgtggcttcggaggattcttgttttgagaatcctgggccgcctagctgctcttctccgttggccaaacaaatgcgaagagatgaattgggcaaagatttttgttatgatggaagggctttagaagggaagtcttcagatctgaacacaatgaatggtcttttgacaggagaagtggcttctaccagagggattgatggtgaaaaattgcaacatttttggaattataacaaacatgatgtgctatctatatcaaacttggcaatgccattatcaacttatgatgatagcttcaaggatgttgatgatgaaaatgagcaaagctctggctttgttggtgaccatggtttcctttttccgaattcttctgctgaagtggttcctatccataactcttctggacataaaacctttctcaagatgaagcatttgtctgggtgtgtcaatagacctttaagttccttggaaagttgctttatggcccagctgtacaaggagcatgctgaaacggaagaatatgtttttagttctctttcatcactgtccacggccacgagatcttttcttgtaagcaatggaagccaaataatcaacagagcaaataataatttgttcagcacgtcgattgaaagcaaggaatataagttgcaaaaagaagttggtcaagtaaaggatgaaaatgtatttggggttccttccttgccaaaaatcatatcagtaaatgatactaaggagaaatttaatgcagtcattgtgagaagtcgaagatcgagctcttccgacaatgtgtcgagtggaaaactcatccatactcaacaatttgataaaacatttctcttcagtcttgggatttcgttcgggatgataacttctatcatggcaaataaaagagaaatagtcaagttaagagagttgttgaagcagaatgaaaacttggttcaagatctacaagaggaactggaaatgaaagattcaatgactgtaaaggagttacagaatgaaaattatggttcacaggatacatgtgatcattcctcatatgacaaggagctaaatgaattttcccctgaaaagcacgtggataactctccaagaattgactctaaagaatcatatcatcaaaaggtagaacaaagttctgagtccatgagcaaaattgaagctgagcttgaagctgaacttgagagattggggttggacatgaatgcatcaagcctagaaggaaaattgtccgagcttgttgagcttgacccagagtttgtagcagattttgctcaaggtgagttacgagtcgacatggtcagtgggaaagattctgtctatccaaaatcaaatgaggatgctggtgatgcaacacctctccctgtcaactatgcagttttgcctcatgaactgagtttgcgtttgcatgaagttatacaatcccaacttgagcaacgcatgaaggaacttgagattgcccttgaaaatagccagaggaaagtacggcttttggaatcaaagcaagagaattgtcttcaaaaggcttcttcctttagtaaagaaaatgatgattgtgaccttatgtctcagcccttaatcctcaatttatcaggtgaagctctagatgcatacaatgaagcctatgaagaactaataaagataaatgactctgaagaaaattcaccattaggcatccatgaccaccaggaagattcatatgcaaatgattggcatgcattaggggttcaacatggtggagcaaatggttctagtaaggtaacaatgttggaagggagcatatatgaattagatggtgctgaagatgaaacttgtggttttgatgatactgaggtggaacagcaattgattaggcaaattgttgaaaggaccaagaaaggttctcccgtttttagaaatgcacaaaggatattgtattctatggatgaagatgaacaatga

SEQ ID NO: 25336 - DNA, 168 bp, Glycine max
  Peptide Sequence Number=SeqID_117021
atgcataaatgccccatgtgtgggatatcactgtacaaagttaaggatgatgatgaatgtggcggtgatgaaagcacaaagaaaggccccccagcgaagatgttatggtatcttccgatcattccaagatgggagaaattgcaatggaatgctctgccatctggctga

SEQ ID NO: 25337 - DNA, 614 bp, Glycine max
  Peptide Sequence Number=SeqID_117022
acgaagaggggcaggcccttagggcagaactcaagcaagcccaaacagtcaaagaaaggttcagatcagcagctcttaagatccgaaaggataatgccaaactgagagatgtaaatatagctaccaccaagggcttggaacaagagaccaagagggctcgtagggaagagcacgaccggaagaagttccaaggggctctgtggggcagtaacagtgagcttaagctccggagagaggaaagggaccaatcacgagtagacagtttggtcttgaaggatgagttgaaggttttcctaaggtccaagagaagcttatctcagcgtttatgcgagatagagaccaacatgttagccatcgtcagcaagtaccaagaagaattaaatctagccacggcccacgagcgcaaagtggcgggcgagtatgcccgagtgtatgcggaaaaggaggctagaggaagggtgatcgactcgttacatcaagaggcaacaatgtggatggaccgatttgctcttactttgaaagagagtcaagaacttccccgattgctagccaaggccaagcaatggcggacacctactccgcccccgaggcgatccacggacttcttagctatt

SEQ ID NO: 25338 - DNA, 291 bp, Glycine max
  Peptide Sequence Number=SeqID_117023
atggaactgattgcatccctttcccagtattatgaccagcccctaaggtgcttcacatttgaggacttccagctagtgccgactgtgaaagagtttgaagaaatcctgggatgcacactgggaggaaggaagccatatcttttctctgggttctatccctccacggcaagagttgccaaggtagtgaaaatctcagcacaagagttgaaccaggtaggcccgtctatccgctacaaggtcactgctcgtgcgtcgaaaaaggaaggcgaattgggaccaactcttggctag

SEQ ID NO: 25339 - DNA, 597 bp, Glycine max
  Peptide Sequence Number=SeqID_117024
atggcgacgctgggcagacgatctcgatgcagtcttcggggaagcggagcgacgaacccggtgctcgtgggctggtctcttgggggtgtggtgctgtcgaactatcttgccaaccatggcgacgccgggattggtggcctcctttacgtcgacggtgtcatcgaactcaaacccgatctcatcacgccgcatccggaggtctatgcaggactggcctcagaggacctgcggacgcatctcgacatggtgcggaccttcctggccctctgctttgcaacgcagccagaaaacgcgacgtttgaacggctgctgtccaatgcagcggtggcatcatggctgatgacgcggacagtcccctcgatgacagtccaggcaaaagaaggactggcgaaggcaaaaaagccggttctgttgatctatgggggcaaggataatctggtacggccgcaaccgagtatagaacgcgcgaagtcgttcaacggcgcgatcaagtcagagatttacgacaactcgggtcatgcgccgtttcttgaagaagcgtcgcggttcaataaggatttggccaggtttgcggcttctgtggcggacggcaagtaa

SEQ ID NO: 25340 - DNA, 514 bp, Glycine max
  Peptide Sequence Number=SeqID_117025
atgtttgggggcaaaagcaagaatcttggcagatgtgagaagagcagtacgaggattgtttgctatactccgactctttatgtatggttggttttgcacctttttcgccaagaggtgaggcatgcttgcccgctagaaagccaccattcatgcacaaagaaaggaggggcaaattgggaccgactcttagcaaacgaagaagaagcgtctatcaacaggttccctcaatggaaagaaggaagaacctgggttcttatttcgtgcagaggatttccgaatgttcccttgatagggacaaggggttgcatcagttacaatcccgttcttgctataaggaaacttggctaccctataagaggggcaccactagaggaagagctcgcgcctatcatttcacgaggtttcaataagaccaacgtggagacacttcagaaggtccgcaaggcatgggaggtggtgcaaaagaaggacaaagaactcaggggcagtaacaatgggcccatcggtggctacc

SEQ ID NO: 25341 - DNA, 96 bp, Glycine max
  Peptide Sequence Number=SeqID_117026
gctgaggatgaggagagtgttgtgcataagaagaaagctgctgaaaagaaaggtactgagggcaagagaaaggatgtgagaggtgaaagcaattaa

SEQ ID NO: 25342 - DNA, 261 bp, Glycine max
  Peptide Sequence Number=SeqID_117027
atgttgggtggccatgtttggcaagacattgttggtgtggttactgatctcattgatgttaagacagttaatccccctcacaggatgacagtcaggctcagggataacaataactgcgacattctaatgactgtttgggaggactatgctattcagctccatgatgctattgacaaaaaccttctgcttcaggaaccattggttgttatgttgaccctaggtaaaatcaaggatgctacaggtgcgtctggtgttaattag

SEQ ID NO: 25343 - DNA, 498 bp, Glycine max
  Peptide Sequence Number=SeqID_117028
atgtcctcaccttcagagggctacacgccctcgcccatcagaggactgcatgtcctcaccttcgaagggctacacgccctcacctttagaggactacacgtcctcgtcaacagagagctgtacgccctcaccttgagaggactacacgtcctcgccaacagagagctgcacgccctcaccttgagaggactacacgtcctcgccaacagagggctgcacgccctcacctctagaggactacacatcctcgccttgagagcgctgcacgccctcacctttagagggctatgtgtcctcattttcagtgtgctccacatccgtaccttaagagaatttaagggccaactatgcgagcacaaccagagagggaggctatcacacagctactatgcataccggggcaagatttcacctgtgccgctgcaaagagacgagtgcggatcatgcgcacccaacatgacccactcttacacagatatagatgacattgctacttag

SEQ ID NO: 25344 - DNA, 490 bp, Glycine max
  Peptide Sequence Number=SeqID_117029
gtcgactctagaggatcccacccttgtgagagatttcagtgcgcaaagtctcaagattgtacaaagagtctgcaaggcgtgggaaagcccgttaaggaaagataaagaacttaggggcatccgtaatggcatcatcagtggttatcatgaatggctaagagttcatacacgagggttagattggctctccaagttgaaaattatcaatgaggggaacttcgaagctccggaagaggatgaagaagtcgaagctctaaaatcagagcaaggaaaggcaagactcaccaaagaaaaattcaagtcagctgctacaaacatctggaaagagtgtgtcgagttacgagaggaaaatgcggctaccgcaagagcccttgaacaagaaatcaagagggctcgcaaggaagagcatggccgagataaattccgaggagctttgtggggcagcaacaatgagctcaagctccggagagaggaaagagaccagtcatga

SEQ ID NO: 25345 - DNA, 561 bp, Glycine max
  Peptide Sequence Number=SeqID_117030
atggctggccgcgtttatcgcccaccggcttcctgctcgatctgcacgttattaaccagctgcctgctgaatggggctcgtttgccgcttcctcggtgcggcggtattcccggtcggactgattctgaccgtgctggcgggtggcgagttgctgaccggcaacatgatgacgctgccccattgcctggttcgcgcgccgcattagcggtttcagcgtgctgcgtaactggttttggtaaagatatggtcggcaaaatcttcggcatgtggttcccggtgatggccttcgtggcaatcggtttccagcacgtggtggccaacatgtttatcgtgcctgccgcaatttttgccggtcagatgagctgggcagaatttgcacctaacgtggttgcggtatttttaggcaatggtgtgggcggtgcgatctttgtcggcctcacctatttcctcgccttccgtccggcacaggcggcgggacagcatcgtgaaaaaggaatggctcactcccgaagagctcgcgctggaaacgggctacagtcggcagacggtgggatcctctag

SEQ ID NO: 25346 - DNA, 429 bp, Glycine max
  Peptide Sequence Number=SeqID_117031
atgtcttggaagaggtcacattacttctcaatgccccaccaagacatttatagtagccaagatgaggctactatttcaccttcctctagtgaaagtgaagaagcaaaaaaggaagaatctagtgaagaaatctacccccatgaagaaggacaacctttaatggttaaggaggagtgtaaggaggtaagtgtctcctccaagaggttagctaagaagaaaagtcattttgaaataaagacaaatattaaagaaacttcccctcttagacaacctccacatcttctcctttgtaaaaagacacttgttagcactgccacacctcttgggcttgaggttattcctcaagtaaaggagttgttggatgaggatttggttcataagagcttaaatccttgtgctttgttggtgcccaaaatagggactcattag

SEQ ID NO: 25347 - DNA, 351 bp, Glycine max
  Peptide Sequence Number=SeqID_117032
atgaaaagagaaaaacatgcctcctatagtagtcataactcttgcaagagcctaagtgaagaacttcgtgactattatgaaggaaggcataggtcacatcttagacctcactcccataggagagaaaatgaaagaaagccccaagaggctaacattaacatcccatactcccatgggaaggacaatgtagaggcttacttagattgggaaataagggtagagcaaaaacttaaaagaaagtctacattaaaatattatagctctcattctcatccaaagaaagaccaaggtctcggtatcttagagcaagagcaccttctaagcccaaagatgataaggggaatacaatag

SEQ ID NO: 25348 - DNA, 255 bp, Glycine max
  Peptide Sequence Number=SeqID_117033
atggctttggagcggacatggatgcctagtgtcttgcaggaacaggtgcgaaaccaaccaaacacagagagcgggcaagcaacagatgatccgtgcgctactcttctcgcaccttcggcccgctatgccgtttcgagtctgttttacgcggtccaaacctcttgcggaatccttgaccacagttgcaattctgctcaaagaggggagacaccagaagaaaagatatggttttcttcccccgagaggacatcctag

SEQ ID NO: 25349 - DNA, 396 bp, Glycine max
  Peptide Sequence Number=SeqID_117034
atggaaattatgagactccatcaacatgaagagaatgacaaaaagaagaaaggaattgcactcaaagcctcatcttcttctattcatgaagaaaatgacaaagaagatgatgattttagtctctttgtaaagagattcaataaattcctaaggaaaaaaggaaatcgaaggagatcaaacttcaatccaaagaagaaaggagaagattcctccttagttccaaaatgttatgaatgcgatcaacctagacacttgagatgtgattgtttatctttaaaagaagaatggaaaaatttgagacaaaaactttcaaagataagaaagaaaagaaagcatatatcacttgggaagataatgacatggattcatcaagtgattcagaaaacgaaatcgtaa

SEQ ID NO: 25350 - DNA, 291 bp, Glycine max
  Peptide Sequence Number=SeqID_117035
atgcacacacgaagtttcacaaatccacaattccttaaaataggcctaactcacaacgtgcccttcgcgggcgagcgagggcgaggctcacgggtgcgctttccaaaggaggaaagatgcacggagtcgccaccaacgtttatttgtggaaaacgtcgagaaaaccgaaggaaaccggtcaaaatgaaaattctaagttcgggagttgtatttatgcctgaggaaggtcgacaaaagcggggcatttgctcctacgtaccctcctttggagaggaaatcagacctatgtag

SEQ ID NO: 25351 - DNA, 123 bp, Glycine max
  Peptide Sequence Number=SeqID_117036
gacgacgttcctaaaggaaaactctacaaggcttcatttcgcgttcttcctgagcgatcaacctctccaactctggtgaagggacatcctgatgcaaacctaccccgcaagggcattggatag

SEQ ID NO: 25352 - DNA, 297 bp, Glycine max
  Peptide Sequence Number=SeqID_117037
atggagagaatcgttaagctcgcccaggtgagttgttacttcattctgaagcaaccttgctcgcctaggcgagctgagctcgcccaagcaagctattgcttcattctaaagcaaccttgctcacccaagcatgctggttactttagcatgaagttatttggtggcccaagcgagccagatgctagcctgggcaagccagtgggaagtaaagataaggacactagttttgttcaagcgatctttctattcgatcgagcaattggcgaaagccaaggaagtgataccgagaaaacatga

SEQ ID NO: 25353 - DNA, 951 bp, Glycine max
  Peptide Sequence Number=SeqID_117038
atggaacctttcccctcttcggccttcaaagttctcatcttgaatatttgctactaccaccaagatctgcaccgacgaccgctccgcccgggctcgcgccctgggttttgcagcgaccgccgcgccctcctactcatcggggcttggtccttgccccgacggccggtatcgctgcgggcctccaccagagtttcctctggcttcgccccgctcaggcatagttcaccatctttcggtcccgacaggtatgctctcactcgaaccttcacagaagatcagggtcggtcggcggtgcaacccacagggggatcccaccaatcagcttcccttgcgccttacgggtttactcgcccgttgaactcgcacacatgtcagactccttggtccgtgtttcaagacgggccgaataggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatcccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccg

SEQ ID NO: 25354 - DNA, 180 bp, Glycine max
  Peptide Sequence Number=SeqID_117039
atggcgaaaaggtgcggaatgaccataatttgtcgccgcatgccatcggactcgatcgtctctggatggcaaaaagtaaagagacaaaacttccaactgatcagagcaacatatgcttttcggatgaaaaacaatgtgtctaccggggaaggagagtatgctgatgaaatattctcataa

SEQ ID NO: 25355 - DNA, 291 bp, Glycine max
  Peptide Sequence Number=SeqID_117040
atggccaagttcaacccatacatagtcctcaaattttatgccaatgcttggcctacggaggagggcgtgcgagatatgagatcctgggtgaggggtcagtggatcccgttcgatgcggatgctatcagccagttcctaggatatcctttagtgctggaagagggccagaagtgcgagtatggccagaggaggaaccgggaggcgagtgtgaattatgcgcaccaacatgaccaccctgacccagatatggatgacgttgctgctcagcaacatcctgcccagcgatcataa

SEQ ID NO: 25356 - DNA, 231 bp, Glycine max
  Peptide Sequence Number=SeqID_117041
atgttggatgatgtagtgaattttgttggagaggagaatgtagtccagcttgccttcatgaatttgaaagcatcattaatgagcatgtttagctctaaagagtggaaaacaagcaagtttggaacttcacaagaggggagaaaagtacagaatgtcgctttggatagtcaattttggaagaacgtaaccatgtgcctcaaagttgctacccctcttatggtggtcctttga

SEQ ID NO: 25357 - DNA, 375 bp, Glycine max
  Peptide Sequence Number=SeqID_117042
atgtctaattgtccaggcggtaatgatagtatcttgtacctgaccggtggctcactttttctaagtaatgggaaagaggaccgacacatgcccctgaaagactctcctgagacaaagacgggctgtcaagaacgtagaggaggtaggatgggcagttggtcagatctaggtttcctcatttgggatcctggggaagaggatcaagctggcccttgcgaacagcttgatgcactatctcccttcaacccctttgagcgaaatgtggcaaaaggaaaaagaatcccatggaccgacccccatcgtctccaccccgtaggaactacgagatcaccccaaggacgccttcggcatccaggggtcgcggaccgaccatag

SEQ ID NO: 25358 - DNA, 192 bp, Glycine max
  Peptide Sequence Number=SeqID_117043
atgggccagccacaaggaccgcaagtgaaggggattcccttatgtcacatcaacaaaagctttgtcagcacaagttggatgtgtgaagggcgggtcgccatgatccacgatgaagtcccccaagagcagccaaattgggtgcgtcttaaccctatcgctaggcctaggcttcagggttttccccctgtttag

SEQ ID NO: 25359 - DNA, 242 bp, Glycine max
  Peptide Sequence Number=SeqID_117044
gactaactgcctgggaattctttgtcccaacacattggagggtacatctacttgggggttgttatactgagaacaagagagggtacatctcttgtggatcagttcaagtggagggtacatccacttggtttttcaaagagaacaagggagggtacatcccttgtggatctttggctagtaaagaattttacaaggttgaaagaaatctcaagaaccgcaggttgcttggggactggatgtag

SEQ ID NO: 25360 - DNA, 381 bp, Glycine max
  Peptide Sequence Number=SeqID_117045
atggggacaaggggttgcatcagttacaatctcgttctttctataaggcaacttagctaccctatgagagggacaccactagaggaagagctcgcgcctgtcatttcacgaggtttcaataagaccaacgtggagacacttcagaaggtctgcaaggcatgggaggtggtgcaaaagaaggaaaaagagatcaggggcagtaacaatgggcccatcgatggctaccgtaagtggttgaacgggagtcaagatcttccccgattgctagccaaggccaaagcaatggtgaacacctactccgctcccgaggtcatccacagacttctcggctattgtcagcatatgatagatttaatggcccatataattagaaaccgctag

SEQ ID NO: 25361 - DNA, 929 bp, Glycine max
  Peptide Sequence Number=SeqID_117046
atggtgggagagggcgagtggcgtgactacgccatcgatcacctgaaggaaaaggcggtgttttccgtcttcaagcgatcaggtgaaatgccgcttttcaggatcgagaaaaaccccaagctgggggcaaaacagggtgcctattgcgtggtgaatacggatggccgcattctgaaacgtggccatgaattgccgcaggttctgaaagtcttcgacaaggaacagcacgccctgacggatatagtcgtcgcggttcccgaggaactgcaggaggaaggtgaagaggttgatgaagtcgagatagagcgtcagcgcacccatgatggccttgcggccagcgacggcaacatcgtcagcatcgaaatacatttccttgatcttctgggtgtcgtaggcggtcaggcctgcgaagatcagcacgccaatcgcggaaatcgcgaactgcagcgcggaggatgcaaggaagatgttgacgatcgaagcgatgatcagaccgaacaggcccatgatcaagaacgagcccatgccagacaggtccttcttggtcgtgtaaccgtaaagcgagagcgcaccgaacgaagccgcggtcacgaagaaggtctgcacgatgctctggccggtgtagaccaggaagatcgaggagagcgaaacacccatcagcgcggcgtaaacccagaaggtcgtctgcgcagcggaaacgctcatgttctggatgcggaagctaaggaagaagaccagtgccagcggagcgagcatcacgacccaacgaagcggcgacgcgaaaagcagctgctggacagccggattggaagcggcgagcgtataagtgccgaacgcggcaacgccggtgatgaccagagccagcgccataaggttgtaaaccttgagcatataggcgcgaagaccttcgtcgatcagcgcaccagact

SEQ ID NO: 25362 - DNA, 270 bp, Glycine max
  Peptide Sequence Number=SeqID_117047
atgaagaattgcactaagcaatcactacgcatggctccaaactcgaaggtggaggacacatgcacgaaaacacaattcatggagctccgaaaaagattgagaatgcagaattgcactagccaatcactacgcatggctccaaactctgaaggtggaggacacatgaacaaaacgcaattcatggggctccgaaaaagggttagagaatggagaattgcactaagcaatcactacgcatggctccaaactcaaagggtggaggacacatga

SEQ ID NO: 25363 - DNA, 306 bp, Glycine max
  Peptide Sequence Number=SeqID_117048
atgagaccagatgtcaggcccggcggtggattgtcgcagctcgcgcttatctgctgcaccttgtcggttgcactctttttgctaataagagtgcaacatacgtgcatgtggtccactcttgacgctttccgggacctcgctcatagtggtggttacgcttgggggtttgccgcgctggaccaccacccgacagcttgcggggtacttgacgctacttcaggagacgtccccacgtgcttcccggtggttgacgtcgaaggcgcacatgaagggcatcacaggagcaccctacagggcacgttgtga

SEQ ID NO: 25364 - DNA, 558 bp, Glycine max
  Peptide Sequence Number=SeqID_117049
atgagaacaaatcaaaccggcaagaggttctaccaagtcaaggtcaaaagcccaggtaccaccagcatcaaggaattagggcggttgatggaacccctccaaatgcaagctttccgcaagacttacggaaagatcttagagttgaccatagtagaggtgtccatagaagccattgcagcacttacccaatactacgaccagcctttgagatgcttcacattcggggacttccaatatagatgtcctcttgggggaaggaaaccatatctttcctccgggtgtctcccctctttgagcagaattgcaactgtggtcaaggattcagccagaggtttggaccgcataaaacagactcggaacggcatagcgggcctaccacagaagtacctagaagacaaggcgaggggtatggccaatcaaggagactgggtcccgtttatggatgtgttagctttgctaatttttggggtcgtcctctttccaaacgtggatggtttgatagacctagcagcaatcgacgctttccttgcctaccaccatagtaaggaaagtccggtg

SEQ ID NO: 25365 - DNA, 87 bp, Glycine max
  Peptide Sequence Number=SeqID_117050
aaggcaccgccttccggagtgtcataccctaatttcgtccgggaacctttgctcgatgacatgcgaccattctttggtccttgtgag

SEQ ID NO: 25366 - DNA, 387 bp, Glycine max
  Peptide Sequence Number=SeqID_117051
tactgcacccagagacaggctcagggtgatgctccacaggccgcaggcgcaccaccaccacctcaccaggctggcccggctgggtcgtttgacatggagcagtatttacggcatgtggttcaccaggaggcggccaaccacagggcccatgtgcggaccaatgagaccctttaccagctgagcctcagcatgcagagccagggcttcgcttctttttcatgccctactccagaccagttcagggcagaggtcgcatggcccggggattggcccgaggcccagaccggagaggcacccccagaggcccccgacgacggagaggaggcccacgaggacgaggagatggccgatttgcttgacttcttgggagggagtggagctacatga

SEQ ID NO: 25367 - DNA, 423 bp, Glycine max
  Peptide Sequence Number=SeqID_117052
atgcactacgaggatcatatcgttccagcaggtgaggtgtggattgtgccaggccagtgttctagtgactacatggactggttcttccgcatctcccatcctttcatgacaccaggccacgcattagatcctctgcatcatggtcacgccccgcagccccgagtcgtccctcaggccccgcagacggatatccctcgcgtgccggagccaggagcatcgtcgacatctgcgaaggagcctagacatgcaacggaagtttgtgatgacattgctgagaggttggagcgccatctgagtctagggggggtcacgcctggctcatcgacacatgaggtgatcgaagaatgcctcaggttggccaggagtgtgacacaggaccatcttgtatatgttaggtctagacgcaggcggcgcacggattag

SEQ ID NO: 25368 - DNA, 537 bp, Glycine max
  Peptide Sequence Number=SeqID_117053
atgctgaataaagctcagatacgcttgatgagtgctgctgctgaaagaatgctgaaacagagaggacttggatttaatcctaagtctgctggcagacactatgacagaatttgttcctgccaaaaacaggactggagccacgatgtcacaacatcggtctcgacatcatggaacgcagcagaaaaagagcaaaagaaagaagtggaggtgtcactactgtggcaagtatggtcacataaagcccttttgctatcatctacatggccatccacatcatggaactcaaagcagcaacagcagaaagaagatgatgtgggttccaaaacacaaggctgtcagtcttgttgttccttcactttgagcaggactcaggctgaaaaggaagaggtactagatagcttggcgttcgttccagccatgacaggaatcaaagagagtatcctggaactgatgaaggtcctgactccaatgctagttatgtgcatttggagatgctcaacaaaggagaaagaatggaatgggaaagctagttcatga

SEQ ID NO: 25369 - DNA, 252 bp, Glycine max
  Peptide Sequence Number=SeqID_117054
atggcacaacctccaccccgtgagaggactctaagggaaatggctgcacctgatttcacctacgaaagcttgtgcatccaataccctgatgaggatgtcccatatgttcttaaaactggactgatccatttgcttccaaagtttcatggccttgcaaggcttttcctcattcttagagggagtggcaaaggactggctatattaccttgctccaaggtccatcacgagctaacctcaagagagtattcttag

SEQ ID NO: 25370 - DNA, 540 bp, Glycine max
  Peptide Sequence Number=SeqID_117055
atggaggccataaaggaacagatgacaatgatgatggaagcaataattagcatgaggaagatgatggaggataatatttctacagttgttgctgcgagtactgctactgagatggacctgattcacccgactggtttcaatcaagtgaattgtccagtctcagatgtagtaggtcaaggaggtgaggcagcaaaaaatgcatgtgggcctcatcattttcaggtttatagcaagcattccttcccatcatataggttgcctcctaattatacactgcccacttttgtgtacacttttggtgacaatatcggcaattctgcacctgtactcattgaaaatcaacaaccccaatctgatcatgcacatgtctctcaacccatggggaaacacatgaagttccccaagaccacactctggccgggaccttccacggtacttgagaacgaaaggattaagcatatggaggagaggctatgcgccattgaaggaggaggaacttgtgcctttactgacatgggaaattttaagaatggggggtag

SEQ ID NO: 25371 - DNA, 213 bp, Glycine max
  Peptide Sequence Number=SeqID_117056
atgagtgctaagccttttaaattgatcagccaaagtctctatgttgatgaaaaatcgtccccaaatgaaattaaggtgatggaagcttgcttgtggggcttctatggaggctggatctttgagcttcaatggggtcctttaatggtgattttccaccatgtagatgcagcggaagacaaaggagaagaggtgagaggaggctccatctactag

SEQ ID NO: 25372 - DNA, 193 bp, Glycine max
  Peptide Sequence Number=SeqID_117057
atggcctgtgattccttagaggagcaggcctcacagggttcctttgtcgcccgtggacgtcaggatgtactagttgctgccattgagcgaccagaacaccatggtcgtgtgcgtgttgctggagtcagtgtcatgatcaaacaatactttggactcgctcgtcattttgccattgagtgcacattggcaaatg

SEQ ID NO: 25373 - DNA, 255 bp, Glycine max
  Peptide Sequence Number=SeqID_117058
atgtctcactatagggtggtttttggtaaggcatgccaccttctagtggagattgagcaccgtgcctattgggcagtgaaaggttgtaacatagcatttgatgaagcgattgagattaaaaataaagttaccagtaaagtcttcaaagtgaatggtcaccaacttaagctttttcatgagagttcccaagtggaggaggcatttgtggtggacctctctttgatcttatcaattttatgtgatgatatgccttga

SEQ ID NO: 25374 - DNA, 106 bp, Glycine max
  Peptide Sequence Number=SeqID_117059
gctgaagggggctgttctaagggtcttggatccccctggtgagcaaatccgtgaaggttttcctccgttattcaccgttcttcatccgttctttgttcttcaacgg

SEQ ID NO: 25375 - DNA, 597 bp, Glycine max
  Peptide Sequence Number=SeqID_117060
gccatgatgagcgtgaagaagataatggaagccaatgcggttgcaattgccgctaccagcgttgttgctaaggtgaacccgacgtccccatccggcctcaagcaaatgaatcatccaacctcaaatatggtaggcaaagatttaggaagtacgagcggcccccatgatgtgcaaattcaaaacgagcacgccttcccgtcatatggcttgcctctcaactatacgccacccaatgtggcgtacactcccaataagaatgtcaataactccactcctatacccattgaaagccagcaaccccaaactgatcatgcacatggcaagcagttggtggtatacccctacaaaaccctttggagggccctcagtatcactcacaactacacctcttgcattccacagcggttaaaaaccctcatgactatggcaggaatgggaaagttggatcatctagaggaaaggctcagggccattgaaggaggtgaagattatgcctttgctaacctagaagaattgttcctaatatggtcattcccaagttcaaggtgccggactttggcaagtacaaggggactactcgctccaagaaccatctaa

SEQ ID NO: 25376 - DNA, 801 bp, Glycine max
  Peptide Sequence Number=SeqID_117061
atgaagtcaaagctcagacagtacagtgtcatggggcatatcaaatgtgaggccgaacactggactataacagctcgagcttatcagttgcattttctaggttgcactttttttgctaacaagagtgcaacacacgtgcatgtggtgttcttggacacctttcgagacctctatcagagtgaaagcaacgcatggggagctgcctccctagtgcatatgtacaatgatttgaataatgcttgtaagagtgacaacatacaacttgttgtatatatcacactattacagtgttggatttatgagcattttccatctgttgctgagggttttacggatgaagactatgatgaaaggtcaccatgtgcctaccactggacctatacgaaggcattaccagcgtcaacgtatcgaaagcgtctagatcgactgacgactgctaatgtttgttggatgccttatggtgccatcatgcagttagagactttgacccgatttcatgtttttctagacattttcgatgggatcccattgttgtcatacactgaccagagagggttgtgtggtaatttggatttatgttgtgcctggaaatgtgcaccagactatatggagtggttctacatgattttgcatccattcatgaggctgacacagcttggggatccacccaaacatccacctatcgtgcaagatgagacatatgtcgaaccagatatgcctcagtacttggtggtggcagcagctatggaggaagcatttgcgcatgcaccttctgatttggagcagcctagacatgcaatg

SEQ ID NO: 25377 - DNA, 105 bp, Glycine max
  Peptide Sequence Number=SeqID_117062
atggccgaccagcaggcgaccaagtccaaagccaaagctcaagacgttaaagaagcgctactaggaggcaacctagtaccttttaaatttctgcctgctatttga

SEQ ID NO: 25378 - DNA, 240 bp, Glycine max
  Peptide Sequence Number=SeqID_117063
atgcgttcatgggtgaggggtcagtggattcctttggacgcagatgccctcagccaattccttggtgacccgctagtgttggaggaaggccaggagtgtgagttcagtcagaggaggaacagggccgacgggttcgacgaggaggccattgcccagctattgtgcacatcggggcaggatttcacccagaccgctgccgggagacgggtgcggatcatgcgcaccagcatgaccacctag

SEQ ID NO: 25379 - DNA, 393 bp, Glycine max
  Peptide Sequence Number=SeqID_117064
atgatacgcggagataccttacggttatccacacccttttgtcatccagaggcgacgggcccgatgacaagcagagacaaaatttggtcattctgcacccttgtgtcatccagaggcggcgggcccgatgatacgcggagataccttacggttatccgcacccttgtgtcatccagaggcggcgggcccgatgatacgcggagacaaatccttacggtcttccgcacccctttgtcattcagacacagtcggtccgatggcgcaagcagagacaaaatttggtcattctgcaccctttgtcatccagaggcggcgggcccgatgacacgcggagacaaaatttacggtcttctgcacccgtttgctcattccagagcacagtcggtccgatga

SEQ ID NO: 25380 - DNA, 182 bp, Glycine max
  Peptide Sequence Number=SeqID_117065
atggattccactgcgatgagtattaagccttcccgaagtgatcaacaatggtccctcgggatgaagttgagagtaaacatctcagaactttacgaattccacaacgatggggtgttaaacatttttgagtggtcaaacgaaggtcgcatgctgacaaacaatggtccccggacgaaattagg

SEQ ID NO: 25381 - DNA, 249 bp, Glycine max
  Peptide Sequence Number=SeqID_117066
atgaagaacgaacgacgaagaacggttgaaaatcttcccgaaatcacccctggaaacgttacggaagcgcctcggcttggattttcttcacgaaaacaattttcctcactaattttaagtgattacaaagaaaaggaaggagatgcttgccacccagctcgcccaggcgagctaggttgcttcctccagaagcaaccgccttctggaggaacatcctggaaggcacaagtgggcctggttgctatttga

SEQ ID NO: 25382 - DNA, 129 bp, Glycine max
  Peptide Sequence Number=SeqID_117067
atgacttcaaaagaattgaacgaggagccatatgaagtgaaaatctcatgtacggtccgagtcaatagcaatgattcgagcactttacactattttggaaacccaggactcaatcgtatggatatgtaa

SEQ ID NO: 25383 - DNA, 435 bp, Glycine max
  Peptide Sequence Number=SeqID_117068
atggcaagacacaagggtttgttggtgatttggaggggagggacgaatcaaagcgacagggctgaatctcagtggatcgtggcagcaaggccactctgccacttacaataccccgtcgcgtatttaagtcgtctgcaaaggattctacccgccgctcgatgggaattgcgcttcaaggcgtctcgtaaggctaatccgcctcacgagggtcaccaacggcacgtgcctttggggggccgaggccccctactgctggtcggcaaacggacggcgggcgcacgcgtcgcttctagcccggattctgacttaaaggcgttcagtcataatccaacgcacttctgcttcgcgccactggcttttcaaccacgcgcgatgaccaattgtgcgaatcatcggttcctctcgtacttggttgaattactattgccacactga

SEQ ID NO: 25384 - DNA, 751 bp, Glycine max
  Peptide Sequence Number=SeqID_117069
gactacaagtccttgccttcagaaagctacacgccctcgcttcagaggactacacgtcctcgccatcagagggctacatgccctcaccttcagaggactacacgtcctcgccttcagagggtcatgtaccttcaccttcagaggactacacgtcctcgcctccagaggactacacgtcctcgcctccaaaggactacatgtcatcgccttcagaggacaacatgtcctcgccatcagaggactccacgtcttcaccttcagaggactgcacgtcctcaccttcagaggattgcacgtcctcgccttcagaggactgcacgtcctcacctttagaggactgcacgtcctcgccttcagagggctacatgccctcgtctttagaggactgcacgtcctcgcctccagaggactacctgtcctcgccttcagaggacttcacgtcctcacattcagagggctacacgccctcaccttcagagggctacatgccctcgcctttgtagggtttcatgccctcaccttcagaggagtacacgtcctcacagtcggaggtctacacgccctcacctttagagaacaacacgtcctcgccatcagaggactacacgtcctcaccttcagaggactacatgtcctcgccttcataggactacatgtcctcgccttcagaaagctacacgccctcgccttcagaggactacacgtcctcaccatcagagggctacacgccctcaccttcagaggactacac

SEQ ID NO: 25385 - DNA, 411 bp, Glycine max
  Peptide Sequence Number=SeqID_117070
atgggtcattggggtgataagggtattttcatgggtttaccttggtatcgtgttcatactgttgtattaaatgatccaggccgtttgctttctgttcatataatgcacacagctctggttgctggttgggccggttcgatggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggtgtggccggagcacatattgtgttttcgggcttgtgctttttagcggctatttggcattgggggtggcttgttttggttttggcgcatttcatgtag

SEQ ID NO: 25386 - DNA, 146 bp, Glycine max
  Peptide Sequence Number=SeqID_117071
atggaggagttgattaacaaaacacaactctctcccaaaataatcccatcatcaagtcggctcggtggctccacaaaagaatctcacttctcgtactctactgctgtcattctgctcacacgaacaagagttcgtgatcatcacag

SEQ ID NO: 25387 - DNA, 79 bp, Glycine max
  Peptide Sequence Number=SeqID_117072
atgacaagccagacagaaaggaaaggttgttgctgtgagaaagaagatcactgtgaaactgagccagtaccaattgaat

SEQ ID NO: 25388 - DNA, 249 bp, Glycine max
  Peptide Sequence Number=SeqID_117073
atggcattagcgcgtgacttttgtaaggaaacaacccatggggcattttgccaaggaggcgtgtgtgatgtaaataacaaatacaccttggaagtacatgtaaataatctaggggaggaggttgtatgccatttttgttttaagagtagtgtcccactggtaagactaactttccaaatgtttgccttcgcaggaaatggccccgaggaagcttgcctcaaagaggtccaggaaggacaaggcagctga

SEQ ID NO: 25389 - DNA, 66 bp, Glycine max
  Peptide Sequence Number=SeqID_117074
atggatgcaaaattcacaaagagtcgtgtacctaggagcctacttgaattgttagtaaactggtag

SEQ ID NO: 25390 - DNA, 426 bp, Glycine max
  Peptide Sequence Number=SeqID_117075
atgactagaggcaatccatctgacttacaatcctttgatcctgagatagataggacatttcatagattagttagacatcatttagtaccttttgagcatcctgagcattctgttattggtgactttgagcattataattttgaacattctgagaacatggcacaacctccaccccgcgagaggactctaagggaaatggctgcacctgatttcacctacgaaagcttatgcatccaataccctgatgaggatgtcccatatgttcttaaaaatggactgatccatttgcttccaaagtttcatggccttgcaggtgaaaacccacacaagcatctaaaagaattccatattgcctgctccaccatgaaaccaccagatgtccaggaggatcacatatttcttgaaggccttttccacattctttag

SEQ ID NO: 25391 - DNA, 243 bp, Glycine max
  Peptide Sequence Number=SeqID_117076
atgaatattgaggaaagaaagaatatgctagatgatattgcagaatctttagaacaaatgcatattcatggacaagattctaaaggaaaaggtaaaggaagcaatgaagatcctccagaagaagtcaaatccaatgatgaacttccaaaagaatggaaagcttcaaaagatcatccccttgacaacattattggtgatatctcgaaaggggtaacaactagacattctcttaaagatttatga

SEQ ID NO: 25392 - DNA, 364 bp, Glycine max
  Peptide Sequence Number=SeqID_117077
atgtgttggtttagaataggtagcaaaatacctttggcaatttacactttgggtatgatagcaaaatacttggatgtattagaaataccaagatgtgcacatgtgcaatttttggtaccccaaaatgctttgagtatgcatgtatgtaaatttagccaaggagatgtgtgtgatagtagtgtcccactggtaaaactaactttccaaaagtttgccttcgcaggaaatggccccaaggaagcttgcctcaagagatccaggaaggacaaggcagccgaaggaactagtccgctcctgagtatgacagtcaccgctttaggagcgctgtacaccagcagcgcttcgaggccatcaggggatggtc

SEQ ID NO: 25393 - DNA, 381 bp, Glycine max
  Peptide Sequence Number=SeqID_117078
atgactagaggaaatccatctaacttacaaccctttgatcctgagatagataggacatttcatagattagttaggcatcattttataccttttgatcatcctgagcattccattactggtgaatttgtgcattctgttattggtgattttgaacatcctgattttgagcattacaattttgagcattctgattctgagcattctgattttgaacattctgagaacatggcacaacctccaccccgaatttcatattgtctgctccaccatgaacccccagatgtccaagaggatcatatatttctgaaggcttttcctcattctttagagggagtggcaaaggactggctgtattaccttgctccaagggggatcctctag

SEQ ID NO: 25394 - DNA, 384 bp, Glycine max
  Peptide Sequence Number=SeqID_117079
atggaaaagaaattgatcgatgagaagagaaagaaaaaactagagaaagctactcaatccgaaagcactgacaccgtcattgatcctccatctcccatcaaacgacacgtgaagtggaagctagcccgtaccaaggaaactggtgacatgacatctgaggcagcaaaagaaattgttgacaagattgatgcgcttgaggagcaggcctcacagggttactttgttacccatggacgtcatgatatactgactgatgccattgggagccggtataaccatcaagcaatactttggatcggctacaaggacctcctccattgctctcaaatacctgcaacagttgacgcaacaaatcaaggaccagctagaggattcgatcactga

SEQ ID NO: 25395 - DNA, 204 bp, Glycine max
  Peptide Sequence Number=SeqID_117080
atgttgctaagtagcaatgtcatctatatctgtgtaagagtggtcatgttggtgcgcatggtccacactcttctctttgcagcggcacgggtgaaatcttgccccattggccctcctccaatatcagggggtggcccaggaaccgttaaaaggaaactactggctcccttaaccgggaagtgcaagtctcggttaagcatttaa

SEQ ID NO: 25396 - DNA, 495 bp, Glycine max
  Peptide Sequence Number=SeqID_117081
atggttggtacattcttccttttgaaacaacaaaatagtttagagattatgagcgaaggatggtctaatttggatgacctgttaatgcaattcaagagtatagtagattcaatgcaacaagcatttaaaagagttgagactcagattggtaagttggtggatgacatgactaaagttgtggtcagaagagaagaaaagtatgcagagattgaaacacatcaagaaagtatttgtcaaattaacgcaatccatcatcaattgatcaccaaagaagaaaaggatgaagtctccattgttccagaatattcctacatggcaactactagctattttgtaggcaaagataaaggtcgattggaactcagtgtagaggatcagaaaatctcctttgacctctttgaagcaatgaaacacccagatatgagtgatgcctattttgaagaagaagaggtggagcaggagatagcattatcagcttcaaccatggtactatag

SEQ ID NO: 25397 - DNA, 177 bp, Glycine max
  Peptide Sequence Number=SeqID_117082
atggcctcctatggtgtggcgtctcctctctctcttcctttctccattacattgccattcatcttccaagatgcaaaggaatccattgatgaagagctagccaaggccaaagcgatggcggacacctactcccccccgaggagatccacgaacttctcgtctattgtcagcatatga

SEQ ID NO: 25398 - DNA, 267 bp, Glycine max
  Peptide Sequence Number=SeqID_117083
atgatgacaacaaaagatgatgaacaaaaagctcaagtgaatcaaagaacatctcaagagaatcaagatcaagatcaagattcaagaatcaagaattcaagactcaagaagaaagcctacaaacaagtatcaagattcaagattcaagatctcaagaatcaaagatcaagattcaagaatcaagtatcaagactcaagatctcaagaatcaagatcaagattcaagactcaagattcgagaatcaagaaaagactcaatcaagataa

SEQ ID NO: 25399 - DNA, 411 bp, Glycine max
  Peptide Sequence Number=SeqID_117084
atgtggggaggcgaacaagacattgaggtagcagcaactccagaaggacctctatcttctgaggcatcttctagttttccaactcaagggcaatctcacacagttttagctgaagcaaatatcatggctgaggagccaagaagagttactctggaggactactcaagctcaagtgtgtcgcaattctttactagtatagcgtggccggagttgatacacaacaatttgtttcatggtctacccaacgaggacccgtatgcacatctagccacttatattgaaatttgcaacactgttagattagctggtgtgcctgaggatgctgttagattgagcttgttttcattttctttgtctagagaggctaaaaggtggcttctttcatttaccggtaacagtcttaagacctga

SEQ ID NO: 25400 - DNA, 630 bp, Glycine max
  Peptide Sequence Number=SeqID_117085
atgggtgaagcagaggaggtgcaagagaagatgaaggccgacatggaggccatgaaagagcaaatggccacaatgatggaggccatgatgagcatgaagaagataatggaaaccaatgcggttatagtttccgctactagcgctatcgctaaggtgaacccgatgctcccatctggcctcaagcaaatgaatcatccaacctcaaatatgttaggcaaagatttgggaagtacggacgaccccatgatgtgcaaattcaaaacaagcacgccttcccatcatatggcttgcctcccgactatacaccacccaatgtggcatacactctcaatgaaaatctcaataactccactccgatactcattgagaaccaataacctcatcaggcacatatctctcatgggggagacacatgaaattccccaccacaatctagctgacttcgagccttggctcagatatgccactgaagggcaagcagttggtggtataccctttgaaaacactttggagggccctcagtttcgcccacaaccacaaccattgcgttttgtggtgggaaaaaaaccctcatgctatggcagaaatgggaaagttggatcatctagaggaaaggctcagggccattga

SEQ ID NO: 25401 - DNA, 324 bp, Glycine max
  Peptide Sequence Number=SeqID_117086
atggttaaggaggagtgtaaggaggtaagtgtctcctccaagagattagttaagaaggaaagtcattttgaaataaagacaaatattaaagaaacttcccctcttagacaacctccacatcttttcctttgtaaaaagacacttgttagcactgccacacctcttgggcttgaggttattcctcaagtaaaggagttgttggatgagggtttggttcgtgtcgagggaaggagcccagagtatgaagaacctcaggatttgaggtcaaatcctttccaaggtggaggggatgatgcaatcctacccccagagggtattggatag

SEQ ID NO: 25402 - DNA, 162 bp, Glycine max
  Peptide Sequence Number=SeqID_117087
atggtgatatcatggttttcacttaaggctgtagtgagctcaaaacaaggaaaggaaacaaggctcaaagggctatcaaagaaattaattcaaggacgcatcaacaagaatcaagccaaggctattgtgcaagcactcaatggggcaaaacacaccaaatga

SEQ ID NO: 25403 - DNA, 363 bp, Glycine max
  Peptide Sequence Number=SeqID_117088
atgacgggactcaatcagcatccgaagcttccaacattcaattttgagcgtctcgatatattacaggactccatcagacatccgagtaaaaagttatcgtcgtttgaaaaggctcagagattcaatcattcaatttcgagcgtctcgatatatgacgggactcaatcagacatccgagtaaaaagttattgtcgtttgaatttgctcagagcttcaacattcaatttcgagcgtctcgatatattacgggactcaatcagacatccgagtaaaaagttattgtcgtttgaattggctcagagcttcaacattcaatttcgagcgtctcgatattacgggagtctcaatcagacatccgagtaa

SEQ ID NO: 25404 - DNA, 273 bp, Glycine max
  Peptide Sequence Number=SeqID_117089
caacctagctcgcctgggcgagctaggtggccaccacaccccccgttttgttgaaaaatgggatgctgaggcttccgagacacccgtaatgcttcccaacctagctcgcctgggcgagctgggcggcaacctcctccccctttttcctataaataggctgaagggggctgttttaaggaggccggatgcccctggtgaggtttccgtaagcaaattcgtgaaggttttcctccgttattcaccgttcttcatccgttcttcgttcttcaacgg

SEQ ID NO: 25405 - DNA, 333 bp, Glycine max
  Peptide Sequence Number=SeqID_117090
atggattgcacccacaagacacccagtgacctgaagaagtccaacagggccctggggtttccagctctggttacgggcctctatcagtcctacagggtgtccgtacccccccggcaaggtcacgtcatcatagggatcgcgcctgcaagacacccagtggacccgaaagaaagtccaacagggtcttggagttgtcaagctctaattacgggtctctgtcagttctacggagtacctgtcacctccagcaagggcatcaggccccctactaatcgatctttcatcaagaagtactgcgcccccaggcagacgcagggcgagacaccacagtag

SEQ ID NO: 25406 - DNA, 270 bp, Glycine max
  Peptide Sequence Number=SeqID_117091
atggttttcggggcttccggggctttcgcaatgcttccggttgcttcctcaagcaacccaggtcacctgggcgagctgggcgacaacctcctccccctttttcctataaataggcgaagggatgctgttccaaatatccctaacccccttggctatgcatttcagctgttttgggtgaaaaaaattgttttcgtgaagaaaatccaagtcgagaaggttttctgtcgttcttcaccgttcttcatccgttcttcgttcttcaacgggtaa

SEQ ID NO: 25407 - DNA, 309 bp, Glycine max
  Peptide Sequence Number=SeqID_117092
gagcaagggaaacaccctcatcgaccgcaaaaggataaaaaatataaaaagctgtcgtctcttatgacggaagcatggggtgctaataccttccccgtgtgtaaatacaactctcgaacctttcacttaaaagttcgtagatcatggcttttccgatttttccaacgttttcctcaaataaacgttggtggcgactcaacgcgtattcctttcatggaacacgcacccgcgagtcacgcgtcgccctcccgtcgaagggtaggttgcgacagttggcgactccactggggacggtttttagagagttag

SEQ ID NO: 25408 - DNA, 372 bp, Glycine max
  Peptide Sequence Number=SeqID_117093
atgaattgcgttttcgttcatgtgtcctccaccttcgagtttggagctatgcgtagtgattgcttagtgcaattctccattctcaacctttttcggagccccatgaattgcgttttcgttcatgtgtcctccaccttcgagtttggagctatgcgtagtgattgcttagtgcaattctccattctcaacctttttcggagccccatgaattgggttttcgttcatgtgtcccccaccttcgagttggaagctttgcgaatggatggcttatggcaattctccattctaaacctttttcggagccccaggatttggattttcgtcctggtgtctccaccctcgagtttggagctatgcgtagtgattgcttag

SEQ ID NO: 25409 - DNA, 705 bp, Glycine max
  Peptide Sequence Number=SeqID_117094
atggccaagttcgacccagacatagtcctcgagttttatgccaatgcttggcctacagaggagggcgtgcgagatatgcgatcctgggtgaggggtcagtggatcccgttcgatgcggatgctctcagtcagttcctgggatatcctttagtgttggaggagggccaggagtgcgagtatggccagaagaggaatcgggccgatggttttgatgaggaggccatcgcccaattgctgtgtataccggggcaggattttgcccgaactgctgctgggagacgggtgcggatcatgcgcaccaaaatgaccaccctgaccataatatggatgagcattcacgtggctcagttgatcgctgatgtcatctatctatttgcagagacaggcccagggggatgctccgcaggccgcagacgcaccgccacctcatcaggctggcccagctggatcattgatacggagcaatattacggcatttggttcaccagcaggcggccaaccaccggggcgcatagccagggttttacttcctttccatgccctactccggatcagttcagggcagaggtcgcatggcccggagattggcctgaggcccgggcaggagaggcaccagcagaggctcccgacgaggcagatgaggcccgcgaggacgaggagatgactgatttgcttgatttcttgggagggagcggagccacatga

SEQ ID NO: 25410 - DNA, 225 bp, Glycine max
  Peptide Sequence Number=SeqID_117095
atgaagaacggtgaagaatcttcacgaaatcgctcacggaaacgtctcggaagcgttacagaagaggctcggcttggattttttccacgggaaaaagagggaagtagttgccgcccagctcgcccaggcaagctgggttgcttccaccagaaggcaccgccttctgttgaaccccctggaaagcccaattgggcctggttgctatttgcacaccctttttactaa

SEQ ID NO: 25411 - DNA, 388 bp, Glycine max
  Peptide Sequence Number=SeqID_117096
tgaccccaatgcaaagttactccaaggagttcgcaaggcatgtgatgcgctcccaaatctaaagactgtgagagacaatgaggttaaagcttcggaagaaagtgatgaggtacaagccctaaaggcagagcttgaaagagcccgggtagtcgaagagaagttcaaggcagcaatagtgagctcaaactctgaagaggtgaaaggaatcatcatgggtcaaaggcatgatctagaaggacgagctaaggcttgccttagtgagactgaagggaatatgtgggccatcatcgatgagtgcaaagagaagctaaatctagcggcgactcacgagcaaaggctagaagatgagtacgccaagatatcagcagaaagggaagcaagggaaagg

SEQ ID NO: 25412 - DNA, 616 bp, Glycine max
  Peptide Sequence Number=SeqID_117097
gacgaggcttctccgcgtgcttgaggtggattgcgacaaagaagaccgtgaagagcattcacacgccatcatacagggagcgcctggaccgactccgaattccggatgtctgttggatcccgtatggggagcatcgggaggtccgggatttccacgtcagatcatgctactccggcctcttgcgttgagggcctgttgctgtttattaccgaccggagagggtcgtgcggcagtttggtggatgcactacgaggatcatatcgtacctacaggggaggtgtgcgttgtgccaggggcttgttccagtgactacatcgactggttcttccgcatctctcatcctttcatgacaccaggccacgtagtagatcctctgcctcatggtcacgccccgcagccccgagtcgtccctcaggccccgcagacggatatctctcgtgaagtttgtgatgacattgctgagaggttggagcgtcatctgagtctaggggtggtcacgcctggctcatcgacacatgaggtggtcgaagaatgccttagattggccaggagtgtgatacaggaccatctagtatacgttaggtgtagacgcagacggcgcactgatcaggcgtag

SEQ ID NO: 25413 - DNA, 769 bp, Glycine max
  Peptide Sequence Number=SeqID_117098
gggttgcatcagttacaatcatgttcttactataagacaacttggctaccctatgagagggccaccactagaggaagagctcgcagctgtcatttcacgagggttcaatgagaccaacgtggagatccttcagaaggtccgcaaagcatgggaagtggtacaaaagaaggacaaagagctcagaggcagcaacaatgggcccattggtggctaccgtaagaccgctaaaagggaagaagttgaggcaccggaggaagatgaagaggtgcaggcccttaggaccggactcgagcaagctcaaacagtcaaagaaaggttcaaatcagtggctcttaggatccgaaaggagaatgccgaactgagggatgtaaatatagctaccaccaaggccttggaacaagagaccaagagggctcgtagggaagagcatgaccggaacaacgagcttaagctctggagggaggaaagggaccaatcgtgggtagacaatttgatcttgaaggatgagttgaaggcttgctcaaggtccaagagaagtttgtctcagcgtttatgcgagacagagaccaacatgttagccatcatcagcaagtaccaagaggaactaagtctagccacgacccacgagcatagggtggcggacgagtatgcccaagtgtacgcgaaaaaggaggctagaggaagggtgatcaactcgttacaccaagaggcaaccatgtggatggaccaatttgctcttaccttgaacgggagtcaagaacttccctga

SEQ ID NO: 25414 - DNA, 291 bp, Glycine max
  Peptide Sequence Number=SeqID_117099
atggcctttgctcaaacctacctgattagaaagataaggcgcctttacttagctgttagcctcccaaaagaaggatctccggtttcaaaagccctagatatagatgtccgggggatcatagatctctcttttcaaacaaacaaagttggcaaaggagaggggttcaagatgccctcgtctaagtctgtctatttctttgttttaggagctcgtaggtctcaagggttgttttccaactcgaccggaggacttgagatgtcaattgctaagtcctttaacgcaatccagtaa

SEQ ID NO: 25415 - DNA, 654 bp, Glycine max
  Peptide Sequence Number=SeqID_117100
atgacaagcagagaccaagtttggtcattctgcacccaagatacgcggagataccttacggttatccgcacccttttgtcatccagaggcggcgggcccgatgacaagcagagaccaagtttggtcattctgcacccaagatacgcggagataccttacgttgtgtccgatggcaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatctgcacccctttgctaggcggacacagttgtgtccgatggcaagcagagaccaagtttggtcattctgcacccaagatacgcggagataccttacggttatccgcacccttttgtcatccagaggcggcgggcccgatgacaagcagagaccaagtttggtcattctgcacccaagatacgcggagataccttacggttatccgcacccttttgtcatccagaggcggcgggtccgatgagcagcagagacccaagtttgggtcactctgcaccccagatacgcggagataccttaccggtatctgcaccctttgctaa

SEQ ID NO: 25416 - DNA, 231 bp, Glycine max
  Peptide Sequence Number=SeqID_117101
atgcgggtgcaagccattggtctgtttgctcaagcgacctgtgctcctgagtttggacttccaagacctttcaatcagagattactcatcttgcacgttgttgggagcgccgtaaaacaacgagtaaaacgttcatgtgacctcattttatcatgccggaaagtttgtcttcttagagaagcgagttgtcaagaatatgatgttggaacaaaatggcctcagttatcttaa

SEQ ID NO: 25417 - DNA, 504 bp, Glycine max
  Peptide Sequence Number=SeqID_117102
atggatgctaaaaaagaatacaatatcatgaatacactccaacatatgaccatggtagccacgacataccaaacatcccatgggtgtttagaagaaacaactatagatattttagttgcaggattttccggccaatcaaaagaatgtgctatcaaaacaaatctcaatggaaaagtcattaaaaatgatgataataggaagattcctgatgctgttaatacccttattttcacaatagcccaacactttattggtgacctgtcactttggaaggataggttagcagaattatcatccaatcttaagtgtagaactttaggggactttaggtggtatagagacaccttcttgactagagtatacaccagagaagatagccaacaacctttctggaaagaaaaatttctagccgatcttccaagatcattaggagataagaaagtagccttaaaaatttgtctagatgacaaaatccaaagacaactagccaaagaaaaagcctag

SEQ ID NO: 25418 - DNA, 207 bp, Glycine max
  Peptide Sequence Number=SeqID_117103
atgtcccttgccactctatttggaaagttgcaggaacacgagatggaattattgagattacaccaacatgaagaaaatgacaagaaaaagaaaggaattgctcttaaagcatcatcctcaattcaagaagaaagtgatcaggataatgatccagatgatgatgatgatctaagtctttttgtaagaagattcaacaagtttcttaaa

SEQ ID NO: 25419 - DNA, 261 bp, Glycine max
  Peptide Sequence Number=SeqID_117104
atggatatcacaactattcaagctaccgaggaatggacaagatttcgagatgcattagctatgaatatgtttgctaactatcaagttaggagaaactttgactttttctttgttttcataaatcgtaaaccgtttgctattgctgacaagatctggtatggtattgtaagtgacatccttggccagagtggatttgattgggatggcactaagcacatgatcacagttgagaatgaaaatgcttggaatgaatattgcagt

SEQ ID NO: 25420 - DNA, 243 bp, Glycine max
  Peptide Sequence Number=SeqID_117105
atgtcagaagcccaaataatagcccatgcgactcaactccatgaggctcaacaaaagaagagagctgaagatgttgttgttgttgctattactgagaaagaacttgttgctattcttggaagagaagctatttccactatccaagttaaaacatatgctaaagttgtgggcgacaccttatgtgtggggtcattgttagtcgttcagtttgatttttatgcagagatattcccttcaatgtga

SEQ ID NO: 25421 - DNA, 150 bp, Glycine max
  Peptide Sequence Number=SeqID_117106
atgaagattttccgtcgttcttcaccgttattcgttcgttctgtggtcttcaatcggtctgatttcctcatcgcaattgaggatacgtacgagcaaaagcctcgcttttgtcgaccaccccaagagatcgttaacggtccaacgccttaa

SEQ ID NO: 25422 - DNA, 201 bp, Glycine max
  Peptide Sequence Number=SeqID_117107
atggataggccaaagcatttgtctccaagggacgacaagggtgttgcccttgctcctacgtatcctcagcaaaacagggcatttggagtaatgacagctcgcccaggcgagctgttacttcattttgaagcaaccttgctcgcccagacgagccagaggctagcctgggatagccagggcttagaaacagccttaaaatga

SEQ ID NO: 25423 - DNA, 276 bp, Glycine max
  Peptide Sequence Number=SeqID_117108
atgtcgagcgtcttggtatactacgggacacaatcggacaaccgagtaaaaagttattgtcgattgatttttctaagagcttctgttctaaatttcgagcgtctcgatatactacgggacacaatcggacatccgagtaaaaacatctcgatatactacgggacacaatcggacatccgagtaaaaagttattatcgtttgattttgctcacagcttctattctaaatttcaagcatctcgatatattacgggacacaatcgggacaaccgagtaa

SEQ ID NO: 25424 - DNA, 474 bp, Glycine max
  Peptide Sequence Number=SeqID_117109
atgaaaagatggtgggctgcgcaccctcaaagctttgcagatttggtcttcgccagtgaaaggatcaatgtgggtccgaaaagaggcaaatttgatcatcctactaggacgactgagaaaactggggcaaataaagagggtgaggatgagggagaaacccatgctgtgactgccattcctgtacggccaaatttcccaccaacccaacaatatctttacccagccaataacaaactttctccttacccaccacccagttatccacaaaggccatccctaaatctaccacaaagtctgtctaccgcacttccaatgacgaacaccacctttagcacaaaccaaaaacaccaaccaagaaccataaccctagccaaggttcatcaacctccattcctccgagaatacaactcgaacgcaacgtgtgcttgtcacggagaagccccgggcgttccattgagcatggtagggctctga

SEQ ID NO: 25425 - DNA, 685 bp, Glycine max
  Peptide Sequence Number=SeqID_117110
ggtgaaacttcctgcttttattgttgaccacagagtggtacctggagatatgtcgcgggggtcaggagaccttggggacgtcaggcgagctcctggcagtcaacagataaaaggaacaaagaccacaaagcaagggggcttgtggtggctggccagctgtgaattttgtgtgatatgtggattatggcctctggtaatcgattaccaagggcttgaaaacgaagtcaggaaacttagggagcctctgatcgtgatggcggcgcagctaatccatgatcgagtagagatggagtgcctagagggagcttgggagaccctcgaaggcaacacgaggtgccgatttcggggcacgattcgatttacggcgacttctttggtgcatccagatgaacccgtgcgcacgcttcagcgcactgtggagtggatactacccacgcctacaccatatcgtctagtggagccagtccaagtgatcgaggtgacgtcatccgaggaagaccctgaggaggatcccgaggagctacctcctgagcctgcggtggatgctcttgactttctagagggcgatgaggacccacttcctgaggtggattctcccgaggaagtcatgtcggcatctgaggcagactctacggaggatagtggaccgagagagatggcgaccagtggaggctcttcatcatag

SEQ ID NO: 25426 - DNA, 426 bp, Glycine max
  Peptide Sequence Number=SeqID_117111
atgcctttcgcttgggcatcttctgaggattctaatggaggagtgcgtcttgaggtgtccatagcttctttctatgctggatcaagttcagatcagtcccttcaacaaccacagtactttccgactaggaattccatcacagttctggttctggaattgaatactctatatgctctgctgtttgtagagtatcccaggaatattcctgcatcactcttgggatccatctttctccttttgctctctatctgccaaaatgtagcatggacttccaaagatgtggaagtgcttgacagttggcttcctccctttccagatttcatacagtgtggttggagtgcctcttctaagtgtgactctgttgtggatgtagcatgctgtgttcatggcttccgcccaaagattatagggaagtctttggcatga

SEQ ID NO: 25427 - DNA, 702 bp, Glycine max
  Peptide Sequence Number=SeqID_117112
atgaaagaaggagaattttttgtctgttatcaacctgtctgtgatgacctggggcgttgccgtggcgcggaggccctgatgcgctggaaaagagcagacggcagacttatccctccagacgtgtttgttccggcggcagagtcagaaaatatgatggcccccttaacacgtcatcttatgagacttattgcgaatgacgttaaacagtggataccaacgagagagtttcatctgagcattaacatttcatcagaacacctctccggtgatgaatttattgaggatatcagggtattccgtgacaaccttccacccgctttgtccctggtggttgagatcactgaacgtacatttatagaagatacagagaaaaccgttgctcacttgtctctgttgcgagaggccggcataaaagttgccatagatgattttggaacagggtattgttccttgtctatcttacaaatcctgcccgcggattacctaaaaattgatagatgtttcacggaaacaattgatttcgcggacgggtccccccctgtactggatgccattatcgccctcagtaaaaggctgaacctcaccatgattgcagaaggtgtcagcacaaaaaagcaggggttcctgttttcacggcctcttgatgcagttgatttttggagttggtatcacggaaacgttgatgaaacgaatttatcttag

SEQ ID NO: 25428 - DNA, 338 bp, Glycine max
  Peptide Sequence Number=SeqID_117113
atgaatgaggacttgaagaaattaagagatatgaacaaggatggcgccaactcccaagctaatgtagtaaaaagtgttgaagatgaagatgaagatgaagatgatgtgtttttggaaacaaatgatgaggttgctaaaacaaaatgggtgatggattttgttgcctcaaagcacatttgcaaagatcaagagatggagcgtaagatgaagctttatgatggtgctattcgaactttctcaaatgtgaggtttgtaccttctgctattgtcaatatgatttttatagaggagatgacatcacaagggtacaagtatgttggttcaaagtggggatacag

SEQ ID NO: 25429 - DNA, 1053 bp, Glycine max
  Peptide Sequence Number=SeqID_117114
atgcctccgaaaaagctttccacaaagaggtctagaaaggaagccacgggagaaggctccagtgctgccttggagtttgatagtcactggtttcagagcgccgagcaccaacagcgcttcgaggccatcaagggatggtcattccacagagagaggcatgccatcagtcagttcttgggcgacccgttgattctggatgaggaccaacagtgtgaatttagccagagaaggaaccaggaaaacggttttgatgaggaagccatcgcccagctgctttgcataccagggcaggattttgcccaaaccgctgcagggaggcgagtgtggattatgtgcaccagtatgactaccctgacccagatttggatgactctgctgctcagcaatgtcttgcctaacgaccacaactccgacctccctctgcctaagtgccaattggtgtatgccatcctgacacggatgagcgtccacgtggcccaggtgattgttgatgccatttatttatttgcaggaatggcgcctactaggcacccgttgaacccagagaagtccaatagggcattggggtttccggctctgatcacaggcctctgccaatccttcggagttcaggtcacccccagcaaagtaatccgaccaccgatcacccgatccttcattgagaagtactgcacgcctaggcaggcacagggtgacgcacctcagggcacgggcgcaccgccaccacctcggcaggcagatccggttgagccgctgggcgtggagcggtatctacagcatttggtttgccagcaggcggccaaccaccgtggacaagtgcagatacacgagtgtctctatcggtttagccgcagtcagcaggggcagggttcctccccttttgtatgccctaccccggagcagtttgcggttgaggttgcatggcctggagactggcccaatgcccaggtcgaggaggagcctgtaggatcccccgatgggatggatgaaccccacatggacgaggatatgactaacctgttcgatttcttgggagggagcggagccacatga

SEQ ID NO: 25430 - DNA, 447 bp, Glycine max
  Peptide Sequence Number=SeqID_117115
atgccacacgtggaagccgcggaggagtcattggaaacggctttccaatcttttgaggtagtaagcatcgcctccgtagattccctccctaggcagccccgcctgtccaatgcggcaatgatggtggcccgggtgatgttggggcatggctacgagcccggaatgggtttgggcaagaacaacggcaacaggaccagcctggtaagtaccagaggaaaccgcaggaagtttgggttaggctataaacctacgcaggctgacataaggaaaaacatctcagaaaggaagaacaaaggccaaggcccacgatcgggacaacaagccaaagaggctctgcgatgccacatcagtaggagcttcgtaagtgcgagtttaagacgcgagggacaagtcgccgcgatatgcgatgaggactccccgaggagatcggatttggtacagccatga

SEQ ID NO: 25431 - DNA, 321 bp, Glycine max
  Peptide Sequence Number=SeqID_117116
atgtcgtttaaagagtcgacaccgctttgcacaagaatcggttctttgtatggatggacagaagggctcagccagacccggttcaattcgttttttgcgggaataccaggttcaagttcaagggaagagaaaagaaagcgtaactctttgttgtcctcttactcttttagcctgccttgtggaggtctctcgggtgtctacggcggatccgatcagtctcgtgaagaagtcttttccgatcttccactaagaaagcaagtaggcgacgcgaatctatggtttctatgtttcaatcgggtaccaattgcttggatgcgttga

SEQ ID NO: 25432 - DNA, 648 bp, Glycine max
  Peptide Sequence Number=SeqID_117117
atggaaccaattgcctccctcgcccagtattatgatcagccgttgaggtgcttcatctttggggacttccagctatcaccaatggtggaagaatttgaagagatcctaggatgtcctctagggggaaggaaaccatacctcttctcagggttctacccctcattggccagaatttctaaaaaagtccaaatctcggcgcaggaattagaccgccaaaggcagtcgaaaatgggtggtcggaataccgagaaatatttggagggagtcctctttccaaatgtggatgggttggtggacctggcagcgatcgacgtttttctcgcctatcataaccacaaggaaagtccggttgccgctatgctagccgacctatatgacaccttcgaccgaagatgtgaagaaagaaatgcaaggattgtttgctgtactccagctctctatgtggggctggtttcacaccattttctccaagaaggtaggcctgtctatccgctacaaggttaccgctcgtgcgtcgaaaaaggaaaggcgaattgggaccaactcttggctagcatgggggggcgtctgttaattggttccctcgctagaaggaaggaagaatcaggattctatcttcatgcgaaggatgtccaaatgttcccttga

SEQ ID NO: 25433 - DNA, 324 bp, Glycine max
  Peptide Sequence Number=SeqID_117118
atggtccatgacatctccgtcaaggtgaaactggaagtaactggaacatcgacagccctaaatgtgtttggcagtagacgaagcagcgatgtaacacaatccaccttttgccccaacttttgcaagatggttacttccatacttcaacttgactcgatgaatcttttcataaaagcacgagcttggttcaaccccataacccagggaatggaaattttgatcgccaatacttcatcaacatttcatagggatgaaagactcgggaatacgcatgctatgcatggaaaatgggaaagcgcaagggtcacgcatgagcaaacatga

SEQ ID NO: 25434 - DNA, 486 bp, Glycine max
  Peptide Sequence Number=SeqID_117119
atggcctccaactcccagcagtttagcgccagaaatgatgccatagtcattagaggagtgcatgaggtagctacaaacccatctgcatcatctgaaactaagaagcttgaaggcaaactggatgcattggttaaacttggtaacccagctgtccttgaatcagaaatctgtacctgtcgcaaggacctttgcccttccatgcagcaacctggagcaattgagcagcctgaagcttatgctgcaaatatttacaatagacctcctcaacctcagcagcaaaatcaaccacagcagagcaattatgacctttccagcaacagatacaaccctggatggaggaatcaccctaacctcagatggtccagccctcagcaacaacaacagcagcctgctccttccttccaaaatgttgctggcccaagcagaccatacattcctccaccaaatccaacaacagcaacaaccccagaaacagccaacagttga

SEQ ID NO: 25435 - DNA, 102 bp, Glycine max
  Peptide Sequence Number=SeqID_117120
atggaggccatgaaagagcaaattaccataatgatggaagccatgatagggaaatccggtttctcggaaaacgcaccagaacgtcaagtatttaaaaattaa

SEQ ID NO: 25436 - DNA, 435 bp, Glycine max
  Peptide Sequence Number=SeqID_117121
atgggtgaagtagaggtggtgcaagagcagatggaagccgacatggaggccatgaaagagcatatggccgcaatgatggaggccatgatgagcatgaagaagataatggaagccaatgcggttgcagttgccgctaccaatgctgttgctaaggtgaacccgatgcccccatctgatctcaaccaaatgaatcatccaacctcagatatggtgggcaaagatttgggaagtacggacgaccccattgtcgcaacctacccttcggcgggagggcgacgcgtgactcgcgggatgagtgttccacgaaaggaatacgcgcggagtcgccaccaacgtttatttgaggaaaacgtcggaaaaaccggaaaagacgcgatctacgaacttttaagtgaaaggtttgggagttgtatttacgcacggggaaggtgttag

SEQ ID NO: 25437 - DNA, 330 bp, Glycine max
  Peptide Sequence Number=SeqID_117122
atgccgatctccccctgcgaaagtatcggttggtttgtgccgttccaacatagggatcgtgcccacaacacactcggtggacccggaggagcccaacagggccctggggtttccagctctagttacgggcctctctggatcacgcccgcaagacaccctgtggacccgaagaagtccaacatggtcctagggtttccagctctgattacgggcccttgtaagttctacggagtgcgtgtcgccccctgcaagttcatcaggccccctattaaccgggttttcatcaagaagtactgcgcccccaggcaggcagagggcgagacaccatag

SEQ ID NO: 25438 - DNA, 603 bp, Glycine max
  Peptide Sequence Number=SeqID_117123
atgggaaaccccgttaaggaaagatcaagagctagaggcattcgtaatggcatcattggtgggtaccacgaatggctgaaagttcgcatacgagcgaagagaattttgaagcaccggaagaggacgaggaagtccaagctctcaaagcgagttaggaaaggcaaactcgccaaggagaagttcaagttggctgctacacacgttcggaaggagtgtgccgggttacgggaagagaatgcaattaccgcaagatcccttgaacgagagaccaagagggctcgcaaggaagagtatggccggaacaaatttcgcggagccctatggggtagcaataatgagctcaagttgcgaagggaggaaagggaccagtcgcgagcgcatggcatggttttgaaagaggagttagttgcctgttcaaggtccaaaagaagcttgtctcagcgtttatgcgagacagagaccaacatgatagctatcatcgccaagtgccaagaagagttaggtctagccgcggcccacgagcataggattgcggacgaatatgcccaagtatacgcggaaaaagaggatagaggaagggtgatcgactctttacaccaatag

SEQ ID NO: 25439 - DNA, 159 bp, Glycine max
  Peptide Sequence Number=SeqID_117124
atggaggcttgcttgtggggcttctatggaggctggatctttgagcttcaatggggtcctttaatggtgattttccaccatggagatgcagcggaagacaaaggagaagagactatggtattccgagaagtttctgaggataaaacacttcctgtgtga

SEQ ID NO: 25440 - DNA, 72 bp, Glycine max
  Peptide Sequence Number=SeqID_117125
atggagaaaatgaagaaattatatggaggagaagccatggagttgcagcagaagataaaggagaagaggtga

SEQ ID NO: 25441 - DNA, 212 bp, Glycine max
  Peptide Sequence Number=SeqID_117126
atgtctgaatcggacatccgtgtaaaagttatgagcattcgaatttgtcgagagcttccgttgttcaatttcgagagtctagatgagttatgtccgcgaatcgcatatccgtgtgaaaaagttatgaccattcgaatttctcgagagcttcagttgttcaattccgagcgtcttgatgagttatgtacgcgaatcgggacatcctgtgaaag

SEQ ID NO: 25442 - DNA, 105 bp, Glycine max
  Peptide Sequence Number=SeqID_117127
atggccgaccagcaggcgacgaagtccaaagccaaagctcaagacgttaaagaagcgctgcaaggaggcaacctagtaccctttaaatttccgcttgttatttga

SEQ ID NO: 25443 - DNA, 276 bp, Glycine max
  Peptide Sequence Number=SeqID_117128
atgcagggttaccgtatggttacccgcacctttcgtaaactaggggaaaacgagcccgttgacacgcaaagactaacatcatcttctgcaccttttgccatccaaggacagcgagtcaggtggcaggcggagataccttatggttttactctcgtcgtcttaaaacattcaagcccggcgacgtgcaagattcttctctgttgggcagcgacgatcgagtgcaatggcgaagggaagtgtcgtggttgtccaactttgttgctttcaagacactga

SEQ ID NO: 25444 - DNA, 102 bp, Glycine max
  Peptide Sequence Number=SeqID_117129
atgaccaagaaaagacaacattcacttgtccctttggcgcagtattgggccagaggaaaggcagagtcttccatgctatttactatgccagcaaggttttaa

SEQ ID NO: 25445 - DNA, 333 bp, Glycine max
  Peptide Sequence Number=SeqID_117130
atgcagaacggtgaaaaatcttcacgaaatcactcatggaaatgtctcggaagcgttacgaaagcgccttggcttggattttcttcacggaaacattttttctcactaattttaagtgaatctcagatatcaggagggttgaacggggcgtgcagccctctgatggtgaggacatgtagtcctctgaatgcgaggacgtgtagtcctttgaaggtaaggatgtgcagccctctgttggaaaggacgtgtagtcctttgatggcgaggacctgtagtcctctaaaggtgagggcatgtaaccctacgaagtcgaggacgcgtagtcctctaaag

SEQ ID NO: 25446 - DNA, 114 bp, Glycine max
  Peptide Sequence Number=SeqID_117131
ggaattggaaaaggaggattggtgccatatcttgaagaatttgagtcaagaagcaaggggccaaccaccttaagagctattgggactaaagaaagcacctccaaaattgagtga

SEQ ID NO: 25447 - DNA, 471 bp, Glycine max
  Peptide Sequence Number=SeqID_117132
atggataacaaagagggagtgcaagaacaaatgaagaacgacatgtcggctttaaaagatcagatggcttctatcatggaagccatgctaaaaattcaaaaatcaatagaagacaatgctacggcggccgcttccaatacatctaaggaagcggaaccggtgctacagcccacaatgaacttgggccgggatagaagcgcgatgggtttcaatcggaggtatagtcctcaagcctacccatatggtttgcctctagacttcactccccgtaccactccagacgatttgagccaagcccctaccttcgaggggcaactccctcctcatgccgactatcctctgcaggaagatgatgaaggagatgcccatttaagccttctacttccccaaagggaaccgaccccccatgagttgccccaaccaaacataatccgccatgccccgtctcaatccgcacccattaaggaactc

SEQ ID NO: 25448 - DNA, 381 bp, Glycine max
  Peptide Sequence Number=SeqID_117133
atgaattcggttataacagtgttgtatttcaatggaagggtatatgaagacaatgatggtgtaatatttgaaggcagtaaaaaagcgattcagattaaacgtggaattagtttcaatgctttgaagaaaaaaattggagataaggaaaatatattgccttgcaaatttgtgacgacgaagacattgaaacaatgttggaaagttttaaacaacaagaccaaatacaaaccggcaacaaatatgagtaatttacatattgacgaagacgatgatgatgatgatgattatcttgtgtctaactcatacgttgaagagtctttagacgaaaatgacagtgttgacggtatatctgacacagacgatgaaggtgggatcctctag

SEQ ID NO: 25449 - DNA, 378 bp, Glycine max
  Peptide Sequence Number=SeqID_117134
atgactatgcaaaacatgcagtttcaacaagagaccagagcctccattcagagcttaactaatcagatgggacagttggctacacagttaaatcaacaacagtcccagaattctgacaaattaccttctcaatctgtccagaatcccaaaaatgtgagtgccattacattgaggtcgagaaagcagtgtcaaggacctcaaccagcaacatcttcctcatccgcaaatgaacctgtccaacttcactctactccagaaaaagaaaaagatgatgacaaaaatttaaagaaagctgcatatccctcttccattccctccaagagcaatttccaacaaaaaaatggaagaggcagaaaaggagatcttggaaacatttag

SEQ ID NO: 25450 - DNA, 69 bp, Glycine max
  Peptide Sequence Number=SeqID_117135
gcatgcaaggattatagtgagtcatgattttggatcaagggtttgtagaatggctagacatgatacatg

SEQ ID NO: 25451 - DNA, 648 bp, Glycine max
  Peptide Sequence Number=SeqID_117136
atgttccttaatgggacaaggggttgtatcaattacaatcccgtcctcgccataagacaacttggctaccccatgagaggagcgccatcggaggaaagcatcacacctttcattgcctggggtttcagtgaccccaatgcgagagtgcttcaagaagtccaaaaggcatggggtgcagtgcaaagtaaagataaggagcttagggggagcagcaacgggatcgccggtggctatcataagtggctgagagttcgaacgcaaaagttggattggctcccaaagctaaaagctgcaagagaggaagaggctgaaactctggaggagagtgaggaagtgcaaaccctaaaggcgaaacttgaaagagcccaagtagtcaaagagaatttcaagtcaatggccatcaaagtctggaaagagtacgatgaactaacggacatcaatatggccactgctgaagccttggaacgagaaaccaagagggcccgaaaggaagaacacgaccgaaacaagttccggggagctttgtggggcagcaacagtgaacttaggctcctaagagccaaaaaggatcagtcacgagtcaaaggcatgatcctgaaagacgagttaaaggcgtgccattggtcgaaaagatgcttgtccgagtag

SEQ ID NO: 25452 - DNA, 384 bp, Glycine max
  Peptide Sequence Number=SeqID_117137
atggtagccataaccccaaccaaggttcatcaacctccatttctccgagaatacgactcgaacgcaacgtgtgcttgtcatggagaagccccagggcattccattgagcattgtaggggcctgaagcataaggtacaaggtctaattgatgcgggctggctgaaatttgaggagaatcttacaatgttaaatgaaatggataaagttgatatctttgtccctcatcctctcacaaacgcatctttgcttattcaactttcaccagaatgtgggtgcaagccattggtctgtttgttcaatcagagattactcgtcttgcacgttgatgggggtgccgtaaaacaacaagtaaagttcaaaaccaataagtttcaaaataaataa

SEQ ID NO: 25453 - DNA, 504 bp, Glycine max
  Peptide Sequence Number=SeqID_117138
atggcctcctctggacctgtcttttgcttttccgggaccccaaccatcaccactgcaaagctgaactggaaaaactacccttcatggtctgcttccgtggagttgtggttccttggtcaaggacaccatgactacttggagaaaacctctaattctgtttcagatgataaaagacctgaatgggagaagcttgactatcaattgtgtgccaaagcccaagaattctttgtcaatgatatccaaagcttgtttgatacaaccatgaaagttacaaccctcaagcaaaccagtcatgacatgatcactcatgtgggtaaggctcaggctgccgtggaagaactgagaaagttccttgtagctgattcattggaagaagtgaataggaaacttgacaaattctacatggttcttattttgagaagcttgcattcagactttgatcatgtgcgtgatcaagtacttgctggagaccagattccatcaatggattccctcgatcactag

SEQ ID NO: 25454 - DNA, 371 bp, Glycine max
  Peptide Sequence Number=SeqID_117139
gtgattcggccgcctatcacccgggcttttattgagaagtactgtacccagagacagggtcagggtgatgctccacaggccgcaggcgcgcccccaccacctcatcaggcgggccaggctggggcattcgacatggagcagtatttacggcatttggttcgccagcaggcagccaaccaccgagcacatggcttcgctcctttttcatgccctactccagaccagttcagggcagaggttgcatggcccggagattggcccgaggcccaagcaggagaggcacccccagaagctcccggcgatggagaagaagcccacgaggatgaggagatggctgatttgcttgacttcttgggagggagtggagacac

SEQ ID NO: 25455 - DNA, 726 bp, Glycine max
  Peptide Sequence Number=SeqID_117140
atgcagagcgatagccgaacatcatttcccccgcagtcaaaacggttcgataagaagtatttattaggaagccgagcggatcattatcctgtgccgatcttttgccatggcttctttgtcgtttttccgcttatttcgatccgctttgtcgatcaattaggatgggcggcgctgatcgtcggcatcgcactgggtttgcgccagctgttgcaacaagggctcggcatctttggcggcgccatcgccgatcgcttcggcgccaagccgatgatcgtcaccggcatgttgctgcgcgccgccggtttcgccaccatggcgatggccgatgaaccctggatcctgtggttctcttgtgccctgtccgccctcggcggcacgttattcgatccgccgcgcaccgctttgcgccggagcggtggtcggcgcgctgatcggcagttggctgctgcagtacgatttccactttgtctgctgggtcggggcggcgatcttcgtgctggccgccggctggaacgcctggctactgccggcttaccgcatctctaccgtgcgtataccgatgaaggaaggcatgctgcgggtcctgcgcgatcgccgtttcctcacctatgtcctgacgctgaccggttattacatgttagcggtacaggtgatgctgatgatgccgatcgtggtcaacgaaatcgccggttcaccggcggcggtgaaatggatgtatgcgattga

SEQ ID NO: 25456 - DNA, 288 bp, Glycine max
  Peptide Sequence Number=SeqID_117141
atgagtcttcattcttcatctagtgttaatgctgagggttctactcctaaggaccccttgtataagatattagatgatttgagatcccttaagttgtggaaagaaaaacaagagagaaaagaaaaagtagtcataactcttgcaagagcctatgtgaagaacttcgtgactattatgaaggaaggcataggtcacatcttaaacctcactcccataggagagaaaatgaaagaaagcctcaagaggttaacattaaactcccatacttccatgggaaggacaatgtag

SEQ ID NO: 25457 - DNA, 255 bp, Glycine max
  Peptide Sequence Number=SeqID_117142
atgttgaagaacggtcgaaaatcttcacgtaattactcacggaaacgttatggaagcgcctcggcttggattttcttcacgaaaacaattttcctcagcaatttcgagagaataagaagtgccaagaaggctgaccccttctcccttcactcctcccctatttatagcaaaataggggaggagcttgccacccagctcgcccaggcgagcaaggttgcttcctccagaagcaacagaaggcccaagtgggcttga

SEQ ID NO: 25458 - DNA, 144 bp, Glycine max
  Peptide Sequence Number=SeqID_117143
atgaaaaaagctattgaattaactgaacaggcgggtacaaaaggagttcaagtacaaattgcaggacgtatcgacggaaaagaaattgcacgtgttgaatggatcagagaagggatcaaaggtttgggatatttttctaaataa

SEQ ID NO: 25459 - DNA, 360 bp, Glycine max
  Peptide Sequence Number=SeqID_117144
atgattatgaggggccaagacatttatagtagccaagatgaggctactacttcaccttcctctagtaaaagtgaagaagcaaaaggggaagaatctagtgaagagatctacccccaagaagaaggacaacctttaatggttaaggaggagtgtaaggaggtaagtgtctcctcccaaaggttagctaagaaggaaagacattttgaaataaaaacaaatattaaagaaatttcccttcttagagaacctccacattttctcctttgtaaaaagacacttgttagcattgccacatctcttaggcttgagtttaatcctcaagtaaaggagttgttggatggtttggttcacaagagctaa

SEQ ID NO: 25460 - DNA, 110 bp, Glycine max
  Peptide Sequence Number=SeqID_117145
ttctagcttctcatctcaaggaggtgtgcttagctattagagaggaagttttctcaaagaagcttttcaaggaagttttctcaagaaagcttctcaaggaagctacctag

SEQ ID NO: 25461 - DNA, 615 bp, Glycine max
  Peptide Sequence Number=SeqID_117146
atgaccggacgtcttcttgccgggtcattggcttttgaaagtcgcatccttcactatttaattgtgcatattctgcttccacggtcttccaaccttgcccaggtttctgaggaagatctaattatcatgtgggcctttcatacagggcgtcaactcaactgggcacacttagtcagatatcgcatgcataaggcattgcgattaaatgctccactaccatatccacagcttgttactctatttcttcgtcattttgaaattcctcttgattctgaatcttatattccaatcaagagatcctttttaattggtgctgctgcaattgtttcttttggttaccgcaaagagcgtgacggctcttgggtcagaaaggggactcaacccgctaatgaagaaggcaacctcccaaatgaagataattgcactcttcttcgcaggcttatggacaagtttgatggacttcagacttttgttggtgacaagtttgatgccatggaattacaagttgacatgaggttcgatgctatggaatcaaggatcacaagagttgaagaagatgtctctttcatccgaacttgttttgatccaccacctccgcctccttcatcctcttag

SEQ ID NO: 25462 - DNA, 372 bp, Glycine max
  Peptide Sequence Number=SeqID_117147
atggcactttcgtggttggtgaattggtatcagaccaagcaggcgaatgggtctgaggttgcgccatttaaagtggctgtctttttctcaaatgccagacagccattcgatcacgatgcacttgcgatggaccgcattgcatatttggattctgtccaaatgggtaaagtgattgacatacctactgcccatatctggggatcggcggacccacaggctgaagaagcacaacgagctgtgaacttttgtgattcggaaagaagatccatcttcgtgcatgaaaaaggccatgaaattcctagttcagtggaggacacagtatccatagcgaaagtgatcaatcgggccatctaccaagtcgaggggaaatga

SEQ ID NO: 25463 - DNA, 282 bp, Glycine max
  Peptide Sequence Number=SeqID_117148
atgaataaatattttccttcatggcatacatttaaaaccgcactaaaaggcaacgaagagtttatattcacaagaaacattaatgaaaggaagcccaacaaagggggtaagtcccgtggagtcgccaactgtcgcaaccctacccttcggcgggaggggcgacgcgagactcgcgggatgcgtgttccacgaaaggaatacgcgcggagtcgccaccaacgtttatttggggaaaacgtcggaaaaaccggaaaagacgcgatctacgaactttttaagtga

SEQ ID NO: 25464 - DNA, 282 bp, Glycine max
  Peptide Sequence Number=SeqID_117149
atgaccaaattttgtctctgcgtgtcatcgggcccgccgcctctggatgacaaaagggtgcggataaccgtaagtctccaccagaagatgcctacatctccggaaagggcgcagatgaccatattggcctccgcttatcaatcacactcgaggtgcgataaccgtaaggtgtctccgcgggctaccagctcttgggtcatggtaacagaaagcagtgtggtcgacaaaagcgaggcttttgctcctacgtatcctcccaatgaggaactcagacctacgtag

SEQ ID NO: 25465 - DNA, 327 bp, Glycine max
  Peptide Sequence Number=SeqID_117150
atggatgcgaaagagctaccttcacccgtgaactccgatgtcgtcaaacaaatattatgcttagaagctggggcaattaaggatgtcgctgcatgttctttatctttatgcattttctggatttccccccagggatttcctgggcaggatcaccttgggctaccttctggagtagagacaaaacatgaacggcagaaaccaatcaaggtacttaaggacgaatgcgagcggggatggggtcacgaccgaccgatcgttgcccttctctgtgcgaaacaagcagggaatgtcgctgcaaggcagccccgtatcctttgtattttgtag

SEQ ID NO: 25466 - DNA, 1062 bp, Glycine max
  Peptide Sequence Number=SeqID_117151
atgacaacagaagttggcgtgaaaacactgcagagccaatcggtgacgctggacagtgagcttgccggacgtgttacaggaagtatgacggcagacgtgaggccacaggtggatggcatcatcttaaaacgcctgtttaacgaaggtgatgaagtaaaagccggcgaggtactgtaccaaatagatcctgccagttatcaggccagttacgatcaagccgtagcgcagttgaagaatgcgcaggcactggttaaaagcagtaaactgaaagccgaacgttatgccgctttggtaaaagaaaacggcgtgtcgcgtcaggatgcggatgatgcgctggcaacctaccaacaaaacgccgcctcagtcgatcagtatcgcgctacggttgaaagtgcccgcatcaaccttaattacactcaaatcaaagcgccgatcagtgggcgtattggcatttcatcagtgacaccgggtgcgctggtgacggccagccagaccacagcactggcgacgattcgtgcccttgacccgatttatgtcgatctcactcagtccagcgtgcagttgctaaaactgaagcgtcagcaggcttccttgcagcagagtactgacgctgttccggtgacggtgaagctggaagacggcagtaactatgatcatccgggtaagctggaactgactgaagtatcagtggatgaagccacaggtaccgtcacgctgcgcgctattttccccaatcctcaacatgaactgttgcccggcatgtatgtgcgggccagtgtaagcaacggcgtaaaaaacgatgctatcctggcgccgcagcagggcatcacgcgtgatgctaagggcggcgccactgcgcttgtagtcgataaagagaacagggttgaaagccgtgacgtgatagccgatcgcgtaattggcaacaaatggctaattacctcgggacttaacagcggtgacaaactgatcgtggaaggcaccggcaaagtgcagccgggcatgagcgtcaaagcggtagaagtgacgtcagataataaatccgcgaccagcgagggcaactga

SEQ ID NO: 25467 - DNA, 150 bp, Glycine max
  Peptide Sequence Number=SeqID_117152
atggaagatgaggttcattgctcgctggtaggtaactatagcgttattccagaccgaagggcatcacctgccagcaagaatagtccgtccaatagcacccggacaacggaacgctgtatttgcctcgtcctcttcggagatgaaaaaaag

SEQ ID NO: 25468 - DNA, 723 bp, Glycine max
  Peptide Sequence Number=SeqID_117153
gatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctcctgtgcgcgtactccgaaagcgaatcggacgtcggcgggggccccggaacagagttatcttttctgtttaacagcctgcccaccctggaaacggctcagccggaggtagggtccagcggctggaagagcaccgcacgtcgcgtggtgtccgcctctggtcgatggaacaatgtaggcaagggaagtcggcaaaatggatccgtaacctcgggaaacggctcggctctgagggctgggcacggggctcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactg

SEQ ID NO: 25469 - DNA, 333 bp, Glycine max
  Peptide Sequence Number=SeqID_117154
atgaggctcggagtttatgagcagttcaagcaacgagatccttgctggagttttattcagttgctcgactaccttaaactcgctttgttggatgaggcgaaggaactcatgggcctcttccaaagtcaccgtctttccttgaagaccttctttcttttcagcccctcttaccactggaggatctacttctttcgagggggtggctacgtctgtgggctcttggaccatgggcgctttccccttggagggcaactccgcctagtgaggggaagcgaacacccgaccactgcgggttatgccactgaggccggtgatgctggtcaccttagctga

SEQ ID NO: 25470 - DNA, 549 bp, Glycine max
  Peptide Sequence Number=SeqID_117155
atgggaccggacaatgtagaggctaacttagattgggaaataagggtagagcaacaacttaaaatgaagtctacttcaaaatcttatggctctcactcttatccaaagaaagaccaaggtcaagtcatcttaggggtgacatcttctaagcccaaagatgataaggggaaggcaatagaaaagcaagcccctaaggctaaggacacattacttctcagggggggcaccacaaaaaccatgattaggaggggccaagacatttatagtagccaagatgaggctactacttcaccttcctctagtgaaagtgaagaagcaaaaggggaagaatctagtggagaaatctacccccaagaagatggacaaccattagtggttaaagagaagtgtaaggaggtaagtgtctcctccaagaggaataatcaacatgaaaatacagaaaaaggggttcccatgaaccctaagagaataaaggtcattcctgagtggcccgctccaccaagtgtgttaaggaaaaaagcccagcgtttcaagaacctcgggatttga

SEQ ID NO: 25471 - DNA, 255 bp, Glycine max
  Peptide Sequence Number=SeqID_117156
atgcgatcaatctgggcacatgagattcaattgtcctgttttcaaaagaagaatgaaaaatctggggggaggaatttcaaagagaatgaagaagagaaaggatacatcacttgggaagataatgccataaattcttcaagtgatttagagaataaaatcataagtctgggtatcatgatgaaagagtatgaaaacggagaagagcaaagtcgatacattgatagcaatttctccataaacacatggcatgcataa

SEQ ID NO: 25472 - DNA, 189 bp, Glycine max
  Peptide Sequence Number=SeqID_117157
atggggctacgtggggagtacgtgagctcagttggaggtgggcaacaggggatggtggagtggtacctggagatatgtcgtgggggtcaggagaccttggggacgtcaggtggggtgctattgcccaaaaccaagcttgaccaatcccgacccaacccggggcatagtcgggtcagtgagaacctgtga

SEQ ID NO: 25473 - DNA, 288 bp, Glycine max
  Peptide Sequence Number=SeqID_117158
atgggcatgggaacgatgcccaacgttagcctcgtcggttattcctctacaacaacaaacgcaccacttgccttcagatggttgggaggtgaatttcatcacataggcaatgaaaatttacttgattttcatcaaaaattagatgtcatgaaacgcgacgaggtcccttattctggacatgtggaaatgaatatgagacaagtttgttttattggaaagtggaatgacaccaaccgaatagagtcacgagacaatttggaatgcaacaacctatttcgggccgagtaa

SEQ ID NO: 25474 - DNA, 240 bp, Glycine max
  Peptide Sequence Number=SeqID_117159
tgctggatatacgagcactttttgatggtgcatcagtgcgtcgttgatgatgcttatgctgaggcaagcccacgtgcctctaggtggcttacgagtaaggctcatatgagggggatcaagggagccccataccaggcacgtatagaagccctgactgtgatggacgtgtgctggatgccctatcagagcaccggggagttaagggcttcgacctggtctcatcctacacgggccagctaa

SEQ ID NO: 25475 - DNA, 255 bp, Glycine max
  Peptide Sequence Number=SeqID_117160
atggcgcagaagaacgacgttagtctctacgtgctatcaaggcttttagtcttaccagacaaccaaaaagtttatacggatacccactcggacagcaaaaccgtttatacggataaccactcgggtatttccgccggtcagcgtgactcaaaagtcagtatgacagatcttgtgagtgcggaagatgacgtaaatcaccgcgtgtcaacgggcttgtcggccgtgattgacgaagggcgcagaagacgacgttag

SEQ ID NO: 25476 - DNA, 271 bp, Glycine max
  Peptide Sequence Number=SeqID_117161
atgtcattgcctagcgctgttcatgtgtcctccgtcaacaagcgcggagcttctgcaaaaaaagttgtagagacgagaatcgtcatcacggaaagggcaggacggacgaaatcagtgtcttatctttgctttcctcttatctccgatgagagaagattcctccagaaggctgttgcttctggaggaagcaaccttgctcgcctgggcgagctgagcggcaagcttctcccctattttgctataaatggagggagaagtgaagaagaaaagg

SEQ ID NO: 25477 - DNA, 327 bp, Glycine max
  Peptide Sequence Number=SeqID_117162
catacatcccatcgactcgtccaaaatcgtcgtatacaagatgagaggccttccgggcactggcgacatacgcacaggagggttcatgaaacactgtttgatccttccaaacgcttcttgaccatcctcgttctaccggatggtttggaaacctcagacttgcctctcggtacggggttccggcatctcaaggatggccttcaccttttcggggtccacctctatgtagacaaaggatcaagccgatgttttgatgatgccaaaagatcacatgcgtctcaaagctttattcaagacaaagcaattaaagatattcaagatggatga

SEQ ID NO: 25478 - DNA, 210 bp, Glycine max
  Peptide Sequence Number=SeqID_117163
atggactcgggaaggttccaagttagtataccaggtgacagctgccctagtaagactttcttggaagaaatgtatcagcagtttcccatctttgcgtatgcccccatcatccgacaatacatctttagatggttcttggggcaagtagtcccattgtacttgtcaaagtccaacaccttgaacttaggaatgaccatgtttgggtactag

SEQ ID NO: 25479 - DNA, 285 bp, Glycine max
  Peptide Sequence Number=SeqID_117164
atggtgaaagttggaacctcttacgtgccgatcaacgtctcattttcgccaaaagttggccagggcttccccggtatcaacagggacacccaggatttatttattctgcgaagtgatcttccgtcacagggtgctccagtggcttctgttttctatcagctgtcccctcctgttcagctactgacgggggtgggtggggtaacggcaaaaagcacccgccggacatcagcgctggcaagtgtagcggtccccgctgcgcgtaaccaccacacccgccgcgcttaa

SEQ ID NO: 25480 - DNA, 195 bp, Glycine max
  Peptide Sequence Number=SeqID_117165
atgacggtgtcatacaaggattggcatgagatgtttgcctttcgccctacacggatacagaacctcgggacgaacttctactgggggcaacgccgtattccttggtttatggggatggaggcagaggataatggcggagtcggggccctaaaaagagtcagaatggggctcaagtacgctaccgaccaactttaa

SEQ ID NO: 25481 - DNA, 321 bp, Glycine max
  Peptide Sequence Number=SeqID_117166
atgtcaggacttacacgcgattctcctcaaatttcagccagcccacatcaattagactttgcaccttacgcttcgaggtcatacagtgctcgatggaatgccccagggcttctccatgacaagcacacgttgcgttcgagtcgtatcctcggaaaaatggaggttgaggaaccttggttggggttatggctaccattgaattatctagtagatatgggagcaaggatggcctttgtggataactgggtggtaggtaaggagaagggttgttattggctgagtaatgacattgttgggccagtgggaagtttggtcatgtag

SEQ ID NO: 25482 - DNA, 48 bp, Glycine max
  Peptide Sequence Number=SeqID_117167
gcaaggcttgatcttgaagaaatattgaatcaaggctttgtttgttga

SEQ ID NO: 25483 - DNA, 365 bp, Glycine max
  Peptide Sequence Number=SeqID_117168
cgacaagggtatactcaaggaggattttcaggcttccagtagggtccttataataaaaaaggatagtggaggtcacaccctggcaattagttcaacaaagaccagggtaacaatgtcaaatcataaaagcactgagtcagcactgaagaaccttaaggttcaggtggaacaattggccaagcagatagctgataggtcatccaatagttttgtggcaaatatagaaaagaatcccaaggaggaatgtaaagttgtgatgacaaggagtaagaggtttgtggaggttgaggatgaggagagtgttgtgcacaagaagaaagttgttgaaaagaaaggtactgatggcgagaaaaatgatatgagag

SEQ ID NO: 25484 - DNA, 750 bp, Glycine max
  Peptide Sequence Number=SeqID_117169
atggctccgagaaagctttccgcgaaaagatctaggagggacgccgcgactgaagggaccggtgccgctcccgagtttgacagccatcgtttcaggagcgctgagcaccagcaacgtttcgaggccatcaaaggatggtcattccaccgagagagacacgtccaactcagggacgatgagtacgcagattttcaagaagagatagctcgtcgacgttggacgtcgctggtcactcccatggctaagcttggcccacagagaagggcgtacgggacatgcgacgccctcagccagttcttgggagacccgatagtgttagaggagggccaggagtgcgagtttagtcagagaaggaaccgggctgatggatttgacaaggaggccattgcccagctgttatgcataccgggtcaggatttcgcccggaccgctgccgggagacgggtgcggatcatgcgcaccagcatgaccaccttgacccagatgtggatgacgttgcttctcaacaatgtcctgcccagcgatcataactttgacctccctctgccgaagtgtcagttggtgtatgccatcctgacacggatgagcgtccatgtggctcagttgatcgctgacgccatttatttatttgtaggtatgccacctaccagacaccctctagacccggataagtctaacagggccttggggtttccagcattgatcacgggtctctgccagtcattcggggttcccgtcacacctagtaag

SEQ ID NO: 25485 - DNA, 231 bp, Glycine max
  Peptide Sequence Number=SeqID_117170
atggccgagaggagaagaaaacttttgcaagacataacagttgcatccattcttgaggaagaaactcatttctctaattcattatcacctgattcaccatcatcaagggaatccgctactcaattacctgaagccactaccatggcagacgagcagcaccagaggattacccttgaggattattcaagcagctcagtaccacaattatttactagcattgcatatcctgaa

SEQ ID NO: 25486 - DNA, 273 bp, Glycine max
  Peptide Sequence Number=SeqID_117171
atggcaagtcaagaagattgggtcccgtttatggatgtgttagcattgctaatttttgggggtcgtcctctttccaaacgaggtagaacaatcaattggttcccccgatggaaggaaggaaaggagggagtccttttctcgtgtaaagggtacccaaacattccgctaataggaacgaggggttgtattaactacaatcccgcgctcgctataagacaactagggtaccccatgaggggagcaccgatggaagaaagcatgtctcctttcctt

SEQ ID NO: 25487 - DNA, 366 bp, Glycine max
  Peptide Sequence Number=SeqID_117172
atggcccagcacgaatcctcaaggctcggctttcctgccctaatcaatgctttatgtaaagcccggggagtccactctgattccttgacccatgagagattaagtcctgccattaatttggcatatattaagaagaactgttggaatcttgatgatccaatagtaaacttcagaggacctaggaaggccaggggtaagagatctgaggccccttccacttcaacaccatcagaagcaccagcaccttcttcttcaatacccccctcttcatccactcagattccattgattcctcctacaccgatacaaatgccacttccagctcctctttctacaggaccatcagatttcatttttacaccatag

SEQ ID NO: 25488 - DNA, 965 bp, Glycine max
  Peptide Sequence Number=SeqID_117173
atggcgccggcgctggcggccggaaactgtattgtgcttaaaccggcccgcctgacgccgctctcggttttgctgctgatggaaatcgttggcgatcttctgccgccgggcgtgattaacgtggtgaacggcgcgggcggtgagataggcgaatacctggctacctcaaaacgtatcgctaaagtggcgtttaccggctcgacggaagtgggccagcagatcatgcagtacgccacgcagaacatcattccggtgacgctggagctggggggcaaatccccgaatatcttcttcgcggacgtgatggaagaagaggatgccttcttcgataaagccctggagggatttgcgctgtttgcctttaaccagggcgaagtctgtacctgcccaagccgcgcgctggtgcaggagtccatctatgagcgctttatggagcgggccattcgccgcgtcgagtctatccgcagcggtaacccgctcgataacgtcacccagatgggcgcgcaggtctcgcacggacagctggagactatcctcaactacattgatatcggcaagaaagaaggggcggatattctgaccggcggtcgccgtaaagtgctgggtggggatctgcaggaggggtactaccttgagccgacgatcctgttcggtcagaacaacatgcgcgttttccaggaggaaattttcggaccggtgctggccgtgaccaccttcaaaacgatggaggaggcgctggagattgccaacgacacgccatatggtctcgcccgccgcccctctggagccgcaacggtaatctgggcctataaaatgggccggggcatacaggccgggcgcgtatggactaactgctaccacgcctatccggcgcacgcggcgtttgggggatataagcagtcgggcatcgggcgtgaaacccacaagatgatgctggagcattaccagcaacgaaatgtctgctg

SEQ ID NO: 25489 - DNA, 273 bp, Glycine max
  Peptide Sequence Number=SeqID_117174
atgccacaacaacatatgccaagtctctatgaccgaaccacgaagctggaagagactttagctaaattcatgcaagtgtcaatgtctaaccaaaagagcactgagtctgcaattaagaatctggaagtccagctggctgatgaactggcgctggaaccggttgatgatttagttgaacttgaagaaattgttgaggaagcagaaggtgatgaagaaggagagacaccaataagagactgtcaagagaaaacaaagaagaaggaagaaaaataa

SEQ ID NO: 25490 - DNA, 194 bp, Glycine max
  Peptide Sequence Number=SeqID_117175
gtgatgacaaaaagctcaaaggtcaattcaagaagtttaagatgttcaagatgttcaagattgaatcaagaacacttcaaggttcaagaggaaatttgatttcaagaatcaagaatcaagattcaaggttcaaactttcaagaatcaagatcaagattcaagactcaagattcaagaatcaagagaagacttaa

SEQ ID NO: 25491 - DNA, 1326 bp, Glycine max
  Peptide Sequence Number=SeqID_117176
atggtacatctacttgggttgttgactgagaacaagagagggtacatctcttgtggatcagttctagtggagggtacatccactagattgttcaaggagcacaagggagggaatgaaagtgaggctatcaaaactattgttgaaaatgttatgcgtttgttagacaagacagagttgttcattgctgataatccagtcgacgtagaaccacgagtccaggaaatgattgaactaatagaccaaaaacaatcaaatgatgttctactactcgggatgtgggggatgggaggcatcggtaaaatgactattgaaaaagccatttacaataagattggccacaattttgagggagaaagcttcctcgcacatattagggaagtttgggagcaagatgctggtcaagtatatctacaagaacaacttctatttgatatcgaaaaagaaacaaacacaaagatacgtaatgttgaatcaggaaaagttatgttaaaagaacgacttcgccataaaagggtacttcttatacttgatgatgtaaataaattgcatcaattgaatgttttgtgtgaaagtcgtgaatggtttggttcagggagtagaataatcatcacaactagagatatgcatatacttagagggagaagagttgacaaagtgttcagaatgataggaatggatgaagatgaatctattgagctttttagttggcatgcatttaagcaagcaagtccaagagaaaattttattggactttctagaaatatagttgcttattctgcgggattgccactagctcttgaagtccttgggtcctatttgtttgatatggaggttacagagtggaagaatgtattggagaaactcaagaaaattcctaatgatgaagtacaagagaaattaaaaataagctatgatggtttaactgatgatacagagaaaggaatattccttgatatagcttgtttctttataggaatggaccggaatgatgttatacatatcttaaatggttgtgggctttgtgcagaaaatggaatacatgtcttggtagaaagaagccttgtaactgtagattataagaacaagcttagaatgcatgatttgctgcgagacatgggaagagaaatcattcgttcaaaaacaccaatggagcttgaggagcatagtagaaacaggggcagcaaagacaatcaacaagcagacagtgaacacaacagcaagagtaggggtgcacaagcccaaaagaaggatcaccaagcctacatacctcagggattacctctgaagaaaaggacaaagccaacaatgcaatgcaatcttgcttga

SEQ ID NO: 25492 - DNA, 591 bp, Glycine max
  Peptide Sequence Number=SeqID_117177
atggctcgtgaaggggagactgttgttacctctggatcgcatccaacagagaagagacacattgatgataggttgatgaagagggggacaaggagggaccaagggtctattacaaacaatcaaaaaaggaaatggtgggcgttgctgaccagccccgccaagaatcttgaggaccttaagctggaactgccattggcttggaaacccatgggcagtgagagctcttccccttgggtcagtttcttaacaaacacaaaagttgagattgaaggtgagttggaggggcttttaaggcttgaggaggtcctttggaggcagaggttgaaggtggagtggttgatgtatgtggataggaacacaactttctttaatagaaaaatatcccaccgaaagcaagtcaataccataaagaagattcaagatgatgatggaaatgtgtataggaatgtagaggacattggtgaggtattaacaaaaaattgcaagccttgtggaggggagaaattatggagagatgtgatcctttgtggatgtggagttttcaagagtagatgcaccccaccaaagctcctggggaagatggcaatctag

SEQ ID NO: 25493 - DNA, 348 bp, Glycine max
  Peptide Sequence Number=SeqID_117178
atgtttgtgggttgtgttggcaggtcgaggggtgcaaacacgcaaccgctgtgggtcacactgctcagccccgtgatgttggttaccttcgccgacaacgagctgatatcggtggcttcttctcccttttcactcggaggtgtatacctctacgggactgcgtggctgttttggtatggtaaaggaacaggtttagctgccgaggggtatcggggcttttgtgaagctgcgtccttggtgaaatatatcaccaaaggtttaggccttccaaaacttctctcatccacgaactgcatacatatatgctgctcatccctcccctcatcaccgacttccagtcggccttga

SEQ ID NO: 25494 - DNA, 279 bp, Glycine max
  Peptide Sequence Number=SeqID_117179
atggcagcagaatggagaaggaagagagagaggagatgccacttcaaggagaagatgagtctagaagaagctcaccaccataggaggccatggataagagcttggaggaagaaagagatgaatgaagggagaggaagagaagaccacaaaattttgtgctctaaaagagctctaaaatctgaaataagtggacccaaccttgacccatgggctcagaaatttaccctgaggttcatgagaaccctagggtgttggatcaagtggcctcggaataattaa

SEQ ID NO: 25495 - DNA, 171 bp, Glycine max
  Peptide Sequence Number=SeqID_117180
atggaggagatacatatagaggaagcaaaagaatatcacctagatgaagatgctttgataccacatagtgtggctccatgtagagcttgtaggccttggatcttcttcatcaatgaagtcctttgcttcttgaagatcaatggcagcaaaatggagaaggaggaaaggtga

SEQ ID NO: 25496 - DNA, 417 bp, Glycine max
  Peptide Sequence Number=SeqID_117181
atggcctctaccacatgtttgtttcctcatctattattcaccgtgttacaggattgttactgcttaactgttggaacagttgacgaaatcattattgatgctccatggagttatgacagttgtcctaactgtacaacgacatttgatccattaaaaggtggctcagcttgccgttcttgccataccagtgtggtcgatacagttccacggtataaattaaatgttaagatggagcataatggggacaaaggaaacttccttctctgggatgcaacatgtatcaagctgtttggtaaaactgctggagaatgtcgagatgagttgatagcggttggggatgatattaaggaacaatcaagtaagggaaaaggaatagctgttgagccagaaagttcaccaccaatttttgttcccacg

SEQ ID NO: 25497 - DNA, 480 bp, Glycine max
  Peptide Sequence Number=SeqID_117182
atgggatcacccccaaagccttcacttaaaaagaggttctatcaagtcaaaatcaagagcttagaggtcaccagtttacgaaagttggggcaattaatgggtcaacttcaacggcaagccttccgcaaagcctatgcgatcgacgtttttctcgcctatcataaccacaaggaaagtccgattgtcgctatgctagccgacctatatgacaccttcgaccgaagatgtgaagaaagcaatgcaaggattgtttgctgtactccagctctctatgtggggctggtttcacacctttttctccaagaaggtaggcccgtctatccgctacaaggttaccgctcgtgcgtcgaaaaaggaaaggcgaattgggaccaactcttggctagcatgggggggcgtctgttaattggttccctcgctagaaggaaggaagaatcaggattctatcttcatgcgaaggatgtccaaatgttcccttga

SEQ ID NO: 25498 - DNA, 108 bp, Glycine max
  Peptide Sequence Number=SeqID_117183
atgagtaaggtaggaaggtttgaaggtttgggaatggagggacgtcgcaaggaggaagaggttgtgcaggggtttctgaaaaacgtggtggaggcaacctactggtaa

SEQ ID NO: 25499 - DNA, 373 bp, Glycine max
  Peptide Sequence Number=SeqID_117184
atgcaatctgaatttgagatgagtcttgttggagagctgacttattttctgggacttccaagtgaagcagatggaagacaccatattcctctcacagaggggtcactacaagatcaagggagaacattgagatttgtctccggaaaattcatgctttgtctccataaaatgagcccttcaaagaatgtgaaagaggcattgactgatgccagtaaagatgaaggtgtagactttgaaatatgtaaactttcaccagtggacttgagtcctcagattagttacttggtgtcattgtctcagattcaatgctggtatgggtattgtgaagtgctgatggctggaagtgcagatgagcagaaaaagggcacttctg

SEQ ID NO: 25500 - DNA, 153 bp, Glycine max
  Peptide Sequence Number=SeqID_117185
atgggatctgggagatcccacggtcatgtggcttcacattgccaccggactcttggggtcacgggaacaaaaagtgggggtgggccgacaaaaggcagggcttttggctccctacgtattcttcaattttgtgatgaggaacctcaaacctac

SEQ ID NO: 25501 - DNA, 456 bp, Glycine max
  Peptide Sequence Number=SeqID_117186
cacgcctacatacctcgctctgctaatcctgttaccagtggctgctgccagtggcgataagtcgtgtctaccgggttggactcaagacgatagttaccgggataaggcgcagcgcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 25502 - DNA, 849 bp, Glycine max
  Peptide Sequence Number=SeqID_117187
atggccccgaggaaacttgcctcaaagagatccaggaaggataaagcggccgaaggaactagttccgctcccgagtatgataatcaccgctttaggagcgctgaacaccagcagcgctttgaggccatcaagggatggtcatttcttcgggagcgacgcgtccagctcagggatgatgagtataccaatttccaggaggagatagttcgccggcggtgggcatcactggttacccccatggccaagtttgatccagacatagtcctcgaattttatgcccaatgcttggcctacggaggaaggtgtgcgagatatgaggtcttgggtaaggggtcaatggatccgtttgatgcagatgctatcggccagctcctgggatatcctttagtgctggaagagggtcaggagtgcgagtatggccagaggaggaaccggtccgatgggttcgatgaggaggccatcgcccagttggtatgtataccggggcaagattttgcctggactgctgccgggagacgggtgcagatcatgcgcaccaacatgaccaccctgactcagatcttgatgactttgctgctcagcaacatccagcccagcgaccataattccgacctccctctgccgaagtgtcagctggtgtacgccatcctgacgcggatgaacattcacgtggctcagttaatcgctgatgccatctatatatttgcaggtatggcgcctaccaggcaccctctggacccggataagtccaacagggccctgggatttcctgccttgatcacaggactctgccagtcattcggcgtccccgtcgcacctagcaaggtgattcggccacccatcacctga

SEQ ID NO: 25503 - DNA, 336 bp, Glycine max
  Peptide Sequence Number=SeqID_117188
atggatgacgctaatccagttggcaccccgttggaatgtggcagcaagttgagcaagcatgaaaaaggagagaatgagagcctaagtcgctatcaggaagcgtccaaacataaagtggaaagagaatccttacgaagaacatcaaaggtcaatcaaactgttggcttgccaacttactcttcctacgaggacacaaagcaattagtaagcattgtccggcaaagtatagatgatagcgatgagtggagactgagatacgaaagcaagcattggttttgtgttctttatgggagatactgcttcactggagtcaaagaagcaacgaatgtcgactaa

SEQ ID NO: 25504 - DNA, 416 bp, Glycine max
  Peptide Sequence Number=SeqID_117189
aatgtttatacggataaccactcgggtatttccgcccgtcagcatgactcaaaagtcagtatgacagatcttgtaagtgcggaagatgatgtaaatctccgcgtgtcaacgggcttgtcggccgcgattgacgaagggtgcagaatgaccacattggccgctgcttgcccgccgcctctggatgacacaagggtgcggataaccgtaaggtgtctccgcgtgtcatcgggcccgccgcctctggatgacacaagggtgcggataaccgttagggtgcggataaccgtaaggtatctccgcgtgtcatcgggcccgtcgcctctggatgacacaagggtgcggataaccgcaaggtgtctccgcgtgtcatcgggcccgccgcctctggatgacaaaagggtgcggataaccgcaag

SEQ ID NO: 25505 - DNA, 207 bp, Glycine max
  Peptide Sequence Number=SeqID_117190
atggcttgcacccacattccgggccctacaatgcttcttgtccctagtggagtcgccaactgtcgcaacctacccttttgcgggcgagcgaggcgagactcacgagtgcgtcttccaaaggaggaaaatgcgcggagtcgccaccaacgtttatttgtggaaaacgtcggaaaaaccgaaggaaaccggtcatgtgggatcctctag

SEQ ID NO: 25506 - DNA, 150 bp, Glycine max
  Peptide Sequence Number=SeqID_117191
atggggtgcaagacgaaaaggaagaagaaaggagtgaggaaagtctcagcaacaaagagaaaggaaggaggtggaggaggaagcaagaagatagaagataaagatcaagattttaaaaagctaatagcacccagctcaatggaaacttaa

SEQ ID NO: 25507 - DNA, 246 bp, Glycine max
  Peptide Sequence Number=SeqID_117192
atgggtgtgaacgaagatttcaacaaggatattgatgatcatcatcatgagtatgtggatgatgatgatgttcctcttccggggtttcgtttccaccctacagatgaagaacttgttagtttctatcttcgaaggaagcttcacaagaaacccatcagcatcgagctcatcaaacagattgatatttacaaatacgatccttgggatcttccaagcctcgcaatagagaggatcaactttgattag

SEQ ID NO: 25508 - DNA, 498 bp, Glycine max
  Peptide Sequence Number=SeqID_117193
atggctgcgcttcacgtcactgatggagcacttgtggtggtggactgtgttgagggtgtctgtgtccagacagaaactgtgctgagacaggcccttggagaaagggttaagcctgttttggttgttaacaagatggataggtgcttccttgaactccaccttgatgcagaggaggcataccttacatttcagagggttgttgagagtgcaaatgtgatcatggcaacctatgaagatgcagcacttggtgatattcaggtataccctgaaaagggaacagttgctttttctgctggcttgcatggatggggttttacactcaccaactttgccaagatgcatgcttccaagtttggagttgatgaggcaaagatgatgagtaggctttggggtgagaatttcttcgactctgctaccagaaagtggacctacaagcataccgggacttctacgtgcaagcgcggctttgttatgttctgctatgaaccgatcaaacag

SEQ ID NO: 25509 - DNA, 1329 bp, Glycine max
  Peptide Sequence Number=SeqID_117194
atggccgtggttcatggcagttgggtcaagcttgatcaaagaggagaagggcaaggagcgagaagctcacatgctatagccatagtagcacagaaggtgtatgcatttggtggcgaattcgtgccacgtgtccccgttgataacaaacttcacgtgttcgacctagagactttgacttggtccgtggctgatgcatcaggggatgccccaccgccacgtgtcggtgtcacaatggccgtagtgggagaaaccatatatgtctttggtggaagagatggtgaacacaaagagctcaatgagctctattcttttgacacaagggccaacaaatgggccttgatttcaagtggcgatattgggcctcctcaccggagctaccactccatgaccgcagatgaccaacacgtgtatgttttcggtggttgtggggtccacgggaggcttaatgacttgtgggcttttgatgttgttgagaacaagtgggtggagtttccttctcccggtgagaattgcaaggggagaggtgggccgggcttggttgtggctcgagggaaaatatgggttgtgtatggcttcgctggaatggagatggatgatgtgcattgctttgatccagcccagaaaacttgggcccaagttgagactagtgggcaaaagcccaccgcccgcagtgtgttttgcagtttcagtgatgggaaacatataattgtgtatggtggggaaattgatcctagcgaccaaggtcacatgggtgctggtcaattttctggtgaggtttatgcattggacatggagacactagcatggaagaggttggaggataaggtggatttcggtggccatcctgggccccgagggtggtgtgcttttgccagagcttggcggggcggccacgaggggttgttggtgtatggtggcaactctcctagtaatgataggcttgatgacatcttcttccttgctctttctcaagggaaaagtgaaatcaaggcatttgatgattcaaaggttggtgtccaaggactcgtggaaaatggcatccatgatgaccctattttgagagatggtgttttggggaaacttagacatgcatgtgagaagtggggattttttcaggttacaaatcatggaattccaactcatattttggatgagatgatcaaaggaactcgaaggtttcatgaacaagatgccaaggtgaggaaagagtactatacccgtgatatgagcaggaaggttatttatctttccaattttagtctctatcaagatccatctactgattggagggatacacttgcatttttttgggcgcctaatccaccctaa

SEQ ID NO: 25510 - DNA, 1110 bp, Glycine max
  Peptide Sequence Number=SeqID_117195
atggccgttgaggcgcgccatctcaatctctttccctctcaattcatacccaaccgggaagtgatgaattctgttgaggcgaatatgaacatgtacaacaacaccactccgatgggtggttactcttcgtttctgccgttatctggcgccgtcacggagacggtgcttccgtcctcggttttcaacaaccattctctcggtaacgccgtgaaatccgaaagcggcgttacctataacaataacaacaaccaccaccaccaccacattaacaacgttgttatgactcccacgtcgagaaagcgttcccgagataacagcaacaattacggttacaacaacaacatcaacaacgattcattctcgtttctcggccaagacgtttctctccagatccaacagcagcaactcgacatcgagcacttaatcatgcaacgcatggagaaggtgagaatggagattgatgaaaagaggaagaggcaagcgaggaggttcatcgaggctattgaagttggagtgatgaagaagctgaaggcgaaggaagaggaaatagagaaaatcggaaaactgaattgggcgttggaagagaaagtgaagcatctttgcatggagaatcaggtgtggcgcaacttagcggaagcgaacgaagccacggcaaatgctctacgctgcaatttggagcaagttttggcgcagtgtggcggaatcgcggcggaggaagaccgcggcggcgcaaccgtgtgcggcggcgcggagatggacgacgcggagtcctgctgcgggagcacagaggaggactgcgaaggaaagaaagtggggtggcgcacgttagcggggtgcgcaggggtgaaggataaggacgaggggggtgagagtagtaatgttgttttgtgcattggatgttgttacgacctcaaatctgaaaagcacgtcagggtcttgagagattgtccgattaaggttgattggattgaaattgatttcaattttctgaagagtttcactattgtagatgaaaaaaagcacataatttcccgaatggagaaactgggaaagaggaaggggcgcgtggggacagaaagggacaggtctgcggcaaaagctgacacgtag

SEQ ID NO: 25511 - DNA, 207 bp, Glycine max
  Peptide Sequence Number=SeqID_117196
atgaatcaccaacaacaatctcctgcagtgactgcatatccagcaggggctcagagcaacctagcagctccaccaccacctgtaggttatcccactaaggatgatcttccttcccaacaaaatgttcctgtcaaaaccactaccaggggtgatggcttctggaagggatggtcagttaatttatatccaaaatcttacttcgtctaa

SEQ ID NO: 25512 - DNA, 483 bp, Glycine max
  Peptide Sequence Number=SeqID_117197
atggttaggaaaaaggtcttcatctccgccgtcgtggcctcagtcgtggcaaaactatgttgtgggtcatatgcgtccaatcagaggttccatttctcttccttctttcgcaccgaagttccaatcgtcgttgttagggtttttcctcgtcgttggagagagatgtgttggattcgtgatgacaaccctatccctggccgcgccctttgcctttgcccatatgtcttctacttccttgatcatcgtagaagagaagaaatgctaggtgtcgttgggacttcaatggcagtgaccgaagctcagaatcctcttcttgtagaaaacacatgtggttccttgttaaaaaagcttcagcttgttgacccatttatagcactctttttcgacattttcttatcagatgaaattcatgggtaccacgtgaaatatgtagatcctatttctcatttggggtctcagtccaaactagtgagacctacatga

SEQ ID NO: 25513 - DNA, 519 bp, Glycine max
  Peptide Sequence Number=SeqID_117198
atgaaatccgacagagagaaggagaaagagaaagagaaagatcgctgcatcagttctcatatgcagacccttcatcgccgtcttctccacgccttaaaccttggcaccaggtctcaacttgcaccccccaccccacccaagaccacggtgtcccccaacccattggtcagagaattatctgctcgcggtgtgtggctgctgctgtcacaagagaattttgcacatgacattttgatgaaaagacttgtagatggaagtggcagtgtgccaacattgaagtgcagacaaatgtgctacgatcaattggagcctgttgccaatattttgggagcgcactattatggattcttcaatgcaaaaggagaagaaacagtgaagaagctgaaaattcttgctaagcgctgcaaactacagcctctcttgcaaatgctttatagacagcgtccaaagtggggtacacctttccccagcattaatcttacttcatctcttggtatagcttcttataaaatatcttga

SEQ ID NO: 25514 - DNA, 1410 bp, Glycine max
  Peptide Sequence Number=SeqID_117199
atgagattcaagggaagcatcactcacatcacactcttaagcaaatcctcttccatctggaagcagctaccttcaacaaaggtggctccttctgtgcccactaacatcccatcttacttaggtctcaggctcctcaaggcagctctaaatgtgggtgatttcaggcgtgcccaaaaactgtatgataatattacccaaccagaccccgccacttgttccacattaatttcagctttcaccacccgtggacttccaaatgagtccataagactctatgctttgctccgggcacgagggatcgaaacccacagctcggtgtttttggccattgccaaggcctgtggtgcctctggtgatgccttgagagtcaaggaggttcatgcctatgggaagtgtaaatacatcgaaggggcaaggcaggcttttgatgatttagttgcaaggcctgactgtatttcgcgaaatggggtgaagccgaatttggtgtctgtgtctagcattttgcccgcgtgctcggttttgaaagatttgaagtctggaagggctattcatggaattgcagtgagacatgagatgatggaaaatgtgtttgtttgcagtgcacttgtgaacctgtatgcaagatgtttaaatgaagctacatggaatgctgttattgggggctgcatggaaaatgggcaaacagagaaggcagtggagatgcttagcaagatgcaaaatatgggatttaaacctaatcagatcacaattagtagtttcttaccagcttgctctattttagaaagcttgaggatgggcaaggagatacactgctatgtctttaggcattggttaattggggacttaacaaccatgacagcgctagtatacatgtatgctaaatgtggtgacttgaatctttcaaggaatgtctttgatatgatactcagaaaggatgttgttgcttggaacacgatgatcattgcaaatgcaatgcacgggaatggaaaagaagtgcttttggtctttgagagcatgcttcagtcagggatcaagcccaattcagtcacttttactggtgttttgtctggttgtagccactcaaggctagtagaagaaggactccacatatttaattcaatgagtagggatcatcaagtagaacctgatgctaatcactatgcatgcatggttgatgtcttcagtcgtgctggtcggcttgacgaggcatacgagtttatacagaaaatgcctatggagccaactgccagtgcttggggagcacttcttggtgcctgtagagtttataagaatctggagttggcaaaaatttcagccaataaactctttgaaattgagcccaacaaccctggaaactatgttttattattcaacatccttgtcactgccaaattgtggagtgaagcttaa

SEQ ID NO: 25515 - DNA, 2541 bp, Glycine max
  Peptide Sequence Number=SeqID_117200
atgggtaagaagcctgaatcaaacacaggaggcagagcatcacacaaagagttgaacaaggtcgtgagtggaccaagaagtgctggtgttattggtgaacggggatcaagagaaaattctacttctgaatggtcacaaagggaagatagtattaactggtatgatcagaatgcttatgatagtgaaggttctacagatggcaaaagatggtcatcacagcctcattcttccctagcccatttacatgattcaaagcccttgtacagaacatcttcttatcccgagcagcaaaggcaggagcaacactaccacctccaacattgctctagtgaaccagttcctaactggtttgatcagcatatttacgacacagaaactgctcatgatcatgatggcaaacgatggtcatcacagccacattcctctgttgcgcatttacaagaatcaaagcccttgtacagaacatcttcatatcctgaaaaacaacaggagcttcctcgtttttctagtgaaccaattttggtaccaaagtcttcattcacttcttatcctccccctggtggtctatctcagctgggttctccaagccatagtacaggacacttgaacattccttatcatactggagcagctcagatggtgctatcatctcaaaatcgttctcatttctctaattctgcactacagccgagtgcattaaatcttgggtcacattttggtgtaagcacacgccaatttcctactggttcccatcataatcagcgaatacagaatcaattggtcaaccaggcagggttgtatcctggagatcattcaaatctccttaataatatgttacagcaacaattacaccttcataatggatcagtagctcctcacttgatgactcaattacaacaacagcagcatagactgcatcatcctggtcagcgatctgcaggctacttatcaggcttccagtctcatttattcaatccccgcccttcctctggctcatctgtaatcagcaaatatgaacatatgcatggaattaccgatggtagagatcataaaccaaaatcaactcataaaggtaaacacagtcttcgtttttccctacatggttctgatgccagtagccaaaagagtgacagtggttcatttcagtttcggtccaagtatatgacaagtgatgaaatagagagcattcttagaatgcaacatgctgtgactcatagtaatgacccatatgtagatgactattaccaccaagcttgtctggcaaaaaaacctaatgtggctaagttaaaacatccattttgcccaagccaaataagggaatatcctccacgatcccgtgctaatactgagccacattcatttgttcagattgatgccctagggagggtttcattttcttctattcgctgtcctcgccctcttcttgaggttgaccctccaaacacttctagctctgatcaaaagatttcagagaagcctcttgagcaggaacctaggtttgctgctagagtcacaattgaggatggtctttgtcttcttcttgatgtggatgatattgatcgttacctacagtttaatcagccacaagatggtggaacacatttaagacgaagaaggcaagtcctgttggaaggactagcaacttcacttcaacttgttgacccactgggaaagaatggacacaaagttgggcttgctgctaaggatgatcttgttttcattcggttggtatctcttcccaagggacgtaagctccttgcaaagtatcttcagttgcttcctcctggaagtgagcttatgaggatagtctgcatgaccgtatttcgtcatttaagattcttatttggtggtctcccctcagatccggcagctttagagactacaaataaccttgccaaggttgtttgccaatgtgtccgaggaatggatcttggtgctcttagtgcctgccttgctgcagttgtttgttctgcagagcagcctcctctacgccccattggaagcacctctggagatggtgcttcccttgttttaatatccgttcttgagagggctactgaagttctaactgatccacatgctgcttgcaacttcaatatgggtaatcgttcattttggcaggcctcatttgatgaattttttggccttctcactaagtattgcatgaataaatatcatagtatcatgcaatccatgcttatacaaagtacctccaatgtggatgacattggaccagatgctgccaaatctattggtagagaaatgcctgtcgaactcttgcgtgctagcctccctcacactgacgagcaccagaggaagttattgctggattttgctcaacgttctgttcctgtggtaggatttaacagcaacactgggggtagtggcggtcatgttgatgatcacaccgatgtcgtaaggacaaccttggatctgttcaagtacatctggagaaaaatcttaaatgtggagagtgcgagttgccgagttgcatctatgatggaggcttctgcctcacccttaattgtctacttgtcataa

SEQ ID NO: 25516 - DNA, 1224 bp, Glycine max
  Peptide Sequence Number=SeqID_117201
atggcttccgagaacgtaagcaccgatacggtgtcgaaagccgtcgacgctctcctgaaatggcgtcgctcccaatctgaaaccctaaaaccaaaactcttcgacgaagacgaggaatatgtgtacctgatcctgacgctgaagaagatcccttcaaaatcccgcgtgaaccctcacaagatccctctcccccactccctcttctcccctttctccgagcagtgcctcatcctcgacgaccgcccaaacaaggcccgcgtcaccaaagcccaggcccaagcccgcatccagtcggaatccatccccgtcaataaaatcctcaagctctccaagctcgcctccgactaccgccccttcgaggccaagcggaagctctgcgactcctacgatctctttttcgctgagaagagcattgtgccgctccttccgcggcttctcgggaagagtttcttcaagaagaggaagattccggtgccggtggatttgaagaaggggaactggaaggagcaggtggagaaggcatgttcgtccgcgatgctgttcatgaggactgggacctgcagtgttgttagggttgccaaggtgaggatggagagggatgagattgttgagaatgtcgttgccgcgattgaaggcgctgtggaggttgtcccgaagaagtgggggaatgtgaggtccttgcatttgaagctgctggagagcctggcgctgccggtgtaccagacggttccggatgtgaaattgaagattgatggatttaaagtcgaggagggggcgacgacgacgacgaagaagaagaatgaaacgaaggagaaggacagtgagggtgaggttagtgattcgaagaagaagaaggggaggattcatgaggttaggtacatggatgagattgaagatcaattggccagcgatgatagtgaagatgagatggtgagtaagaagaggaagaaaggaggttcgagtgagttgagtggtgttgagcaattgaagaagttggtgtttaatgagttgactgccaaggggaagaagaagaagaagggcttgtctgttgggggggttaagggagatgcgattgaggggagtggaagtgagttggttgttaaggatcaagagtcaggagtgaagaagaagaagaagaagcgagaggaagtgaaggcaaaggctactaaaagtgtaaaggctacgaaaggtgtgaaggctaagaaaattaagaaggctgcgtga

SEQ ID NO: 25517 - DNA, 90 bp, Glycine max
  Peptide Sequence Number=SeqID_117202
atgtttggggaagaatctattaacagcaaggaaaccatgagtagcgccgcctttaaggtcggtgtgttggggagtggaagattttattga

SEQ ID NO: 25518 - DNA, 159 bp, Glycine max
  Peptide Sequence Number=SeqID_117203
atggaaagcgaggctagggttcatggagggtgcgcctatgatctcgaagttgcagagatggagagtgacgttggggttcaaaggatcttcaaagtgaggcttagtgttcgggcgagttcagtttcatacggatgcaattccaactacccgaatcaatga

SEQ ID NO: 25519 - DNA, 204 bp, Glycine max
  Peptide Sequence Number=SeqID_117204
atggttcccccacatgtgaatgaaaatagacttgaatgtgagagaaaggagttggctgaaacaaggagggggttggggcagatcaagagggagaatcaacataagagtaaagaatgccaagaagcttggaactccttaaaagagcttcaaaatgagctaatgcagaagaccatgcatgtaggatctttggctttgtggaagtaa

SEQ ID NO: 25520 - DNA, 349 bp, Glycine max
  Peptide Sequence Number=SeqID_117205
atggtcgaaacagccttggtctcccacgagcggcaacacccactccccaaaaccgccgacccgcgtgtccaaatcgctggcaacttcgcccccgtgccggagcacccggcgcatcagtccctcccggtgaccggaaaaatccccaaatgcattgagggcgtctacgtccgcaacggcgcgaacccactctacgagcccgtcgctgggcaccacttcttcgacggcgacggcatggtccacgccgtgaagttccactcgggcgccgccagctacgcctgccgcttcaccgaaacccaacgcctctcccaagaaaaaagcctcggccgccacgtgttccccaaagccatcg

SEQ ID NO: 25521 - DNA, 400 bp, Glycine max
  Peptide Sequence Number=SeqID_117206
atgggaacaattctgtcacattcagcctatgcggcggttcacatgatcaatgaggcggcagcgacgagaccgactacgacagatccggcggcggcgaatccattcgagacggcggcattctcggacggtgcgggagcatcggacggaggggaagagatcgatgaaggagaagacgccggtactaaagaaggaggagatggcggagagatcccgccggaaggtgaaggtgtcggagaaacagcgggtggagacttggacgaagaaggcgagggagtggcggctttcggtggagtagcaggggactcaggagacgacgccggagattgtgcgacgccggagaagacgaaaatcgccgcgagcagaagaacgagtgcggaagaggaagaagtcattctcagag

SEQ ID NO: 25522 - DNA, 1674 bp, Glycine max
  Peptide Sequence Number=SeqID_117207
atggagagctatgcactccactctctctcaacctctttctctcgcttttctcaactccatcaccctcctccccctgtcatctccagatcccaattcaaccaatctcaatctctctctctccgatcacccatcacaatctcccaacgtttctccttcccctcctccaccttcaaattcaaccctttctcaaaaccccattaccctattcaagcttctccttcatcaccaccaccaccaccaccaccaacacctatacagggtgcaaagcccattccttttatcatctccatatccatcggcctcattgttcgctttttggttcccaaacccgtccaagtcacccccgaggcctggcagctcctctccatattcctctccaccatcgcgggccttgtgctgagcccgttgccggtcggggcgtgggcctttctgggcctcacggcctccgttgtgaccaaaactctcacctttacagaggccttcggcgccttcacgaacgaggtgatttggctgattgtgatttcgttcttctttgctcgcggattcgtgaagaccgggctcggggatagaatcgctactttcttcgtgaagtggatgggaaagagcactctgggtctgtcttatgggctcacgttcagtgaagtgctgattgcgccggcaatgcctagcaccaccgcgagggctggtggtgtgttcttgccgattattaagtcactctcactctctgctggcagtgaacccgccagtcccacttctaagaaactcggggcttacctcattcagaaccaatttcagtctgctggtaactctagtgctcttttcctaactgctgcagctcaaaatctgctgtgtctcaaattagcagaggagcttggggtgatagttccaaacccatgggttacttggtttaaagcagctagtttacctgccattgtttgtcttcttcttacgccattgattttgtacaagctctatccccctgtaatcaaagacacaccagaggctcctgccctggctgccaagaaactggaaagtatgggccctgtcactaaaaatgaatggattatggtcggcacaatgcttcttgcagtgtctttgtggatctttggagacactattggcatagcaagtgctgtagctgcaatgattggtttatcaatactactcctattaggagtccttgactggaatgactgtttgaatgaaaaatcagcatgggataccttagcttggtttgccattctggtaggcatggcaagccagttgacaaaccttggaattgtgagctggatgtctgattgtgtggccgacaaccttcggtcattctctttgagctggccggcctcattggctgttcttcaggcagcttatttcttcatccactacctttttgcaagtcagactggacacgtgggggctttatactctgcatttcttgccatgcatagggcagctggtgttcctggtattctggcagcccttgctttaggttataatacaaatctttttggtgcaataacacactatagtagcggccaggctgctgtatactatggagctggttatgtagaccttccggatatcttcaaaatgggcttcatcatggcttttattaatgctatcatctggggaggtgttggttctgtctggtggaaatttttgggattgtattga

SEQ ID NO: 25523 - DNA, 300 bp, Glycine max
  Peptide Sequence Number=SeqID_117208
atggtaaataacccaagtattaggatttcacactggaggtcagagtttcaagaaagtcattatctttcttctttgtctgcatggcttgttggaattctcagtaaagttccttctgtggcagcaaatatgccaaaaagagttttgcttgaacttctttgtagatgccttctaacatcacaactctgcaacaagcagcttgtggattcaacacttcagcttgcagaactgatagatgaaagatacttggtggacaaagttcaaaagttctttattgacttcaaagaacattttccaagttga

SEQ ID NO: 25524 - DNA, 261 bp, Glycine max
  Peptide Sequence Number=SeqID_117209
atgatagagcaacaatacatgaagccatggggagcagcagaaaataagtgttgccaagctttctttggaacacaagtaaaaactggtgctgatagttcaattactattgcttcagtcctatacttgtcagacttaacccaaggtagcactgtccgtcaatacaacagtctctggtcctttattaagcaggaagaactggatagaaccaccaatgatgaagatctgttaaacagatggccacttcctacactcaagaggtaa

SEQ ID NO: 25525 - DNA, 207 bp, Glycine max
  Peptide Sequence Number=SeqID_117210
atgggggattctaatggaaaggtgatgatgccagaagtctggcaggtacaggtaagcgtacttggcagtggattttgggattaccacgccaggggaggctgggatgggaacgtgcaccggtgtcctctggatatgattgttatactacaccacgtttctccccgcttgaactcctcctcgcgctggataattatggagataatgtag

SEQ ID NO: 25526 - DNA, 1827 bp, Glycine max
  Peptide Sequence Number=SeqID_117211
atgagcttgttgaatgaggagagaaaaccgcacgctgtggttactccatatccagttcaaggacatgtgaaccctttgtttaaactagcgaagctgcttcatctcagaggctttcacataacctttgttcacactgagtacaactacaagcgtttgctcaagtcaaggggtcctaatgcccttgatggcctaccagattttagatttgagagcatcccagatggtcttccgccattggatgatgataatgttactcagcacgttccctctctctgtgactctatcagaaaaaacttcctcaaacccttttgcaaacttgttcatagacttaaccactcttctgccactgagggtctcatacccccagttacttgtttggtctctgacggttgcatgccttttactatacaagctgctcaagagcttggactccctaactttatcttttggcctgctagtgcctgttctttcttgtctatcatcaactttcccactctggttgagaaaggtcttacaccactcaaagatgagagttatctgacaaatgggtatttggactccaaagtggactggattcctggaatgaagaacttccggctgaaggacatacctgacttcataaggacaacggatctaaatgatgtgatgttgcaatttttcattgaagttgcaaatagaattcaaagaaacactactattcttttcaacacttttgatggacttgagagtgatgtaatgaatgctctatcctctatgttcccttctctttatcccattggtcctttccctttacttttaaatcaaagtccacaaagccacttgacatctttaggttccaatctttggaatgaagatctagagtgtcttgaatggctagaatctaaggaatctcgatccgttgtttatgtgaattttggcagcatcactgttatgtctgcagaacaactcttggagtttgcttggggtttggccaatagcaagaaaccctttttgtggatcattaggcctgaccttgtcattggtggatccgtgattttgtcgtctgagtttgtcagtgaaacaagagacagaagcctaatagcaagttggtgtccacaggaacaagtgctaaaccatccttcaattggtgtattcttgactcattgtggatggaactcaactactgaaagtgtttgtgctggagtgccaatgttgtgttggccattttttgcagaacagccaacaaactgtagatacatttgcaatgagtgggaaattgggatggaaattgataccagtgcgaagagagaggaggtggagaagctagtgaatgaattgatggtgggagagaagggaaagaagatgagagaaaaggtcatggagttaaagaggaaggcagaggaggtcaccaagcctggtggttgttcatacatgaacttggacaaaaattttctgcattgtagaaatggtgccctggaagtgccactttgtgttttgtttattgtggccgaggacggagaggctggagggggaggagcggcaggcggacatggcaacgcgctttttccagtgggagcacacaaaaaaacttccacccaaacaaaaaggttttatttttatgagcacacaaaaaaaattgttgaaaacgttttgattttttacatgccggtgttgttgccaataactcacttgtcgtcgtcaccactgtcgctggtggtgccgtttcggaaacgccggtggccaagagcggctattattgggatctcgttgcaagctgtgaagatgatggtgtcgatgctgtcgctaatatcattgtcaacagagcagtttcgagtggttgaaggctaa

SEQ ID NO: 25527 - DNA, 279 bp, Glycine max
  Peptide Sequence Number=SeqID_117212
atgcaaaccaaaatacaacaatacaatacaaaaacatgtggagaaggattcagtaacctcgaaggtgatcaagaagaccaaaggaacaacggccaaataagacaaaagcaccacaacagcaaccacggaccaccacgaaaacaggaacaagaagcactgccgaagaaaagaggaacaacagccactaatgctggagaacaaaggaagaagaagcaccaaagaaaaaaggaagaagaagtagttcctaagaagaagaaagggcacaggagaggagaatga

SEQ ID NO: 25528 - DNA, 960 bp, Glycine max
  Peptide Sequence Number=SeqID_117213
atgttgccgaaactctcaaaatgcatcagcttcaccgcttcgcgggactggctgtaccgtcatttgttcgccgccgcggggctccgctcggtggccaccgacctcggcgaaggaaccatcgtgcattgctgggtacccaaaatgcacaagccatgcaagccaagcctcgtactcattcacggtttcggcgccaacgccatgtggcaatacggggaacacattcgtctcttcatggggcacttcaacgtgtacgtgccggacctcgtgttcttcggcgagtccttcacgttaagggctgagaggagcgagtactttcaggctgagtgcatggtgaagatgatggaggctcatggggttcacaaaatgagcttggtggggatcagctatggtgggtttgtagggtaccgtgtggctgctcacttccctgacgtggtggagaagattgttctttgttgtgctggggtttgcttggaggaggttgacatggaaaatgggttgtttagggtttcaaatttggatgaggcttccagcattttgttgccacagacaccggacaagctcagggaattgatgaagttgtcctttgtcaggcctgccaggggtgttcctacttggttccttcaagatttcattcaagtgatgtgtacagactacattgaacagaagagagaattgcttgaggcaatactaaaaggtcggcatctttccgatcttcctaaaatccaacagaattcgaacccaccatctattcctccatctcttcactctttaccaccaacccactctaattttatggggagagcaagatcagatattccctctggagttaggacacagattaaaaaggcatataggggaaaatgctcaaatggcagtcatcaagaatgcagggcatgcagtgaacctagaaaaggccaaagagtttggcaagcacttgaaagcattccttatagattctaa

SEQ ID NO: 25529 - DNA, 2733 bp, Glycine max
  Peptide Sequence Number=SeqID_117214
atgtgggtgttcttttcatatattcagcaattacaatttgaagcccagcatcgatggttgcgacctgcagaaatttgtgaaattcttcgtaattatcggatgtttcatatcacatcagagcctcataacaggccaccaagtatggttactgcatgtggttcactttttctttttgatcgaaaagttttgagatactttagaaaggatgggcataattggagaaagaaaaaggatggaaaaactgtgaaagaagctcatgaaaagttgaagattggaagtgttgatgtgttgcactgctactatgcccatggagaagaaaatgaaaattttcaaaggcgaagctactggatgcttgaaccggatatgatgcacatagtatttgtccattacttggaagttaagggtaacaaaaatattgtagtaaatactgaaggtgatgagatcccatcagattcccaaaaggtaacttcttcatcgtctagccttcccacacatcatagcagtgttccttctctgagtacagattccgtgagcccaacaaccagtttgatgtctttacgtgaagatgctgattctgaggatatccaccaagcaagttctgggttgcgcccattatatgagtcacaacatagtgggaatggtccattgacggaaaagattggtgctggttcgaacagttcatatcttattcatcccttttcaggtgattatgaacagtcatcaatttctggaacggattatatccctgttgttcatggggataaatttagaggaaatgatactgcttatattgatggtcagaaaacacatgacgtggcaacatggagcactgtcttgcaaagcactgccaaattgcataatgatccttctcttgcatcatctccttccattccatctagttcaatgggagatgtccttgaacaagaacataccatttttagtgaccttttaatgagcaaaagtggtctcactgaggtagcagagagctctcagtctctccaatcaaattggcagattccttttgaagacaattcaggaggcatgccaatgttaacccaaacccagacatttggtctgcaatttagatctgattatggcaccggtttactagggaatgaaactcgtaatgcatgttctgaaagtgctgcgatcctgtacagttttaatggtgaaccaaaagagcagcctatgcagcaaaactatctacaagagcttgaagatggacaatctcaacatgcactaaaatccaattctgcaaataaagttcctgatgaagaaactatcaactatggcttaacagtgaagcgcacattattggacaaagacgagagcctgaagaaggttgatagcttctctcggtggattactaaggaacttggagaggtggctgatttgaatatgcagtcctcacctggtatttcatggagtacagatgaatgccagcatgtgatagatgatacctcattgagcccatctctctctcaagatcaactgtttagtataaatgatttttcacctaaatgggcttatgctgagtccgaaattgaggtgttgattattggatcatttttgaagagtcaaccagaggtgacaacctgcaactggtcctgtatgtttggggaagttgagattcccgccaaggtcttagctgatggaattttgtgctgtcaagctccgcgtcataaggttggacgggtccctttctatgtgacatgttccaataggttagcttgtagtgaagtgcgggaattcgatttcagagagggctttgccagaaatgtagattttgcagatttttataacagttctgaaattctgcttcatttgcgactagaggattttctttctttaaagccagtggacccttcaaatcattcttttgagggtgatatggagaaaagaaacttgatttttcagctcatttcactgagagaggtggaggaatattcaattaaggatgaagtgactacagaattggatatatcccaacacatggtgaaggagcatctgtttcacaagcagtttaaagagaagctgtactcatggcttcttcacaaagtaactgagagtggtaaagggccaaatgtattagatgaggatgggcaaggtgtgctacatttagcagcttttcttggctatgattgggccataaatccaattatatctgctggagttaatatcaacttccgagatgtgaatggatggacagctcttcattgggctgcatcctgtggcagagagcgcacagttgctgtccttgtctccatgggtgcagattgtggagcattgacagatccatctccctcatctccagcaggtagaacagctgcagatcttgcctctagctatgggcacaaaggaatttctggttttcttgccgagtcttcattaactcaccacctcgaaaccctcacaatggatgatcaaaaaggtggtcggcaagaaatttcaggaatgaaagcggtgcagacagtttcagaacgatctgcaacacccgtgcactttggtgatatgccagatctctgcctcaaggattcgcttactgctgtgcgtaatgcaacacaagctgctgatcgtatacatcaagtatacagaatgcagtcattccagaggaagcagttaactcagtatgaaagtgatgagcttggattgtcagatcagcaagcactttcccttctagcttccagagcatgcaaatctggacaaggagatggtttagccaatgctgctgca

SEQ ID NO: 25530 - DNA, 657 bp, Glycine max
  Peptide Sequence Number=SeqID_117215
atggagtatctttatttatttttaaagttgggaattgacgacgtcatttatgatggagatgctagtggtgaagctggtggtgctgagccattgagaggtgatggaggtttgcaacaacaaactcgaatgcaagatcatgtgcttgaggtactccttgcaaatgtcgaggagtgcgaggatgtcgtgctgcatagggagttggcccttgttgacaatggaggttgtgagaggtgcttcgtgtccgtgctaataatgtcttcttctctttcaattccgattccatttccgatcgcaatggattctgcgtcgtctttgacggtgacacagatagcgcttttcaaacctctgaagcagaagcatcatttcgtcagaggcagagtcagtgttattagaccacttcatcgccgcctcaactccgtttcgcctccgcggtgctcttccgccgtggactgtggacagccgcaagtgttatctgctcatgtaaatttgacatccgagacagcaaccgtttcccttgtgcctgaacaaaaaactgcaccagatggtctaaagcaattgggggaggaacttgcacagcatttaactacatgtggttttacttctacccttcgagttttatgcaatatagagagaagtgccaaatgggtgtttttgtaa

SEQ ID NO: 25531 - DNA, 2529 bp, Glycine max
  Peptide Sequence Number=SeqID_117216
atggccgaggagatcaatggcggaacgtccatggactccaccgaatcgcggtgggttatccaggacgaggacgaggacgcgtcggatttggagaacttcgacgctgatttgagatttagacgccacgctggcgtggtggattccgaggacgaagatgataacgcggaacagagactcattcgcactggtcctcgcatcgattccttcgacgtcgaggctcttgaagttcccggtgctgctcatagaactgactatgaggacatcagtgtgggtaagaaaattgtattggcttttcagacacttggtgttgtctttggtgatgtgggaacaagtccattatatacgttcagtgttatgtttagaaaggcccctattaatggaaatgaagacattcttggagctttatcacttgtcttgtacactttaatcttgattcctttagtgaagtacgtcctggtggttctgtgggccaatgatgacggtgaaggtggtacttttgccttgtactccttgatctgtcgtcatgctaaggtgagtcttctccccaatcagttaccatccgatgcccgtatatcaagctttaggctgaaggtgccatcccctgagcttgaaaggtcattaaaaatcaaggaaagacttgagaattctctgactctgaagaagactctactatttttcgttcttgctggtacttctatggttattgctaatggtgttgttacaccagcgatgtcagtactgtcatctgttggtggtttaaaagttggggtagatgcaatcaagaaagatgaagtggtgatgatttcagttgcctgccttatcattttgttcagtgtacaaaagtatggaacaagtaaaatgggacttgcagtaggacctgctttgttcttatggttttgttctcttgcgggcatcgggatatataatcttgtcaaatatgacagtagtgtcttgagggcatttaatccgattcacatctactatttcttcaagaggaactcaactaaagcatggtattctctaggtggttgccttctgagtgcaactggttctgaggccatgtttgcagatctttgctacttttctgtacgttcagttcagctttcatttgtctttcttgttttgccgtgcctactattgggttatttgggtcaagctgcataccttatggaaaaccatgctgatgctggtcaagcctttttttcttctgttccaagtggtgcattctggccaactttccttattgctaacattgcggcacttattgcgagtcgggctatgacaacagcaacattttcatgtataaagcaatcaactgcacttggttgtttccctcgtcttaaaatcattcatacttctcggaaatttatgggccagatctatatccctgtgataaactggttcctcttggctctttccctggtgcttgtctgcactatatctagcattgacgagattggaaatgcctatggcattgctgagcttggggtgatgatgatgaccactattttagcaacccttgtcatgcttcttatatggcagatacacatcatcattgtgctgagttttgtggtagtcttcttgggattggaattaacttttttttcatctgtcctgtggagtgtgactgatggaagttggattatattggtctttgctataataatgtttcttataatgtatgtatggaattatggaagcaatctcaagtacgaaactgaagtcaagcaaaggctgtcgacggatttgatgcaagaattaggttgtaatctagggacaatccgggctcctgggattggtttgctttataatgagttggtcaaaggaataccggcaatttttggccattttctgaccacacttcctgcaatacactccatgattatatttgtgagtatcaagtatgttcctgttcctatggtgccacaaagtgaaaggttcctttttcggcgagtctgccccaaaagctaccatatatttcgttgtattgccaggtatggttacaaagatgttcggaaagaaaatcaccagacttttgagcagctgctgattgagagcctagagaagtttatacgtcgtgaggctcaggagaggtcactggagagtgatggggatggtgatactggttcagaggatgagtaccctaattctagggttctcatagctcccaatgggagcgtttactcacttggtgttcctcttcttgctggttttaaggatacaagcaaccccgttttagaagaaagcacattagacgtgataagcccggtatccactgatcccctggtgtttgatgctgagcagagccttgagagtgagttatcttttattcataaggctaaagaatctggtgttgtgtatcttcttggtcatggggatataagagcaaggaaggagtcgtggtttatcaagaagttagttataaactatttttatgcctttttgagaaagaactgcagaagggggatcacaactttaagtgtaccacactcacatttgatgcaagttagcatgacatacatggtttga

SEQ ID NO: 25532 - DNA, 699 bp, Glycine max
  Peptide Sequence Number=SeqID_117217
atgggtgaacttcttagagcttctgcggaggcactgggtcatggaatcttgggaaatagttataaggctatgctgaatgatggatctaccattgtagtaaagaggctaagggacttaaaaccactctctaaggaggaatttgcaaagatactaaacgtgattgctgatatgaagcacccaaatttgttgtcattgcttgcttattatcattctagagacgagaagctcatgctctacagatatgcagagaatggaaatcttttctcccggcttcatgtgcaaatcattattcctattttaaaaaaagaacaaaaggaaaaaaggttaaggaggtggaaaccgagttccattcagttggaactcaagattgtgagttgcaagaggagtggcacgagcattggtgtacctgcagctcaaccacaacaacatcgtcccacacggcaacttgcggtcttccaacgaagacgacacagttcttgtttcagacttcggcctagcctccttgatagcacaaccgattgcagctcagcacatggttgtttacaagtcacccgaatgtttggagctacgctccacaagggagcagtgagggaagaatggactgctgagatatttgacaaagagatttgtggccaaaagagtgcacttgctgggatgctgatgctgttgcagattgcaatgcgttgcattgagaggtga

SEQ ID NO: 25533 - DNA, 1974 bp, Glycine max
  Peptide Sequence Number=SeqID_117218
atgagtcagcatgttagtgacgaggttgtggcaaaggacatgggggaaataagaagtgggccttcttcacgtaggcatggagatactttgccacatattcacaaggtgggaactcctccaaagcagacacttttccaagagatcaaacattctgtggtagacactttcttcccagacaaaccctttgaacaatttaaggaccaaaccggcggtagaaagtttctcttaggcctgcaatctctcttccccctttttgaatggggaagagattacaatcttaaaaaattcagaggtgatttcatttctggactcaccattgcaagtctatgtatccctcaggacattgcatacgcaaagcttgcaaatttggaaccccaatatgcactatacaccagctttgtgtgtcctcttgtgtatgctttcatgggaagctcaagagatattgccatcgggcccgtagctgtggtgtccctcttgcttgggactatgctaaccgatgagatcagtgacttcaaaagtcatgaatacctgcgtcttgcatttactgctaccttcttcgcaggagtcactcaaatggcacttggtgttctcaggcttggtttcttgattgactttttgtctcatgctgccattgtgggattcatggctggagctgcgattactattgcactgcaacagcttaagggttttcttggcataaaagcgttcaccaagaaaactgatattgtttctgtcctgcgctcggttttcaatgaagcacaccacgggtggaattgggaaacaatagtcattggagtagcattcttggttttccttcttataaccaagtatattgctaaaaagaataagaaactcttttgggtggctgcaatttctcctatgatctctgttatagtgtctaccttttttgtctacattaccagggcagacaagaaaggcgtggcaattgtgagacatgttaagaagggtgtgaatccatcatctgctagtgagatttttttcagtggaaaatatctaggccctggtattcgggttggtgtggtagctggtatggtagcactcacggaagctgtagcaattgggagaacatttgctgccatgaaagactattcactggatggtaacaaagaaatgatggcaatgggaacaatgaacattattggttcactaacatcttgttatgtggctacaggatctttttctcgctcagcagtgaactacatggctggttgtaaaactgctgtatcaaacatagttatgtccattgttgtgttattaacactgctactcattactccactctttaagtacactccaaatgcggttcttgcatctattataatagcagcggtgcttggccttgtgaacattgaagcagttattctgctgtggaagattgacaaattcgattttgttgcttgcatgggagccttctttggcgtgatcttcataagtgttgagattggccttctaatcgcggtggctatatcttttgccaaaatcctcttacaagtgacaaggccaagaactgcagtactaggaaaacttccagggactactgtttataggaacatcctgcaataccccaaagcaacccaaattaatggcatgctgattataagggttgactctgcaatctacttctcaaactccaactatatcaaggagagaattttgagatggctggccgatgaagccgcccaaaggacaaatggatcgtcaagaatagagtatgccattgttgaaatgtcacctgttactgatattgacactagtggcatccatgcttttgaagagttatacaagacccttcagaaaagaaaaatacagcttatcttggcaaaccccgggccaattgtaatggagaagctccacgcatcaaagttagcagacttaattggggaagataaaatatttctaacagtggctgatgcagtttctacttttggtccaaagggtgaagcagtagtatga

SEQ ID NO: 25534 - DNA, 102 bp, Glycine max
  Peptide Sequence Number=SeqID_117219
gtgaaatcctttaatggtgttgatatgatgactaaggcattactaagagggaagtttgaagcttgctatgagatttccggtttggcggtcacctccgcatag

SEQ ID NO: 25535 - DNA, 234 bp, Glycine max
  Peptide Sequence Number=SeqID_117220
atggatgcagtcctaagctctaagtcatctaccaataatcaaagaaaaaagcaattagagggtaagaaaaggaagctaacctcgacgccgaaaatgcaagtgaaaatggagaagacaaaaatggataagacgaaagggaggaacgagcaagaagatgttgcagaagaagtgttgggtgcaccagcaatagtgctgggtgcacctagcaacacccctaatacaaaggcttcatga

SEQ ID NO: 25536 - DNA, 513 bp, Glycine max
  Peptide Sequence Number=SeqID_117221
atggccgcgataataaccggtcaggccgttgcgatcgatttccggcttgctgcggtaaccgtcgaggtaatcgtcgaaggcggtgaagtaggtttcggtggagatgcggttattgtccggatcgatggtgatcaggcgtattgcgccgttgccgccgttattgccgcgcgactcgatgccgttgccggtgatttcgcgggatacgccgttctggtagttgaccaggaactggaagaccggctcgccatactggttgtaggtgatgtcggtttctgcgccatcgccgaagatatgaccggagaaggtcatgacgatgttcggataacgggacaacaagacgcgggcgacatattcgccgtcgtttgcgccgcgctggtcggtgcgcataccgtaatcgtagccggcgccttcgtcatagagcggcaaggccagattgtcctgacggccggcatagctcgtcagcgaatgcgttgcgagcatcacgcgatggtcgggaaacttctcgatcacatc

SEQ ID NO: 25537 - DNA, 246 bp, Glycine max
  Peptide Sequence Number=SeqID_117222
atgtatagatctcccacaggcaatttagttcctctggacttggagattgaagctacgttaagaaggaacggagccgagaggagaagaaaattattgcaagacaggacaatgataacaaaagatgatgacaaaggtgatgacaaaaagctcaaaggtcaatcaaagaaagagatcaagatttcaagaataaagattcaagagatcaagattcaagactcaagattcaagaatcaagagaaggcttaa

SEQ ID NO: 25538 - DNA, 315 bp, Glycine max
  Peptide Sequence Number=SeqID_117223
tgcaagaaaatgaactgcattttatggaaaacgcaatgaactcggcgttctcggaagaactcgctaagcgcacctaccgcgctaagcgagttcatcctttgaggatgaacactcattgtcgcaacgtgcccttttgcgggcgggcgaaggcgaggctcacgggtgcgctttccaaaggaggaaagatgcgcggagtcgccaccaacgaaggtattagcacctttcacgtcgacaaaagcggggctcttgctcctacgtaccctccatcgaaaaggaaatcaaacctacgtagttcttccttattttacttgaaag

SEQ ID NO: 25539 - DNA, 330 bp, Glycine max
  Peptide Sequence Number=SeqID_117224
atgggtagtgaatggacaaagctaagcgagtgcttagtgctaagcccaaagacctctctgcattttaattctttggaattgggcttagcgcgaatgctcgttgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaactttttagtgaaaaggttcgggagttgtatttacgcacggggaaggtattagcaccccacacgtccgtcccaagggacggcagcctttaa

SEQ ID NO: 25540 - DNA, 333 bp, Glycine max
  Peptide Sequence Number=SeqID_117225
atggggatcgcacccacaaagacacccagtggacctgaagaaggcgctcgtccccccagcagctcatgccatcatgacataggtaaggattgtgcccgcaagacacctagtggacccgaagaaggccaacagtgtcttggagttgccagctctaaatacgggtctctatcagttcaagggagtgcctgttgcccccagcagggtcatcaggcccccctaccaatcgagttttcatctagaagtgatgcgtctccaggcaggcgcagggcgaaacaccatagcagcctggggatggccggcagcgggcaacagacgcaccgccatcacctctag

SEQ ID NO: 25541 - DNA, 1081 bp, Glycine max
  Peptide Sequence Number=SeqID_117226
atgggaacaaatcaaaccggcaagaggttctaccaagtcaaggtcaaaagcccagataccaccagcatcaaggaattagggcggttgatggaacccctccaaatgcaagccttccgcaagacttacggaaagatcttagagttgaccatagcagaggtgtccatagaagccattgcatcacttacccaatactacgaccagcctttgagatgcttcacattcggggacttccaattagtaccaaccattgaagaatttgaggagattctaggatgtcctctcgggggaagaaaaccatatctttcctccgggtgtctcccctctttgagcagaattgcaactgtggtcaaggattccgcaagaggtttggaccgcataaaacagactcggaacggcatagcgggcctaccacagaagtacctagaagacaaagcgaggggtatggccaatcaaggagaatgggtcccgtttatggatgtgttagctttgctaatttttggggtcgtcctctttccaaacgtggatggtttggtaggcctagcagcaatcgacgctttccttgcctaccaccatagcaaggaaagtccggtggtagctgtcttggcagatctatttgacacatttgaccgaaggtgcgagaagagtagtgcacgggatcatctgttgcttaccccgccctctgtgtttgaggagaatggattgggaccagctcttggccgggataggaggggttgtattaattacaatcccatgctcgctataaggcaactagggtaccccatgaggggagcaccgacggaagaaagcatgtctcctttccttgtgagggatctcggcgcacagaattccaagactatacaaagaatccataaggcatgggaaaccccgttaaggaaagatcaagagcttagaggcattcgtaatggcatcattggtgagtaccacgaatggctgaaaattcgcatacgaggtttagattggctcgccaagttaaaagtcgtcagcgaagagaattttgaagcaccggaagaggacgaagaagtccaagctctcaaaagcgagttaggaaaggcaaaactcg

SEQ ID NO: 25542 - DNA, 303 bp, Glycine max
  Peptide Sequence Number=SeqID_117227
atggttaccagacacccacggagaggcacattacagcacttgaattggttctataagcgatacaggtctcaacggggctattttacaaataatatctcacggatttattggcgctgcgctttttttcttggcgggaacgagtatgatagactacgtcttctttatctcgacgaaatgggtggaatggctatcccaatgccaaaaatattcacggttttcactatctatcgatggcttctcttgcattgccggcatgagcggttttgttgcagaattgatagtcttattgggaataattactag

SEQ ID NO: 25543 - DNA, 204 bp, Glycine max
  Peptide Sequence Number=SeqID_117228
atggatgcaactgttatgtcttgcagaagtttccttctcctctcgaccctgttccttcacaatgtagctttgatttctaagtccagaggaactaaattgcctgtgggagatctatgcatatacactactaacagaacaacggttatccagtttaacaagaaaagacagataggaattaagaacaaatattcacaaaaacaataa

SEQ ID NO: 25544 - DNA, 159 bp, Glycine max
  Peptide Sequence Number=SeqID_117229
atgaaaattcaattgcttatgaactcgctaacgagcttgctcgctaagccagtgctttcaggtagagtagttgcactatgcgcgccttgctgcgctaagcgcaaatccttctctgttttgaaaatttgtggagttgggcttagtgagcctactcgctaa

SEQ ID NO: 25545 - DNA, 292 bp, Glycine max
  Peptide Sequence Number=SeqID_117230
atggaatttgctatacagctcatcattatcttaatttgtctgttctacggcgcgaaaaagggtggcattgcgctcggccttttaggcggcattggcttagttatcttagtttttgtctttcatcttaaaccaggaaaaccgccggttgatgtcatgctggtgattatcgcggtggtggccgcctcggcgacgctacaggcatccggcggtttagacgtgatgctgcagattgccgagaagctcctgcggcgcaaccccaaatacgtttctatcgttgcgccattcgtcacct

SEQ ID NO: 25546 - DNA, 387 bp, Glycine max
  Peptide Sequence Number=SeqID_117231
atggctcagaaaaagctttccgagaagagatctaggagggacgccgcggctgaagggactagtgccgctcccgagtttgatagccactgtttcaggagcgccgagcatcagcagcgtttcgaggccatcaaaggatggtcgttccaccgagagagacgcgtccaactcaggaatgatgagtacaccgactttcaggaagagatagctcgccagcgttggacgtcgttggtcactcccatggctaagtttgacccagatatagtcctagaattttatgctaatgcttggcccacagaagagggagtgcgggacatgcgatcatgggtaaggggtcagtggatcccctttgacgcagatgccctcagccagttcctggggacccgctag

SEQ ID NO: 25547 - DNA, 312 bp, Glycine max
  Peptide Sequence Number=SeqID_117232
atggggtcttttatcgcgggaacccaatctggatatctggggcgaaacgaatttgggtgtcaaggtgtcggtctcgggccgaacttccacatcattccacaaggcacgcgtgacaatgatgatttgaaaacaacgtgcaaaattagtcatggctacagccaggtgggcactcaagcatcccgtttatggcattgtgatactacggttgggaatttacacagacagacccaatgtttccaaattatgttctttcatcagttcaatgaattcatccattcttatctcggttcattccggaaaataaactcttag

SEQ ID NO: 25548 - DNA, 480 bp, Glycine max
  Peptide Sequence Number=SeqID_117233
atgccaatctccccctgcagatgtatcggttgggatcgcgcccacaagtcgcccagcgggcccgaagtagtcctacagggtgcccgtttcccccggcaaggtcacgtcatcatagggatcgcgcctgcaaaacacccagtggacccgaagaagtccaacaggttctacggagtgcctgtcacctccagcaagggcattaggccccctactaatcgagctttcatcagaagtactgcgtctccaggcaggcgcagggcgaaacaccacagcagcctggggatggccggcagcggcaacagacgcaccgccatcacctctagagttcacctcagctcatccgcaaaaaggttagagcgttgcctacgacacatggccgaccagcaggcgaccaagtccaaagccaaaggtaagcaaagtactaggtccatgacctacaagccatcatgcgtccagctcaagacgttaaagaagcgctactag

SEQ ID NO: 25549 - DNA, 507 bp, Glycine max
  Peptide Sequence Number=SeqID_117234
atggggatgaggggttgcattaattacaatcccgtcctcgccataagacaacttggctaccctatgagaggggcaccattagaggaaggcctcacagcttttattgcgcgaggtttcaatagcaccaatgcgggggtgcttcagagggtccgcaaggcatgggaaatggtgcaaaagaaggacgaggaacttaggggaagtagccatgggcccatcggtggttaccataggtgcttgaaagcctacgcacaaggtctcgattggctcccgaatttgagaaccactaaagaggtggagggtgaagctccagaagaagacaaagaggtacaagccctcaaaacaaagcttgagaaagcccaaatagccaaagaaaagttcaagtcaacagctattaggatccgaaaagagaacgccaaactgagagacgtcaacatagccaccaccaaggccttggagcaagagaccaagagggcccacaaggaagaacatggctggaacaagttctga

SEQ ID NO: 25550 - DNA, 1000 bp, Glycine max
  Peptide Sequence Number=SeqID_117235
atgggagggcggcgcggggctgtctacgcttcggcccacttcgactacgagcgatgtcggctttggcctcatcgagtgacgttttccatgcaaaagcgcgccttcccttgccgcaatcattgccgcctgatcagccgcccgctgcgcgtggccattgccgttgcgatggccatggcagtggccagccatgcccatgccgtcgacggtgaaccactgcagttcagcgcagggttcctgattggcggcaaggccatcgacatgcagcgctatgcgcagggcaatccgatggagccaggtgactatccgctggacgtggtggtgaacgggcagttcctggagaaccgcgacatccgctttgtcgaggcaccggcgccggtgggtgccacgccctgcctgccgatggcgctgctgggccgcttgaatctgaaggacagctacctggccgatctgcaggaagatgcagagggctgcattgcattgcctgcgcttgtggaaggcgccaccgtggaattcgatgcaggcaacctgcagttgcttgtgaacgtgccgcaggccgcacaggcgcgcaatgcacgcggctacgtggcaccggaccagcgcgaccatggcgttaccgctgcgttcttcgactacaacgtcaaccacaaccgtgcccaaggccaggatgcgacctatctgggcttgaacacgggcctgaacctgggggcctggcgcctgcgccaccgttcgtccttcagccagagcagccatggcacccgccacgatgtgatcagcagttacctgcaacgcgatcttccggtctgtaacagccagctgttgctggggcagggcaataccgggggcgagttgtttgaatcgctgtcgttcaccggcgcgcgcgtggccagcgatgaacgcttgctgcccgattccctgcgcggggttcgcgccggtggtgcagggcattgccgagggcaatgcgctggtgaccatccgccagaacggcaacatcatctacgag

SEQ ID NO: 25551 - DNA, 276 bp, Glycine max
  Peptide Sequence Number=SeqID_117236
atgtccccagtggagtcaccaactgtcgcaacgtgcccttttgcgggcgggcgacgcgtgactcgcgggatgcgtgttccacgaaaggaatacgcgcggagtcgccaccaacatttatttgaggaaaacgtcggaaaaaccgaaggaaaaccggtcaaaaagaaaattctaagttcgggagttgtatttacgcttgaggaaggtgatcattttaaggcgttggaccttgaaaatgatccattttacttagtaagaaacagaaatgataaactttga

SEQ ID NO: 25552 - DNA, 249 bp, Glycine max
  Peptide Sequence Number=SeqID_117237
atggagaaggaagataattggagacacctcttaaaggagaagatgagtcaagaagaagctcaccaccataggaagaatcttctcaaggaagcttctcaaggaggtgagcttagttatgagagggcatcctctccaagcttcttatccaaggctcatcttggtggtgaagctccttcttccatggcttattccctagtggatggcgcctcctctcacctcttctcctttgtctttcgctgcatctccatg

SEQ ID NO: 25553 - DNA, 615 bp, Glycine max
  Peptide Sequence Number=SeqID_117238
atgggtgaagtagaggaggtacaagagaagatgaaggccgacatggaggccatcaaagagaaaatggccacaatgatggaggccatgatgagcgtgaagaagataatggaagccaatgcggttgcaattgccgctaccagcgttgttgctaaggtgaacccgacgtccccatccggcctcaagcaaatgaatcatccaacctcaaatatggtaggcaaagatttaggaagtacgggcggcccccatgatgtgcaaattcaaaacgagcacgccttcccgtcatatggcttgcctctcaactatacgccacccaatgtggcgtacactcccaataagaatgtcaataactccactcctatacccattgaaagccagcaaccccaaactgatcatgcacatgaatgggaaaagttggatcatctagaggaaaggctcagggccattgaaggaggtgaagattatgcctttgctaacctagaagagttgttcctaatacccaaacatggtcattcccaagttcaaggtgccggactttggcaagtacaaggggactactcgctccaagaaccatctaaagatgtactgtcggaagatgggggcatacgcaaaagatga

SEQ ID NO: 25554 - DNA, 462 bp, Glycine max
  Peptide Sequence Number=SeqID_117239
atgttgagtcaacatcccaatattttaaacaacattgactctgtgaagaagagagaatctcctctatccctgcattacaaactgtttgaggggacacatgtcccagacattgtcttgacatcagggaaagctgctgcttcaggtgctgtgtccaaggatgatttgattgctgaactcaaggacacatgcaaggtgctagaggcaatcatcaaagccaacacagagaagataataatagctggaacgcctgatcaaaagactctcagacatatggcgtttgatgatggagaagcagctgaggaagaagaagatgcagcagaggatacaaaatcagatgatgatgattctgatgccacccccatgaccatcagacctttaatactgctgtgcttgattactctgataatgaaagttgctgatcccacttgcatgactgctcgtacctgctcaggaagtgtctaa

SEQ ID NO: 25555 - DNA, 174 bp, Glycine max
  Peptide Sequence Number=SeqID_117240
atgcgtgaagatgcagaaaaagcaagaatgcacgaagttgggtgtgagagaaaatgcagcaaatttcgatcctgccgcttagcggatgatgcaatcctaccccgaagggcattggatagaagactccaagaagattgggccaaagatgcaagagaatgccctagggtctcatga

SEQ ID NO: 25556 - DNA, 510 bp, Glycine max
  Peptide Sequence Number=SeqID_117241
atgagaggactacacctcctcgccatcagagggctgcacgccctcacctctagaggactacacatcctcgccttgagagggctgcacgccctcaccattagagggctacgtgtcctcattttcaatgtgctccacatccacaccttaagagaatttaagggatcgcacccacaaagacacccagtggacctgaagaagtccaacagggccctagggtttccagctctggttacgggcctctatcagccctatagggcgcccgtccccccagcaagctcatgccatcatgacatagggatcgtgcccgcaagacacctagtggactcgaagaaggccaacagggtcttggagttgccagctctaaatacgggtctctatcagttcaagggagtgcctgttgcccccagcagggtcatcaggccccctaccaatcgagctttcatcaagaagtgttgcgcccccaggcaggcgcagggcgaaacaccacagcagcattgggatggccggtag

SEQ ID NO: 25557 - DNA, 644 bp, Glycine max
  Peptide Sequence Number=SeqID_117242
ttgagtatgtgaaaagattgtatgaccaagtgaaggtgcaaattgcaaagaagaatgaaagctatgtcaagcaagcccacaagaaaaggaaggaagtgggaatgatgagaatcatgaaactggccaaatacaggctaaaggcccaagtggagaaggacgaaggcccaagtggagaaggacaaagcccccgagtggagaaggatgaaggctcaagtaatccttgtggcgtctaccctgacttatcttccttcactggaagtggcgtctacccagacttatcttccttcaccagaagtggcgtctaccctgacttatcttccttcaccggaagtggcgtcatccaaaaactctacacctgtatcaaacaatccgctcctactcagatttcagactcactagtgatttctccatcagccttcatgatcatggtcctcctggttggacattcagaagcaatatgtcctctgcctaagcacttgaaacattttatgtttctggttccagtattggatgaggaagtggaggtgttatgtttgcttccacctacactgggcgttgctgactttccatgcggggatgtggctgcaggtcggaacgaattacctccctccatcttggatctgttggcccagttttggttgtaa

SEQ ID NO: 25558 - DNA, 315 bp, Glycine max
  Peptide Sequence Number=SeqID_117243
atggctacctgtaaatctgtcaatgttaatcccatgaactatatgtcaccgctattcactttacaacacattttgcacgtctacgacaactcctttggtttagtgccacataaatcaatgtggcaagaatatgaaggagataagtggggtcctaatccaaggagaaagaggactgcaaagggtcgtctcgtttcaccaggtgtttctagtgagatggacggaaacgaaaataaacggaaaagtagaaaaaaaatgttgaatttccggcaacatggccataacaaaaacaattgtcctaacatattttcatcttaa

SEQ ID NO: 25559 - DNA, 615 bp, Glycine max
  Peptide Sequence Number=SeqID_117244
atgtcagttctagaattgtacatagaaaaggatgtggctggtggttcaatgtttcattctgcaaattcccttacatcatgtggaaattatgtatctaatgattacacacaaccgccaacaaatatgagcaatttaaatcttgacgaagatgatgatcatgatgatgatgattatcttgtgtctaactcatacgttgaagagtcgttagacgaagatgatagtgttgacggtatatcagatacagacgatgaagtccccgacattcctcaaccagtaagaattgttcacccagcagaaggtgcacaacgaattgaaaatccattttggaatgatgctttacattataacaatatcaactggagttatcctgatgaggaggacatttgtggtttggagatgccgtcgacctttaatgttggccaagaattatatgttggcatggaatttgatagtaaagatgcggtcaagaatgcactcaaacaatatgttatgaaggtgcatcaaagtttcaaagttgttgaaagcaaatcgaacaaatacgtggaaagtcacacaatggggtggaccacacacatgtctgaatatgaccatgacacaagatcacgagaaacttga

SEQ ID NO: 25560 - DNA, 261 bp, Glycine max
  Peptide Sequence Number=SeqID_117245
atggctactccacctgcctcgcctcctcctcctcctccacctcctcctcctgcagacgcatcaacgtctccatttacgttgaagtggacacgcaaggcgacacgactacgatcattggccactagaccacctagggtagaaagacctgtggtcaacatcgatcctactaccggcaaggccgacagtccccacaagaagaaattaagaacatatttggggattgtcactcgtgataaggtcgacgtgacatatgacacctag

SEQ ID NO: 25561 - DNA, 315 bp, Glycine max
  Peptide Sequence Number=SeqID_117246
atgaagaacaaaaagaatggacctcaacatcagggaaaaccatactcgacccctcctaagcaatatggtaaccgccccaacaatcagaggactgttgctatggggtttgcgggtggtagtggtagcaaacccaatactttccccactcagatcattttttacaaatgtgacaaaaggggcatatttagagagattgtccatatcccaagaaggagcataatggtgggggccagaatgaccaaactggacatccgaaggccacgggaaaagtctttacccttaatggtgccgaagcttcaaaatccaaagatctaa

SEQ ID NO: 25562 - DNA, 198 bp, Glycine max
  Peptide Sequence Number=SeqID_117247
atggcagaacaagctaaacaagtttttatgttcaagacctatgtgatgaaaggcaaatggctaccccacccagctctccttctcctcctcctcctcctcctcctactgattgttgctcgtgataagctcgatgtcacatatgagaattggaagcaagtccctgctgctcagaaggatttgatatgggaggatatttag

SEQ ID NO: 25563 - DNA, 507 bp, Glycine max
  Peptide Sequence Number=SeqID_117248
atggaaggatttttagtgtctggaaaatatgttgcattgcaaatttgtgatgacgaagatgttgaaaccatgctcgaaagttttcaacaacaagatcaaatgtcagttctggaattgtacatagaaaaggatgtgagcaatttacatggtgatgaagatgatgatgatgatgatgattatcttgtgtctaactcatacgttgaagagtctttagaaaaagatgataatattgacggtatatctaatacagacgatgacgatgaagtcaccgacatgattcaaccagtaagaattgttcacccagtagaaggtgtacaaggaattcaaaatccattttggaatgatgctttgcattataacaatatcaactggagtcatcctgatgaagaggacatttgtggtttggagatgccatcgagttttaatgttggccaaaaattatatgttggcatggattttgatagtaatgatgcggtcaaaaatgtagtcaaacaatatgttatgaag

SEQ ID NO: 25564 - DNA, 135 bp, Glycine max
  Peptide Sequence Number=SeqID_117249
atgggtggtaaatggccagaggttgaaactgtaccatggtggagacctgtgctaagcgctcaaacccctgcatctcaaggtgattggctcgctaagctggccatgggcaagcttagcccaattcaatatgattag

SEQ ID NO: 25565 - DNA, 417 bp, Glycine max
  Peptide Sequence Number=SeqID_117250
atgaaggcccaagtggagaaagatgaaggcccagaggcagaggcactatcaagacaattaatgttgctgaaggcccaaactaatttgaaggcccaaacttatcaaggtaatccttgtggcgtctgcctagacttatcttccttcactggaagtggcgtctaccctgacttatcttccttcaccggaagtggcgtctaccctgacttatcttccttcattggaagtggcgtctacccagacttatcttcctctcttggaagtggcgtctacccagacttatcttccttaaccggaagtggcgtctacccagacttatcttccttcactggaagtggcgtctaccatgacttatcttccttcactggaagtggcgtcatccaaaccttcgtagcctgtatcaaacgatccgccccgtaa

SEQ ID NO: 25566 - DNA, 863 bp, Glycine max
  Peptide Sequence Number=SeqID_117251
gaaccattccaacttctttggctaatctctgcaacttaagggagataggtttatcatatctcaaactcaaccaacaggttaatgaacttttagaaattcttgctccttgtatttcccatggactcacaacacttgcagttcggagttcacaactttcaggcaatctgacagatcaaattggggcttttaaaaatattgacatgctagatttttccaacaacttaattggtggtgctcttccaagatcatttgtaaaactttcatcattaagatatctctatctgtctattaataaattcagtggaaatccatttgaaagtattggatcactactctctaaattgtcatctctgcgtattgatggcaataattttcaaggagttgtcaaggaagatgatcttgcaaatcttaagagcttgaaggagtttcatgcatcagggaacaatttcactttaaaagttggttccaattggcttcctagttttcagcttacctatttggatgtgggatcatggcagttaggtcccagctttccatcgtggattcagtcacaaaaaaaacttaaatatttaggcatgtctaacacagggattattgattctattcctacacagatgtgggaagcacaatctcaggttttgtatttaaaccactctcataatcatatccatggtgagcttgtgactacattaaaaaatccaatatctatcccaactgttgatctaagcacaaatcacttatgtggtaaattaccctatctttcaaatgatgtgtatgggttagacctttcacgtgaatcattgaaaactacaatctattgtatcctgaatgaaagaccatttgcagaattaccctcctcttaa

SEQ ID NO: 25567 - DNA, 330 bp, Glycine max
  Peptide Sequence Number=SeqID_117252
atggcatattttgttgggagggttgaaagaagcactacgaggataccatggctgaacagagagccttatgcttactggaaaggtaatccagctgttgctgaaaccagacaagatctcatgaaatgcaatgtttatgaaaatcaagattggaatgctcgtttatttgcccagataataacagaatttgaggataacagaatttgggaaaagcactatctctgtcccctaactaactgcagtgcactaatgctgtcgcggctaaacctaatccctgaggtgagtgggtctgtagtgtggagaagaaatcagcttgttgctccaattgattaa

SEQ ID NO: 25568 - DNA, 382 bp, Glycine max
  Peptide Sequence Number=SeqID_117253
ggcacatcttagacctcactcccattggagagaaaaggaaagaaagcctcaagaggctaacattaacctcccatacttccatgggaaggacaatgtagaggctaacttagattgggaaatatgggtagagcaacaacttaaaaggaagtctacttcaaaatcttatggctctcactcttatccaaagaaagaccaagacatttatagtagccaagatgaggctactacttcaccttcctctagtgaaagtgaagaagcaaaaggacacttgctagcattgccacaccaagggcttgagtttattcctcaagtaaaggagttgttggatgagggccttcatggaagcttgcttgtggagcttctatggaggctagatctttga

SEQ ID NO: 25569 - DNA, 351 bp, Glycine max
  Peptide Sequence Number=SeqID_117254
atgtctcttggaaattattttctgaaaatcccctctggtaatcaattacaagacttatgtaatcaattacaggatggacccttgggtactagtaccctcgtctccagaggactatacgtcctcgccttgagaggactacacgtcctcaccatcagagggctgcacgccttcacctccagaggactacatgtcctcgccttgagagggctacacgccctcaccttgggtactagttaccctcaccgtcagaggactacacgtcctcaccaccagagggctgcacgccctcacctccagaggactatacgtcctcgccttgagagggatacacgccctcaccttgggtactag

SEQ ID NO: 25570 - DNA, 540 bp, Glycine max
  Peptide Sequence Number=SeqID_117255
gctcataagaaccctagggccttctcttgcatctttggcccaatctacttggagttttctatccaatgcccttgcgggggtgagacactgcctacctattccagatttacgaggatgaggattgatcctcaagagtttgcttcccgtctctgcatccctggtaggggttttgttctgaatgcagggggccatccttggaagcttctgaggaaagatctcaccactcttgcacagacatggagtgtcctctcctacaacaacctgactcccacttctcacacctctgatcttaatatggacagagacaggttggtttacggcttagtcacaggcatggacgtgaatatcagagccctaatctcaggtcagatttctaccattgccaagagtaactcttttaggctcggatttccagccttgatcactgccttatacagagctcgaggagttacctctgacagtctgacctatgagagcctgagcccgaccattaacttggcctacattaagaaaaattgttggaatgtggatgatctgaca

SEQ ID NO: 25571 - DNA, 402 bp, Glycine max
  Peptide Sequence Number=SeqID_117256
atggttaaggaggagtgtaaggaggtaagtgtctcctccaagaggttagctaagaaggaaagacattttgaaataaagacaaatattaaagaaatttcccttcttagacaacctccacattttctcctttgtaaaaagacacttgttagcattgccacatctcttaggcttgagtttattcctcaagtaaaggagttgttggatgagggtttggttcgcaagagattaaatccttgtgctttgttggtgcccaaaatagtttcaatacaaactttaggcacacatatgggacaccttaggggtcccatgaaccctaagagaataaaggtcattcctgagtggcccgctccaccaagtgtgttgaggaaaaaagcccagcgtttcaagaacctcgggatttga

SEQ ID NO: 25572 - DNA, 453 bp, Glycine max
  Peptide Sequence Number=SeqID_117257
atggcagatcgttattttctcgctgggcatgtacctcgtggtctatggctgcgcaatgcaggactcacggagtacctgtctggtgtgctgaatctgctggcagacaaggggttatgggcagcgacgttcggcaccggcttcctgacggcatgtctctcatcagtgatgaacaatatgccgacggtgctgattggcgcgctgtcgattgacggtagtacggcgactagcgtcgtcaaagaggcaatgatttatgccaatgtgattggctgtgatttaggcccgaaaatcaccccgataggcagtctggcaaccctgctgtggctgcatgtgcttgcccagaaaaatatgacgatcacctggggatattacttccgcaccggcattatcatgactctgcccgtgctgtttatcactctggccgcgctggcgttgcggctctccatcactttgtaa

SEQ ID NO: 25573 - DNA, 225 bp, Glycine max
  Peptide Sequence Number=SeqID_117258
atggtgatcatttttaaggcgttggaccttaaaaatgatcctttttacttgttgaagactgaagaaaacgaagaacgaacgatgaatgtcgaagaacggttgaaatcttcgcgtaattactcacggaacttaacggaacgttacggaagcgcatcggcttggattttcttcacggaaacaattttcctctggatttcgagagataagaagtgccaagaaggctga

SEQ ID NO: 25574 - DNA, 252 bp, Glycine max
  Peptide Sequence Number=SeqID_117259
atgaattgcgttttcgttcatgtgtcctcgactttcgagtttggagctacgtttcatgattgcttaagtgctgaccctcaaggctatcctccattctcccccttttttcggagctccatgaattgcgttttcgttcatgtgtcctccactttcgagtttggagctatgtttcatgattgcctaagtgcggaccctcaaggcaatcctccattctcaccctttttcggagccacagtgaatgttattgcctag

SEQ ID NO: 25575 - DNA, 605 bp, Glycine max
  Peptide Sequence Number=SeqID_117260
atgaaaagagaaaaacatgcctcctatagtagtcataactcttgcaagagcctaagtgaagaacttcgtgactattacgaaggaatgcataggtcacatcttagacctcactcccatagaagagaaaagaaaagaaagcctcaagaggttaacattaacctcccatgctggggggggaaggacaatgtagaggctaacttagattgggaaataagagtagagcaacaacttaaaaagaaatctacgtcaaaatcttatggctctcactcttatccaaataaataccaaggtcaagacatcttagtggtgacaccttctaagcccaaagatgttaaggggaatacaatagaaaagcaagcccctaaggctagtatgcaagagaaaactagctctataaagtgctttaaatgtcttggaagaggacacattacttctcaatgtctcaccacaaaaaccatgattttgaggggccaagacatttatagtagccaagataaggctactacttcaccttcctctagtgaaagtgaaaaagcaaaaggggaagaatctagtgaagaaatctacccccaagaagaaggacaaccattagtggttaaagagaa

SEQ ID NO: 25576 - DNA, 526 bp, Glycine max
  Peptide Sequence Number=SeqID_117261
atggggacaaatcaaaacggcaaaaggttttatcaagtcaaggttaaaagtctagatgtcaccagcctcaaggaattgggacgattgatgggacctctccaaaggcaagccttccgcaaagtgtacgggaagattctagatttgaccgcagcggaggtatttacggaagctgtcgtatccctcgcccaatactatgaccagccgttgaggtgcttcacgtttggggacttccaaatggtaccgactattgaagagtttgaggaaatactaggatgccctcttgggggaagaaaaccgtatcttttctccgggtttcttccctccttgagcaagattgcagttgtggtcggggattcggcaaaagagttggatcgcatgaagcaaactcgcaacggcgtagtaggcctgccatggaaatacttggaaggcaaggcaagggatatggcaagccaagagaagtggggcccatttgcgaatatactggctttgttgatttttggggttgtcctctttccgaacgtggacg

SEQ ID NO: 25577 - DNA, 135 bp, Glycine max
  Peptide Sequence Number=SeqID_117262
atggagctccagatgcacgcatacatgcagcctttggctgaccagcaggcagcaaatcatatgggccagcagtgccaggaccccaacccttacccgtggcctactcccgagcagttcagagccactgttgcatag

SEQ ID NO: 25578 - DNA, 298 bp, Glycine max
  Peptide Sequence Number=SeqID_117263
tcagaagtcatgggatgaagtagtggaaaagttcttgaagaagtacttccatgaatcaaagactgtagaaggaaaagctgccatctcttccttccaccaacagctcaacatattcatagatgggttgagaccacaatctaagcagctcttagatgcttcagctgggggtaagatcaaaatgaagacccccaaggaagcaatggacttaattaaaagcatggctgctagtgacattgccattctgagagaccgagctcacattcctaccaagaagagcttattggagctaacctcatag

SEQ ID NO: 25579 - DNA, 148 bp, Glycine max
  Peptide Sequence Number=SeqID_117264
atgactacaggtgatccaccccaacagaagacaagtcaaggaaatgagaaaaagaaagaagatgagaatattactcaaggcgatccaactcaacagaagagaagtcgaaaaatcggcataaagaaaaaattcaagaatatagcacaag

SEQ ID NO: 25580 - DNA, 130 bp, Glycine max
  Peptide Sequence Number=SeqID_117265
acgcacccgtgaacctcgcctcgctcgcccgcaaaagggtaccttgcgacacaggtctatggaaaactctatctctctctcgggtggtagaccgaatatatcctcagggaacacttcaggaaactatgca

SEQ ID NO: 25581 - DNA, 537 bp, Glycine max
  Peptide Sequence Number=SeqID_117266
atggagaggagtatgattgatgctaccagttgtggagctcttggtgatatgactcctattgaggccaggaatctgattgagaagatgacttccaactcccaacaattcagtgcaagaaatgatgctattgtccttagaggagtccatgatgtggccacagattcatctttatttgctgaaaataagaagcttgagggaaaacttgatgccttggttaacctagtaactcagcttgccataaatcagaaatctacatgtgcacctgttactgttgcaagagtctgtggtctatgttcttccactgatcaccatacagatctttgtccatctatgcagcaatctggagttaatgaggaacctgaaacctatgctgcaaacatttataatagaccaactcagcagcaaaaccaacaacagcagaataattatgatctttcaaacaacagatacaatccaggccatatgttcctcctccaatgcagcagtagcaacaacaaagacaacaagcaactgaggccccttctcaaccttccttag

SEQ ID NO: 25582 - DNA, 533 bp, Glycine max
  Peptide Sequence Number=SeqID_117267
atcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgaacctgcggaaggatcattgtcgatgcctcacaatcagattgacccgcgaacttgtttattcatctaccgtcgggagggaggggatgaccacggcgccccgaactcaaatctgttaagtgcgactcccgggggcccggagacggtgtcccgcgggagtcgtcacgacacaacatttacatacaatgactctcggcaacggatatctcgggctcttgcatcgatgaagaacgtagcgaaatgcgatacttggtgtgaattgcagaatcccgtgaaccatcgagtctttgaacgcaagttgcgcccgaagccattaggccgagggcacgcctgcctgggtggcacacatcgtttccccaacgcaaacatgtacaatgttgctgccgg

SEQ ID NO: 25583 - DNA, 354 bp, Glycine max
  Peptide Sequence Number=SeqID_117268
atgaatattgaacaagccattggtcatggaactgaaattgctatggatgttcatgaagcgatgagtagagaaacaaatgaagtggaattcatgggtttaggtgctactactactatagacttagaagaaccaagctctaatacaaaaggaaaaagacaaggtttaacttcttctagcacagattctcacaggagaaagattggagaaaaagaaggaataacaatctctttagataaaatggtcaactcttttgaccgaatggtagaaaaaatggatggtaaaatcgatgatgaagatagtcaagaaatgttacgtgaggtagctttgataccagatcttagtagacaacaatga

SEQ ID NO: 25584 - DNA, 195 bp, Glycine max
  Peptide Sequence Number=SeqID_117269
atgtgcggagtcgccaccaacgtttatttgtggaaaacgtcggaaaacccgaaggaaaccggtcaaaatgaaaattctaagttcgggagtgtatttacattgaggaaggtcgacaaaagcggggcttttgcccctacataccctccatcgaagaggaaatcagacctgcgtagttcttctttaagagtgaattaa

SEQ ID NO: 25585 - DNA, 237 bp, Glycine max
  Peptide Sequence Number=SeqID_117270
atgccttccaagattattttgatgatgtcaaagaatcaagagttaagcaagtcccaaagaatcagaagtcaaaaagcttcaagactcgagattcaagaatcaagagaagtctcaatcaagtttcaagaatcaagattcaagaataatcaagatcaaaattcaaaattcaagattcaagaatcaagagaagactcaatcaagataagtactaaaaaagtttttcaaaacattgagtag

SEQ ID NO: 25586 - DNA, 236 bp, Glycine max
  Peptide Sequence Number=SeqID_117271
gtgctggtgctgtaacttcatttggttactgtaaagatcatgatggtcaatggctgaagaaggatgcactgcctcagcaagatgagcagttacggggcctccacacatatgttggtgaacgattcgattccttggatggtcgctttgaaggcatggataccctcatcacccagcttgaagaagatgtgacttatcttcgtcggtgcttcgatcttccaccgccttctaagtcttag

SEQ ID NO: 25587 - DNA, 516 bp, Glycine max
  Peptide Sequence Number=SeqID_117272
atgcaattaccgcaagagccctcgaacaagagaccaagagggctcgcaaggaagagtatggccggaacaaatttcgcggagctctatggggtagcaatagtgaactcaagttgcggagggaagaaagagaccagtcgtgagcccatagcatggtccaaaagaagtttgtctcagcgtttatgcgagacggagaccaacatgctagctatcatcgccaagtaccaagaagagttagatctagccgcggcccacgagcataggatggcggacgaatatgcccaagtatacgcggaaaaagaggctagaggaagggtgatcgactctttacaccaagaggcaaccatgtggatggatcggtttgctcttaccttgaacgggagtcaagaacttccccgattgttagtcaaggccaaagcgatggcagacacctactccgcccctgaagagattcacgggcttctcggctattgtcagcatatgatagacttaatggcccacataattagaaatcgttag

SEQ ID NO: 25588 - DNA, 234 bp, Glycine max
  Peptide Sequence Number=SeqID_117273
atgtcattacgtcggctcggcggctcctcaccagaatcttactccttacaccctgccactgtcattctgctcccacgaacaagaatgatgcatgcacctgactcaacactcagatgcaatgtggtacgtaccaacaacaacctaatatcaggaaatagcctaagcgtgtccacacgacactctcacttagggaactgtgctgaatttttcgagaccacccggttgtgcacgtaa

SEQ ID NO: 25589 - DNA, 174 bp, Glycine max
  Peptide Sequence Number=SeqID_117274
atggtgacaaaaagggtgatgcaagctccattggagcttgtaggcctaggatcttcttcatcaatggattcctttgctccttggaagatgaatggcagcggaatggagaagaaagagagagaggagacgccacttcaaggagaagatgagtctagaagaagctcaccaccatag

SEQ ID NO: 25590 - DNA, 318 bp, Glycine max
  Peptide Sequence Number=SeqID_117275
atgaaaagctggactgaaaagaagagcaagaatctggcgttcgtgtccaatgatgaaggagaagaagatgagtatgacctggatactgatgaagttcaacaaagtgatgaacagaatggacaggaggcagaaaccacatgtccggaacatcccttttcgacatcaggaaaggtagtgaataccagaaaaggtcagatgaaaagcccagtcacagcaaaggagttcaatgccgtgggtgtgaaggctatggacacatcaaagctgaatgtcccactcatctcagaagcagaggaaaggactttctgtatgtcggtctga

SEQ ID NO: 25591 - DNA, 828 bp, Glycine max
  Peptide Sequence Number=SeqID_117276
atggccccgaggaaagcttgcctcaaagaggtccaggaaaggataaagcggccgaaggaaccagttccgctcccgagtatgacagccaccgctttaggagcgctgagcaccagcagagcttcgaggccatcaaggggtggtcattttcttcgggagcgacgcgtccagctcagggacgatgagtataccgatttccaggaggagatagttcgccggcggtgggcatcactggtcacccccatggccaagttcaatccagacatagtcctcgaattttatgccaatgcttggcctacagaggagggcgtgcgagatatgaggtcctgggtgaggggtcagtggatcccgtttgatgcagatgctatcggccagttcctgggataccctttagtgctggaagagggccaggagtgcgagtatggccagaggaggaaccggtccgatgggttcgatgaggaggccatcgcccagttgctatgtataccggggcaggattttgcccggactgctgccgggagacgggtgcggatcatgcgcaccaacatgacccccctgactcagatctggatgactttgctgctcagcaacatccagcccagcgaccataattccgacctccccctgccgaagtgtcagctggtgtacgccatcctgacgcggatgagcattcacatggctcagctaatcgctgatgccatctatatatttgcaggtatggcgcctaccaggcaccttctggacccggataagtccaatagagccctgagatttcccgccttgatcacaggactctgccagtcgttcggcgtccccgtcgcacctagcaag

SEQ ID NO: 25592 - DNA, 294 bp, Glycine max
  Peptide Sequence Number=SeqID_117277
atggatgaagtaatcggagtgacaaatggtttcggttgcggaaaccggagaaagtcgggaaccgtcgcttcgcttcctcgtcgcttctttctggcgactagcttctcaagcgggtggcttggtaagcaagctaccttcagcatcggtcaaatccctatcaataataggccgaaatggtggggaaggaggccctccctactgaaatggaaaggggcgaatcgccgtttcacagccgctcctctacaactacctttcgcccaacatgatcacgaacgaagacagagaattgcgtag

SEQ ID NO: 25593 - DNA, 264 bp, Glycine max
  Peptide Sequence Number=SeqID_117278
atgtcaaatgaagaattgaagctgcaggatccacgatgtcggatacaatgtcctgacatcctgcccgaaaatactggagttgctgcacaatgcataagtcaagataaaatattttcaggaagaatgatagatctcctccagcacaagccgttgcagcccagaaacgcacattgctatataaacatggaggctgcacgattgttcgtaccaagtccgggattgaagagttattttgtgagtttttgggacttgagtgttttgtga

SEQ ID NO: 25594 - DNA, 483 bp, Glycine max
  Peptide Sequence Number=SeqID_117279
atggcacaacctccaccccgtgagaggactctaagggaaatggctgcacctgatttcacctacgaaagcttgtgcatccaataccctcatgaggatgtcccatatgttcttaaaactggactgattcatttgcttccaaagtttcatggccttgcaggtgaagacccgcacaaacatttgaaagaatttcacattgtctgctccaccatgaaacccccagatgtccaagaggatcacatatttctgaaggcttttcctcattcattagagggagtggcaaaggactggctgtattaccttgctccaaggaccacagccatcaggaaggaatctcaggtattagccaactcagtggagagagcctgtatgagtcctgggagagatttaagaaactatgtgccagttgcccccaccatcagatttcagaacaacttcttctccaatatttttttgaaggacttagtaatatggagagaagtatga

SEQ ID NO: 25595 - DNA, 249 bp, Glycine max
  Peptide Sequence Number=SeqID_117280
atgactgagtggtatatatttaaaattggtgctattcaaattatgctttatgattgtcatcatctaaatgggggagattgtggaagcaatgacttccaagattactttgatgatgccaaagaatcaagagttaagcaagttccaaagaatcgggagtcaaaaagcttcaagaatcaagtttcaagattcaagaataatcaagatcaagattcaagaatcaagagaagactcaatcaagataagtactaa

SEQ ID NO: 25596 - DNA, 105 bp, Glycine max
  Peptide Sequence Number=SeqID_117281
gtccaacgccttaacgtttctctcctttcaaaaatcaagaggtcgtttcaaggtccaacaccttaacgattctccgcctttcaaagttgagaagatcatttcaag

SEQ ID NO: 25597 - DNA, 189 bp, Glycine max
  Peptide Sequence Number=SeqID_117282
atggaaaccaacaaagggtccccagtggagtcgccaactgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagttga

SEQ ID NO: 25598 - DNA, 144 bp, Glycine max
  Peptide Sequence Number=SeqID_117283
atgaagacaagcattcaaagaaaaagcatagcatcagcatcaaagccgcatgctaagcgcgagatcagtgcgctaagcgcagcaggtgccttcagccaagctaagctcgagactggcgctaagcgcagtgtcacgatttcatag

SEQ ID NO: 25599 - DNA, 351 bp, Glycine max
  Peptide Sequence Number=SeqID_117284
atgtctcaaggaaatttcaatgggggtttatcggaaagcgcaccggatcgtcaacctaaattactaaaccttcgatccctcgtcaggctgaatatccaagcttcatccgtagatccctcatgtaagattaggctcgatttagacaactgtcataccctaatttcgtccggggacctttgctcgatgacgtgcgaccattctttggtcctcgtgaggtgcttggcacccatcattaggcaatttgtgaaattccaggacatgccgaaaaaaccaaaaaatattgatgcacaatccgtaagtttccgtgacacaccggaaatcaaatggaagcatcgttgcataattaagtga

SEQ ID NO: 25600 - DNA, 660 bp, Glycine max
  Peptide Sequence Number=SeqID_117285
atgaagaaatgggcccttgcagccgatcaggacggtgtcgaggacactgtctgtgacaaatacgacatcagcaaggaaaagtgggcccagttttgccagactcgcagagacccttcttgggaggcacaggccatccaaaagcagaatactgccccccacgttttgtctcgtgggggttatgattatttggagcagaagctcctggcggagaagaccaagaagaagatgcaggaagctgcacagtcaggaagcgttaatggcatcatcgaccctccatccctggtcagacgccacgtgaagtggaagatggcccgcacgaagaagacaggggagatgacgactgaggccgcaaaggaaatcgctgagaagattgattcgtttgaggagcaggccacacagggatcgttcgtcccccatggacgtcaggatgttctggccgctgctattggacgtccagagcaccctggatgtgtccgtgctgttggagccggtgtcaccatcaagcaatactttggatcggctccatggacgtcccacagtgcttcctccctgcctcctgacgaattacaacagctgactcagcagatcagggaccagctagaggagtccatcacaaagaaagtgacgaggcaggtcatggcatccttcagccagctttag

SEQ ID NO: 25601 - DNA, 186 bp, Glycine max
  Peptide Sequence Number=SeqID_117286
atgggaggaaaatgcgcggagtcgccaccaacgtttattcgaggaaaacgtcggaaaaaccggaagaggtgtggtctacgaactttaagtgtgaaaggttcgggagttgtatttacgcacggggaagggtgtttcccttgctcctacgtattcctcaattgtgacaagaaaattagacctacgtag

SEQ ID NO: 25602 - DNA, 312 bp, Glycine max
  Peptide Sequence Number=SeqID_117287
atggagtgtatgtcatggggggcagagtgcactgaccttgtcggatggcccagacgtggggaacacctttgggctcccaggctaatcatctatgggaggggggctgttacgtgcacaaccgggtgggtctcgataaacttagcacagttccctaagttagagtgtcgtgtggacacgcttaggctatttcctgaggtttggttgttgttgggacgtaccacattgcatctgagtgttgagttaggtgcatgcatcattctgtgcagtcttgattgggtccatggatggatgatgagtaattgttggatgtga

SEQ ID NO: 25603 - DNA, 279 bp, Glycine max
  Peptide Sequence Number=SeqID_117288
atggaagatgaaggaaatgaggatgtgggacttcccctagaattagaaagaatggtctcccatgaggaccaagaaatggggcctcatcaagaagaaacagagctggtagacttaggaattggcagtggaaaaagggaagtaaagataggtacagggcgacgcgtgactcgcgggatgcgtgttccacgaaaggaatacgcgcggagtcgccaccaacgtttattcgaggaaaacgtcggaaaaacaggaaaagacgcgatctacgaacttttaagttga

SEQ ID NO: 25604 - DNA, 570 bp, Glycine max
  Peptide Sequence Number=SeqID_117289
atggctgcaagtgacattgctattctcaaagatagaacccacgtaccaacaaagaaaagtcttatggaacttacatcgttgttgggtgtgccatctgtggtggagctcacaattatggctgctgtatccccaatgaagaaccaactcatgaagtcaactatatggggaaccagccaagacaaaatttcaatgcagatggatattccgaatttcagcatggccagccatataattcacaacaaagacaatggaaaaatcaccctggtatctatgtcaaaccataagagcacagagtcaaccattaagaatctggaagtccaagtgggacagctggcaaaacaattggcggataggttgtcaagcagctttactgcaaacactgagaagaatccaaaggaagaatgtaaagctttaatgataaggaggaaaatgacaattcaggccgatgaaggaaaagctgagaagaaggcagagggatataaacaacagtcggcagttgagccggcactggaaccagtgtctgactttgttgaacttgaggaagttgtggaagatgaagatgaccaatag

SEQ ID NO: 25605 - DNA, 852 bp, Glycine max
  Peptide Sequence Number=SeqID_117290
atgatagaagttttcgtggaagtcatcgcatccttcactcagtactatgaccagccgctaaggtgcttcacatttggggactttcagttggtaccaaccgtagaagagtttgaagggatcttgggatgctcgctaggaggaaggaagtcgtatctgttttctgggttttacccctccatggcaagagtagcaaaggtggtcaagatctcggtgcaagaattggaacgagtgaaacaaaatagaaatggggtggttgggataccaaagaagcgcttggaagagaaagcgaaagctttggcggatcaaggagagtggacttctttcattgatgttttagcactattggtgtttggggtcgtcctctttccaaatgtggatgggctaatggatctagcggcgatcaatgcttttcttgcttatcaccatagcaaggaaagttcggccgttgttgttttggttgatgcctatgacacgtttgaccagagatgcaagaagaacaacgcgagaattgtctgttgcacactcgctctttatgtatggctggtctttcacatttttcatcatgaaagtagacatgtttgtcccctacaaggtcactacatatgtgccgagaaagggaaagcaaattgggagcagctcatggcgggtatggtaggggcgtccgttaattggttccctcgatggaaggaaggaggggccagagttttgtcctcatgtgaagggttcccaaacgtccccttgatgggaacgaggggttgtattaattataatcctgtacttgtcataagacaactaggctaccctatgaaaggggcaccatcagaagagagtatcgcgcctttcatcgcatga

SEQ ID NO: 25606 - DNA, 372 bp, Glycine max
  Peptide Sequence Number=SeqID_117291
atgaaagcgacaggtaaagacacattccagaagctgagactgaaagagtttttcagcgctcgctgcattcacaaggtcatgcgtgataatgatcgtgagaaaatatcacgtcatttgcgcaaaaaattcgcgaaaaggcgccctcacgatcaaccccaattggcgaaaccgatgccctttccaatcgaacgaccgaaggtaaaatcaggcaactccgactatggcagacaatgtgcccaggcacttgatctatccgttaggaatcttatgagtaaagctgttgcttccggatgggatgaagttgaagttgcgttgcaggtgatatcgctctgcgagagctatatttatggcccctttgatcgcgagcgttaa

SEQ ID NO: 25607 - DNA, 144 bp, Glycine max
  Peptide Sequence Number=SeqID_117292
atggaagattgccttgagggtccccacttaggcatcatgaaacatagctccaaactccaaggtggaggacacatgaacagcgctaggcaacctaactttcatggagctcctaaaaaagggggagattggatgattgccttgagg

SEQ ID NO: 25608 - DNA, 150 bp, Glycine max
  Peptide Sequence Number=SeqID_117293
atgactaaagcacgtcaaaaggggggtacggaaagaaaaggaaagagatgcttgccacccagctcgcccaagcgagctaggttgcttcctccagaagcaccgccttttggaggaacatcctggaaggccaatgggcctggttgctattga

SEQ ID NO: 25609 - DNA, 474 bp, Glycine max
  Peptide Sequence Number=SeqID_117294
atgtcaatccttacctcggaagaaaagagtgggagaaagcaaaaagaaaagaaggaaagttcccaatcaaagagtgggagaaagcaaaaaaaaagaaaagaaggaaagttcccaatcaaagagtgggagaagaaaaaaaaagaaaagaaggaaaattcccaaatcaaagagtgggagaaagaaaaggacggaaagaaaattcccgatcaaggatcgaaggaaaacagaggaaatgtgcagaaaggtcgttggaccagacgatatctgaacaatacagaattgtcaccaaataaacaaaaagaagaaaggaaaccacaacctaaagtgatcttctcccttagattgccaaccaaaatcttgtgcgtcggtgacttgttcgcctcgcgtaaaacaaaaacagaaaagaaaaggggcagaaaactcaaagccaaatttcccaccaaaagaacccattcccaagaagagtcctattga

SEQ ID NO: 25610 - DNA, 636 bp, Glycine max
  Peptide Sequence Number=SeqID_117295
atgggtgaagtagagaagacacaagagaatatgaaggccgacatggaggccattaaagagaaaatggccacaatgatggaggccatgatgagcgtgaagaagataatggaagccaatgcggttgcaattgccgctaccagcgttgttgctaaggtgaacccgacatccccatccggcatcaaccaaatgaatcatccaacctcagatatggtaggcaaagatttgggaagtacgggcggcccccataatgtgcaaattcaaaacgagcacgccttcccgccatatggcttgcctctcaactatacgccacccaatgtggcgtacactcccaatgaaatctcaataactccactcccatactcattaagagccaacaacctcaatctgatcatgcacatgtctctcatggaggagacacatgaaattccccaccacaatctagctgacttcgagccttggctcggatatgccactgaagggcaagcagttggtggtatacccctgcaaaacactttggagggccctcagtttcgcccacaaccacaaccctcacgttccacagtggttaaaaaccctcatgactatggcagaaatgggaaagttggatcatctagaggaaaggctcagggccattga

SEQ ID NO: 25611 - DNA, 730 bp, Glycine max
  Peptide Sequence Number=SeqID_117296
ttctcacggctgatgatccgcgatggcattaaaggtcgcatcattcagatcaactcgaaatccggcaaagtcggcagtaagcataactcaggctatagcgcggcgaagttcggcggcgtcgggctgacccagtcgctggcgctggatctggcggaatacggcattaccgtgcattcgctgatgctcggcaatctgttgaaatcaccgatgttccagtcgctgctgccgcagtacgccaccaagctcggcattgatgagagcgaagtcgagcagtactacatcgataaggtgccgttgaaacgcggctgcgattaccaggatgtgctgaacgtgttgatgttctacgccagcccgcaggcatcgtactgcaccgggcagtcgattaacgtcaccggcggccaggtgatccgccacccgacaaaaaacggtacccgggttgtacccggcatcacaccttcaggagacattatggttaccgcactcattaccgtcgccgctattgcctggctttgccaactggcgttcggcggctggcagatccgccgcttcaatcacgcctttgatagcctttgccagcagggccgcgtcggcgtcggccgctcctccgggcgctttaaaccgcgcgcgattgtcgctatcgccgtcgatgaaaacgatcgtatttgcgatacgctgttgatgaagggactcaccgtcttcgccagtccgcaaaaaatccccacgcttagcg

SEQ ID NO: 25612 - DNA, 159 bp, Glycine max
  Peptide Sequence Number=SeqID_117297
atgtcgtcacgcatgcgttgtacgttggtctcatcttttgtcatgggaagccgaaaggttcatatcaccttcttaactgcacacatggagcactgtgcccccaaatgcgcaagtactatgagccaaccatgtaaggatcataaacccgttttcacttaa

SEQ ID NO: 25613 - DNA, 198 bp, Glycine max
  Peptide Sequence Number=SeqID_117298
atggagagatgccataacttcgacaatgggaagagatctcaagaagaaaagaatgagaagaaaagccatgaagaaagaagatccaagaaggcgtatattgcttggaatgacaatgactcatccgatggttcggtgaaggagatcaaccttttgtccaaggactacgagagcgatgagaaaatctctcaagaagattaa

SEQ ID NO: 25614 - DNA, 676 bp, Glycine max
  Peptide Sequence Number=SeqID_117299
gattgcatcagaaggctacacgccctcaccttcagagaactacacatcctgaccttcgaaggactacacgccctcacctttagaggactacacgttctcgcctttagagggctacacaccctcgccttcagaggactacacgtcctttccttcagagggctacacgccctcgccttcagaggactacacgtcctcgccttcaaagggctacacgtcctcgcctttggagggctgcacgtcctcgcttttatagggctctacatctgcacctttagagaactcaatgaggaggctatcacgcagttactatgcataccggggcaagatttcacccgtgccgctgcaaagagacgagtgtggatcatgcgcaccaacatgaccactcttacacagatatggatgacgttgctacttagcaacattctgtccaacgaccacaatgccgatctccctctgcggaaggatcgtgcccacaagacacccagtggacccggaggagtcccacagggccctagggtttccagctctagttacgggcctctgatcacgcccacaagacacccagtggacccgaagaagtccaacagggtcctagggtttccagctctgattatgggcctctgtcagtcctacagggtgtctgtccccccagcagggtcatgccatcatgacatag

SEQ ID NO: 25615 - DNA, 624 bp, Glycine max
  Peptide Sequence Number=SeqID_117300
gtcgactctagaggatcccacatcagtgcttacctcggcgacgagggcaaaggtctgctgctgaacgtgaccgatgcggcctctattgagagcgtgctcgagaaagttcgcgccgaatttggcgaagttgacattttggtcaataatgcaggcattacgcgtgacaatctgctgatgcgcatgaaagacgatgagtgggcggatatcctcgataccaacctgacatcggtgttccgcctgtcgaaggcggtcatgcgtgccatgatgaaaaagcgcgtgggccgtatcattaccatcggttcggtagttggaaccatgggtaacgcgggtcaggcaaactatgctgcagcaaaagcaggtttgattggctttagcaaatcactggcgcgagaagttgcgtcacgtggcattaccgtaaacgtcgtggctccgggctttattgagacggacatgacgcgtgcactgaacgaagatcagcgctcgggcattctggcagaagtgccggcaggtcgtttaggcgacccgcaggagattgccaatgctgttgcattcttagcctctgacgaagccgcctacatcacgggtgagacgctgcacgtcaatggcggcatgtacatggtctga

SEQ ID NO: 25616 - DNA, 331 bp, Glycine max
  Peptide Sequence Number=SeqID_117301
atggtgagggaggcctggagtaatgatcagcagggaggttgggggggtattgtccttaaaaataagctgaaaaacttgaaagctgctataaaacagtggagtaagggagaggggaattttgatgtcaacaagatattcagcattcagcagaaattaaatgaggtggaggatctagcctctaatcgagttttgtctgaccaagagctcaaggactactctagaccttatttggatggggttccttttaattctatttctcatgggcaaagggagcagatgcctgtccctttccctgaccaagagatcaaagaagctgtgtggagctgtggag

SEQ ID NO: 25617 - DNA, 165 bp, Glycine max
  Peptide Sequence Number=SeqID_117302
atgtcatggaacttcacggattgcttaacgatgggtgtcaagttcctcgaagcggtcaagcaaaggttgcatgccatcaaacaatggtccccggacgaaattaggggactcattaggcaggtgttgaggaaagaatccatgagtttcaagaacctatggatttga

SEQ ID NO: 25618 - DNA, 330 bp, Glycine max
  Peptide Sequence Number=SeqID_117303
atggcagcgcagttaatccatgatcgcgtggtgatggagtgcctagagggagtttgggagaccctcgaaggcaatgagaggtgtcgattccatggcacgattcaactcactgctacttcattggtgtcatcctctgaagaagatcctgaggaggacctagaggagctacctcctgaacctgttgtggatgacctcgacttacctgaggatgatgaagacccactccctgatgttgattctccagaggatatcatgtcagcatctgaggtagactctacagaggagagcggccctggagggacaacgagtagtgaagactcttcatcatag

SEQ ID NO: 25619 - DNA, 322 bp, Glycine max
  Peptide Sequence Number=SeqID_117304
atgactagaggcaatccatctgacttacaaccctttgatcctgagatagataggacatttcatagattagttaggcatcattttgtatcttttgagcatcctgagcattatgttattggtgagtctgagcattatgtggttggtaattttgaacattctgagaacatgacacaacctctaccccatgagaggactctaagggaaatggctgcacctgatttcacctacgaaagcttgtgcatccaataccttgatgaggacgtcccatatgttcttaaaactggactgatccatttgcttccaaagtttcatggccttgcag

SEQ ID NO: 25620 - DNA, 513 bp, Glycine max
  Peptide Sequence Number=SeqID_117305
atgatcggaaggcttcttgccggttcattggcttttgaaagccgcatccttcaatatctaattgttcgcatcttgcttccgagatcttcaaactttgcacaggtttctgaagaagatctcattgttatgtgggcctttcataaaggtctacaaattgattgggcacatcttgttagatatcgcatgcataagccattgcgattgaatgctccattgccatatccacatctagtcactcttttccttcaacactttaacatccctcttgattctgaaccttacgttccaatcaagagatccttcctaataggaactttagtcattgcatcctttggacatgatggagaagattcatctcttctttcaaagattttggacaggtttgacactttggaattacaagtggacatgcgctttaatgagatggagtcaagaatcaccaaggttgaagaagatgtttcttatattcgttcaagctttgatctaccaccaccgccgccaccatcatcttag

SEQ ID NO: 25621 - DNA, 480 bp, Glycine max
  Peptide Sequence Number=SeqID_117306
atggggacaaatcaaaacggcaaaaggttttatcaagtcaaggttaaaagtctagatgtcaccagcctcaaggaattgggacgattgatgggacccctccaaaggcaagccttccgcaaagtgtacgggaagatcctagatttggccgcagcggaggtatttacggaagtcgtcgtatccctcgtccaatactatgaccatccgttgaggtgtttcacgtttggggacttccaaatggtaccaactattgaggagtttgaagagatattaggatgccctctcggggggagaaaaccgtatctttttttcggctttcttccttccttgagcaaggttgcggctgtgattggagattcagcaaaagagttggatcgcatgaagcaaattcgaaacggcgtagtgggcctgcctcggaatactggaaggcaaggcaagggatatggcgagccagagaagtggggcccgtttgcggatatttag

SEQ ID NO: 25622 - DNA, 222 bp, Glycine max
  Peptide Sequence Number=SeqID_117307
atggaggattgccttgagggtcctctcttaggcaatcatgaaacacagctccaactcgaaagtggaggacacatgaatgacaatgcaattcattcatggggctccggaaaaaaggcaatcatgaaacacagctccaaactcaaaagtggaggacacatgaatgacctaacgcaattcattcatgtggctccggaaaaggatgagaatggaggattgccttga

SEQ ID NO: 25623 - DNA, 417 bp, Glycine max
  Peptide Sequence Number=SeqID_117308
gacgccgcgactaaaggaactagtgccgctcctgagttcgacatccatcgtttcaagagcactgagcaccagcagcgtttcaaggccatcaaggaggagatagctcgccggcgttggacgtcgctggtcactcccatggccaagtttgatccggatatagttctagagttttatgccaatgcttggcccacggaggagggcgtgcgggacatgcggtcatgggtaaggggccaatggattccttttgatgcaggcgccctcaaccagctcctgggatacccgctagtgttggaggagggccaggagtgtgagtatagtcagagaaggaaccgggccgatgaatttgatgaggaggccattgcccgactgctatgcataccaggtcaggatttcacccggaccgctgccgggagacgg

SEQ ID NO: 25624 - DNA, 270 bp, Glycine max
  Peptide Sequence Number=SeqID_117309
atgatgatttggaaacaacgtgcaaaattagtcatggccacaactaggtgggcactcaagcatccagtttatggcattgtgatactatggttggggatttacacaaacagacccaacgtttccaaattatgttctttcatcgattcaatgaatccatccattcttatctcggtcattcaggaaaacaaacccttagcgactatgttcctaaatgaaaaactctacacggttccgaaatttcaacaaacactattgacaacaactaagtaa

SEQ ID NO: 25625 - DNA, 363 bp, Glycine max
  Peptide Sequence Number=SeqID_117310
atgtctcttgccactttatttggtaaattgcaggaacacgagatggaacttcaacgcctcaatcagaatgaagaaaatgacaaaaagaatagaagcatagcccttaaagcctcatcttcaatacaagaagaaaacgaagaagaagattccgatgatgaagaagatttttccttctttgttaagaaatttcataaattcatcaagaaaagaagaattgacaggcgtcagaatttcattaatggaagaaaatcacaagatgattctcaagtccttaggtgttacaaatgcaaccaaattggtcacattaagaccaactgtccgtcaatgaagaatggtcggagaaaagtgaaaataaagatttga

SEQ ID NO: 25626 - DNA, 237 bp, Glycine max
  Peptide Sequence Number=SeqID_117311
gaaacctgtcgtgccagctgcattaatgaatcggccaacgcccggggagagggggtttgcgtattgggcgctaaaggaatgtatactggcttactatgttggccctgatgagggatatattccgcttcctcgctcactgactcgctacgctcggtcgttctactgcggcgagcggaaatggcttacgaacggggcggagatttcctggaagatgccaggaatattcttaacagggaa

SEQ ID NO: 25627 - DNA, 183 bp, Glycine max
  Peptide Sequence Number=SeqID_117312
atggcaccagaatggagaagaagaagagttaagaggagatgccacttcaaggagaagatgagtcaagaagaagctcaccaccataggaagccatggataagagcttggagccttctaatccaagatcaagtccaagattctccactaagtgtgcttaggtatcatgaagcatgtaaagcatga

SEQ ID NO: 25628 - DNA, 267 bp, Glycine max
  Peptide Sequence Number=SeqID_117313
atgaagatgctcttgatacctcatgatgtaagctccattggagcttgtaggcctaggatcttcttcatcaatggattcctttgcttcttggaagatgaatcccatgggcccgaaatctatcctaaggctcataagaaccctagggccttctcttgcatctctggcccaatctacttggagttttctatccaatgcccttgcggggtaggattgcatcattctctcccccttgaaaaggatttgacctcaaatccgcgaggttcttga

SEQ ID NO: 25629 - DNA, 102 bp, Glycine max
  Peptide Sequence Number=SeqID_117314
atggcagaaatcaaccaaggtaagacgatgaccggtcacgattggttgcatatcatttggctcttacttgcaggcttaaataggcaaaacgctaacccataa

SEQ ID NO: 25630 - DNA, 1095 bp, Glycine max
  misc_feature (1049)..(1049): n is a, c, g, or t
  Peptide Sequence Number=SeqID_117315
atgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacacacgatgctgtagcatggcacaacgtgcgcaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatgttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgatnagtcgtgtcttaccgggttggactcaagacgatagttaccggataa

SEQ ID NO: 25631 - DNA, 287 bp, Glycine max
  Peptide Sequence Number=SeqID_117316
atggctagacatgatacatgtcggggtttggtttggctcaaggataaaaggggtgccccacattatttccatgacacaaatgcaaaaatgatgatttggaaactttatgcaaaactggtcatgcatgcacctatgcggacgctcaagtggtggcggtgcgtctattgcccgctaccggccatcctaatgctactgtggtgtctcgccctgcgtctgcctgggggcgcagtacctcttgatgaaagctcgattagtagggggcctgatgcccttgctggaggtgacag

SEQ ID NO: 25632 - DNA, 264 bp, Glycine max
  Peptide Sequence Number=SeqID_117317
atgtggtgcacttgccggaagccgaacaagatttttgcttcattgtcagggaacttctttttatttgggaaatctcccacaggaaatttagttcctctagacttagaaattgaggctacattgcgaaggaacagagccgagaggagatggaaaattctgcaagacagaacagttgcatccattcttgaggaagagactcatttctctgacttattatcacctggattcaccatcatcaagggaatttgccactcaattacctga

SEQ ID NO: 25633 - DNA, 498 bp, Glycine max
  Peptide Sequence Number=SeqID_117318
atgtgcaggtgtcagaccctgtatcactggagagacgtgatgaaaactatcgctattggtgccgatgatgcggctatcgatctgaaaaacatcattaaaaagctgctggaagagcaggattatcaggtaactgattacagtaacgacgcgcaaaatgagcgcccgatgtatccggacgtggcgtttgcgctggcgacggcggtgcagcaaaagcagtttgagcgcggcattttgctgtgtggcaccggcattggcgtcgcgattgttgccaataaagtggaaggcgtgcgcgccgcgcagtgtcatgacaccttctccgccgagcgcgcgcgcaaaagtaataatgcccagatcatgaccatgggctcacgcgtaattgggccggagctggcgaaaaacatcgttaacgcctggctggcatccgagtttgaagggggcggttcgaccgccaaagtggagaagatcggttactacgaacaggtgtcacacgcgaaataa

SEQ ID NO: 25634 - DNA, 390 bp, Glycine max
  Peptide Sequence Number=SeqID_117319
cctgttgtaatcgattacacagagggatgggtcactggtaatcgattacagatcgtgatggcggcgcagctaatccgtgatcgagtagagatggagtgcctagagggagcttgggagaccctcgaaggcaacacgaggtgccgatttcggggcaccattcaattcacggctacttctttggtgcatccagatgaacctgcacggacgcttcagcgcactgtggagtggatactacccacgcctacaccatatcgtctagtggagtctgtccaagtgattgatgtaacgtcatccgaggaagaccctgaggaggatctggaggagctacctcctgagcctgctgtggatgctcttgactttctagagggtgatgaggatccacttctctga

SEQ ID NO: 25635 - DNA, 168 bp, Glycine max
  Peptide Sequence Number=SeqID_117320
atggggtgcaatagaaaccaggcccacttgggccctccaccgaaggctgttgcttctgaggagcaacctggctcgcctgggcgagctgggcgcaagcatctcccctattttgctataaataagggaggaaaaaatctaagccgaggcgcttccgaaacgtttccgtaa

SEQ ID NO: 25636 - DNA, 333 bp, Glycine max
  Peptide Sequence Number=SeqID_117321
atggatacgatgatgatagtgatgctggaaatgatttggcttcgggggttggagagtgtaggatgtatactcaggcggaaaaagcaaaaaacaagtgttgctgctgctcaaacttctaaaaaacaggcaataattgttggatcttcatcaaggaagcaaaaagcagtccaagaaaatgatgaggatctagatgttgaggagaatattgatgttgaatctgaagaagaagaaatcatggtcaattttgaggcgtctgatggggaagagggagatgctccattatcatatgataacaacgaagatgattatgttgggattggagaagatgattag

SEQ ID NO: 25637 - DNA, 273 bp, Glycine max
  Peptide Sequence Number=SeqID_117322
gaatcgcacccacaaagacacccagtggacccggagaagtccaacagggccctggggtttccagctctggttacgggcctctgtagtcctacagggtgcccgtttcccccggcaaggtcacgccatcatgacatagagatcgtgcccgcaagacacccagtggacccgaagaagtccaacagggtcttgaagttttcaagctctaattacgggtctctgtcagttctacggagtgcctgtcacctccagcaagggcatcaggccccctactaa

SEQ ID NO: 25638 - DNA, 636 bp, Glycine max
  Peptide Sequence Number=SeqID_117323
atgatggaacaagaaattctcgccctgttcgaaaacgtattatcccgtaaggtcggtttccacgatgagctgattgactcagacattctcgactccattctggcggtcgacatggtactggaagtgcaggacgtttacggcttctgcggtatggcattcgtaacaacgaaagacggcgtcaacatttactacaaagactggggtccgaaagaagctcaacccattgttttccatcacggctggccattgagtgccgatgactgggataaccagatgctcttcttccttgccgagggctatcgcgttatcgctatcgatcgtcgtggtcatggacgttcggatcaggtcagtgaaggtcacgatatggatcattatgcggccgacgcgtcggccgtggttgaaagcctggatctgcacaatgccgtgcatgtcggtcactctaccggcggcggccaggtcgcccgctatgtagcgaaatacggccagccgcaggggcgcgtcgccaaagcggtgctcgtcagcgccgttcccccgctgatggtcaaaacagaggataaccccggcgggacacccatcgaggtgtttgacggcttccgtagtgcgcttgcagccaatcgcgcgcagttttacctcgac

SEQ ID NO: 25639 - DNA, 633 bp, Glycine max
  Peptide Sequence Number=SeqID_117324
tccaaaggggttgcttctgacagcttggtcttcaaacacctgagcccagtcattaacttggcctatatcaggaaaaactgttggaaccctgatgatttgacagttactatcagagaggccaggagagtgaggacaaggctagttgaggccccttccacatctacagctcctcctccagcatgtaccctagcagctccttctgccccagcttatgcagattttcagcgtcttgaagccgtgcttcaaaacatccatcaggggcagattatcttattacaaagtttacagatggtggcacctccaaactctattccttcagtagagcagtttaatgagtgggatgagtcatccgagactaccactccagagcccttggtcaaaaggaagaaggcagatcaaacacaagaagctgcaaccacttctgagaaatctcttgaggccactttcgagccttcagaaccagtgacaaatatagcttcacttcagcaggcagcagacccttccactcctgaggatcagactacacctgtcttgtctccgaaaacctctcctacaactaccgttgtgcttcacttaacagatgaggaggatgttcagacacaggatactcaggaccgatcacaggatttttga

SEQ ID NO: 25640 - DNA, 126 bp, Glycine max
  Peptide Sequence Number=SeqID_117325
atgaaccctaagagaataaaggtcattcctaagtggcccactccaccaagtataagaaaaatttggggcttccatgacttaacaaacatttaccaaaggtgttcagggaaggagctcagagtatga

SEQ ID NO: 25641 - DNA, 347 bp, Glycine max
  Peptide Sequence Number=SeqID_117326
atgctcaagcacggttacgagcccggaatgggtctgggcaaggacagccacgaggatgccgttgtggttgacattaggggtaacccgtacaaatatgggttggggtatgaacccgggaaacctggaagaaggaatgcaccatcaagactccgggcggatagggcgtggcccggtcatgttagccagtgtttcacaagtgtcgggataatgcttgaggaagaggtggcggcaataggagagaagtctccacaagatccaccaagtttcgtacgaccgtgccatcccaattcccaagtggggaattggcgcgtgatgagccagtcggaagtctataccgctgattcaat

SEQ ID NO: 25642 - DNA, 333 bp, Glycine max
  Peptide Sequence Number=SeqID_117327
atgcagcatctgatgaagcttctcgaacgtgatcaatacattcattggcatagattgaaggatgaagttgtggtgcgtgatctgttttggtgtcacccagatgcagtaaagttatgcaatgcatgtcatctggtgttttttatagacagtacctacaaaacaaacaggtttcatatcgataagaatgtgaaggcgaagtgcaaatctttaatcggggaaaaaaatgcgtgggactatgtaatggatagctgggggttgaatcagctcattgggctctcaaaagagtactacaaaatagcgttggagacctatgtagtatttgggatgccatga

SEQ ID NO: 25643 - DNA, 288 bp, Glycine max
  Peptide Sequence Number=SeqID_117328
atgggtataggagtggagttattcacattctcattgggagtgtacgccacaattgctggtgtaagttgggaggcaagccatatggcgagaaggccagatgggggcatcgggttcaccttagcaacagtgctggtagcgacaattgtaaccatattggcttccattatcttcttcatgctcatcatggcctccatcattgtggccattttctcttacatggcctccatgtcggccttcatctgctcttgcacctcctctacttcacccattactctagctctagcacgg

SEQ ID NO: 25644 - DNA, 366 bp, Glycine max
  Peptide Sequence Number=SeqID_117329
atgggcagtcaacttgaatggccattacttgtcaatgcggaagcttgtggttacgtgagcatgaactactaccaatatatagatgttgtttacaccaatgagcacatcttaaaagcatactccgcacagtggtggcctcttgggaatgaagcggcaattcctccttctgatgaggcatggacactaatccctgacccaactacaattcgtgcgaaaggtcggccaaaatcaacaaggataaggaatgagatggattgggtcgaaccatctgaccaccgacaaaaatgtagtagatgtggagctgaagggcacaataggcgccgatgtccaatgcaatctgaccgtgggagtaattcatttaattga

SEQ ID NO: 25645 - DNA, 333 bp, Glycine max
  Peptide Sequence Number=SeqID_117330
atgacatccttcagccagatgcagtcccagatgcaatctcagggacttgcactgcgtttcgagcctctggttggtccctctggtcctcgagtaagcacaaaggggagttgtgttgatccctcaagaaactatcctgagacgggtgactcagataggtgcggcttgtacatcgaagcagatcctgcccgcctggttgccctggggagagtttatgagggatccactattgttcataactctccttttttgcgtggccaagtaaaggtggggtgtggagggagggtacagatgcagatgctccaattcctgtacccactgatgaggtttccctag

SEQ ID NO: 25646 - DNA, 588 bp, Glycine max
  Peptide Sequence Number=SeqID_117331
atgtctcctccacctctaggtgtggaagcaatgtcttccaaagttattttgatgatgtcaaagaatcaagagttaagcaaaggttcaagcaaagattcaagattcaagaacaatcaatatcaagattcaagactcaagattcaagaatcaagagaaggctcaatcaagataagtattaaaatgtttttcaatacattgagtagcacaagaagttttcacaaaatcattaccaaagagttttactctctggtaattgattaccagaaggtagtaatcgattaccagtgttttaaaacgttaagattttcaaaattcaaaaatgaagagtcacatctgttgatgtgtaatcgattacaccttaacgggtacatcctttgtggtacaagtagagggtacatctacttggggatttttatactgagaacaagagacggtacatctcttgtggatgagttcaagtggagggtacatccacttggtttttcaaagagaacaagggagggaacattccttgtggatctttggcttgtaaaggattttacaaggttgaaagaaatctcaagaaccgcaggttgcttggggacttga

SEQ ID NO: 25647 - DNA, 465 bp, Glycine max
  Peptide Sequence Number=SeqID_117332
atgactttgctgctcagcaacatccagcccagcgatcataattccgacctccccctgccgaagtgtcagctggtgtacgccatcctgacacggatgagcattcatgtggctcagttaatcgctgatgtcatctatctatttgcaggtatggcgcctaccaggcaccctctatacccggataagtccaacagggccctgggatttcccgccttgatcacaggactctgccagtcgttcggagtccccgtcgcacctagcaagagccagggttttacttcttttccgtgccctactccggaccagttcagggcagaggtcgcatggcctggagattggcctgaggcccaggcagaagaggcgccagcagaggcaccagcagaggctcctgacgaggcaaatgaggcccgcgaggacgaggagatgaccgatttacttgatttcttaggagggagcggggccacatga

SEQ ID NO: 25648 - DNA, 219 bp, Glycine max
  Peptide Sequence Number=SeqID_117333
atgtgcatgatcagattgaggttgttggctctcaatgagtatcagagtggagttattgacattctcattgggagtgtacgccacattgggtggtgtatagttggaaggcaagccatatggcgtgaaggcgtgcttgttttgaatttgcacataatgggggccgctcgtacttcccaatctttgcccaccatatctaagttggatgactcatttggttga

SEQ ID NO: 25649 - DNA, 642 bp, Glycine max
  Peptide Sequence Number=SeqID_117334
atgcacgtgctcaccttcagaggactgcacgtcctcacctttagagggctagacgccctcgccttcagaggactactcgtcctcgccatcagaggactacatgtcctcgccttttgtggattgcacgtcctttccttcagaggactacacgtcctcgtctttagaggactgcatgtccttgtcttcacaaggctgcacgccctctcctttagaggactagatgtcctcgccttcagagggctacacgtcctcaccttcaatgggctacacgttctcaccttcagaggactagacgtcctcgccttcagagggctacacgcccacgccttcagagggctacacgtcctcaccttcagggggctacacgttctaaccttcagaggactagacgtcctcgccttcagagggctacacgccctcgccttcagaggactacacgtcctctccttcagaggactacacgtcctcgcttttagaggtctgcacgtcctcgccttcagaggagtacatgtcctcgccttcagaggactgcacctccttgccttcagagggctacacaccctcaccttagaggactacgcgtcctcgctttcagaggactgcacatcctcgccttcacaggacaacacgtccttaccttaa

SEQ ID NO: 25650 - DNA, 435 bp, Glycine max
  Peptide Sequence Number=SeqID_117335
atgaaggagttttacgccaacctctatgaccccgaggataaatcacctaagcaggtgaaggtgagaggtcacttagtgaagtttgatgaggatactcttaacacatttttgaagaccccagtgattttggaggagggggagaacttatgtacttattccaggtttgcactcctaaggcctaatcctcaggagttagctgctaagctttgtatcccagggaagggattcgagcttaatgctgatgggcactctttgaagattttgaggaagaacatgaccactctagctcagacatggagcgttctttccttttctaacctcattcctacctcccacacatctgatgtgaccttggacagagccaaattgatttatggtattattatgaagatggatatgaaattggggtacctcatctcccaccagatctcttag

SEQ ID NO: 25651 - DNA, 180 bp, Glycine max
  Peptide Sequence Number=SeqID_117336
atgaaagcaaaatgcaaccaaaggtggcttgggggagcaaaaaccgtgaatcccgggttgctcgcccaggatactgggctgccttgcagcgacgttttctgcttgtccaacgcccagaaaggacgacgatctgtcggtcgtgaccctatcctctatttgcattcgtccctaagtacctga

SEQ ID NO: 25652 - DNA, 608 bp, Glycine max
  Peptide Sequence Number=SeqID_117337
catcatcgccttcagaggactacacgtcctcgccatcagagggcaacacgccctcgccttcagaggactacacgtcctcgccttcagatgactacacgctctcgactttagaggacttcacaggggtgcaggccctcaccttcaaaggactactccccctcaccttcaaaggcctacacgccctcgccatcagaggactacacgtcctcgccttcagaggactacacgtcctcgccttcagaggactacatgtcctcaccttcagaggactacacgtcctcaccttcggagggctacacgacctccctttcaaaggactacatgtcttggcctccatagggctacacgccctcactttcaaagggctgcacgcccatgcctttagaggactacacgtcctcaccttcaaagggctacacaccctcacgttcagcggactacacgccatcaccttcagaggctacacaccctcacgtttagcggactacacgccatcaccttcagagggctgcacaccctcgcctttagaggactacacgtcctctccatcagagggctacacgacctcaccgttagagggcaacacgccctcgccttcagagggctaa

SEQ ID NO: 25653 - DNA, 385 bp, Glycine max
  Peptide Sequence Number=SeqID_117338
atgacccagcccctaaggtgcttcacatttgaggacttccagctagtgccgactgtgaaagagttggaagaaatcctgggatgccaactgggaggaaggaagccatatcttttctttgggttctatccctccacgacaagagttgccaaggtagtgaaaatctcagcacaagagttggaacgtctaaagcaaaacagaaatggagtagtcgaagtaccaaggaagtttgtcctctttccgaatatggaagggttagtggacctagcagcgattgacgctttcctcgcctttcatcatggcaaggaaagcccggtcgtcgccattttggccatgtatgacacgttcgaccggggatgcccgtctatccgctacaaggtcaccgctc

SEQ ID NO: 25654 - DNA, 192 bp, Glycine max
  Peptide Sequence Number=SeqID_117339
atgacccttttcaggcattggagaggatcaacaacaatgtttataggctcaaactcccaaagaagtgtagctgattcaaatgatgaggggtctgcaaattcgaggataaatcctcttcaagagggaagggatgctggaatcctccctaaggttttcatgagtcttagggtagattttgggcccataggctaa

SEQ ID NO: 25655 - DNA, 456 bp, Glycine max
  Peptide Sequence Number=SeqID_117340
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatccccctatgtggcgcggtattatcccgtattgacgccgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 25656 - DNA, 886 bp, Glycine max
  Peptide Sequence Number=SeqID_117341
accacaggaagcaagtcgaaaatggggtggttggaataccgagaaaatatttagaggcaaaagctagaatctcggcaggtaaaggcgagtgggccctgttcatagatattctcgcattgttgattttcggaggagtcctctttccgaatgtggatgggttggtggacctggcagcgatcgacgcttttctcgcctatcataaccacaaggaaagcccggttgtcgctatgctagccgacttatatgacaccttcgaccgaagatgggcaaattgggaccaactcctagcaagcaaagaaggagcatctgtcaactggtttcctcgatggaaggaaggaagaaccggagttcatatttcatgcggaggatttccaattgttcccttgatggggacgaggggttgcatcagctataatcccgttcttgctataagacaacttggctaccctatgagaggggcgccactagaggatgagctcgcgcctgtcgtttcacgaggcttcaataagaccaacgtggagacacttcagaaggtctgcaaggcatgggaggtgttgcaaaagaaggacaaggaactcaggggcaataacaatgggcccattggtggctatcgcaagtggttaaaagcccacgtgcaaggtttagattggcttccaagtttgagaaccgctaaaagagaggaagttgaggcaccggaggaagacgaagaagtacaggcccttagggcggaactcgagcaagcccaaatagttaaagaaaggttcaaatcagtagctcttaagatccgaaaggagaatgccgagctgagagatgtaaacataactaccaccaaggccttggagcaagagacaaaaagggctcgtagggaagaacacggccggaacaa

SEQ ID NO: 25657 - DNA, 526 bp, Glycine max
  Peptide Sequence Number=SeqID_117342
atggggacaaatcaaaatggcaaaaggttttatcaagtcaaggttaagggtctagatgtcaccagcctcaaggaattgggacggttgatgggacctctccaaaggcaagacttccgcaaagtgtacggaaagatactagatttgaccgcagcggaggtatttacagaagctgtcgtatccctcgcccaatactatgatcagccgttgaggtgcttcacgtttggggacttccaaatggtaccgactgttgaagagtttgaggagatattagggtgccctcttgggggaagaaaaccgtacctattctccgggtttcttccctccttgagtaaggttgcagctgtggtcggagattcagaaaaagagttggatcgcatgaagcaaactcggaacggtgtagtgggcctgccgcggaaatacttggaaggcaaggcaagggatatggtgagccaagagaagtggggcccgtttgcggatacactagctttgctaatttttggggttgccctctttccgaacgtggatg

SEQ ID NO: 25658 - DNA, 195 bp, Glycine max
  Peptide Sequence Number=SeqID_117343
atgcattttcgaaaaggctattccgaagtcatcactggagggatgggtgttgttgagggaggagtgtcatcatggtgggtgtgtcatcgagggagatgtcgtcacaagttgatagaagggagaaaagaggtgaaaaagagtctaagttttgaaatgcaaaaagtagcagttgggctaagtgcatatccatcgtaa

SEQ ID NO: 25659 - DNA, 209 bp, Glycine max
  Peptide Sequence Number=SeqID_117344
gacctttcgtggtgaaaagagctttttctatgggtgctctgatactcacccacatggatggcgaggagctgccctcgcccgtgaactccgatggattcccattcactgtacttgtctcgcttctttgaaaagaaaagatgggcgaggagtagaatcgtctcaggccacggtcagaagtcaagacaagtcaatggcagaaatcaaccaag

SEQ ID NO: 25660 - DNA, 246 bp, Glycine max
  Peptide Sequence Number=SeqID_117345
atgtcatatgttcctattttgacaagcattttcgtgccattttcaacatatatgcacatttgcaaagcatttagctacctattcaacatacacatgtacatggtgaataacattttcacaccatctaggtacaaagaaatcatggtgcagcccaaaccaagtgctggccttaaggggaaacctcaccaacatgctctcactttcatgccttcttgcattccaaaaatcaaaggcttgggtccctag

SEQ ID NO: 25661 - DNA, 558 bp, Glycine max
  Peptide Sequence Number=SeqID_117346
atgtccaaatcttgtggatttgggatgaccggccctctcgatgagtcgatctcttgctttctcataagggtggacccttgggtacttgtacctatcacttttagaggactacacgtcctcgccatcagagggctgcatgccctcaccttcagaggactacacgtcctcaccatcagagggctgcacgccctcacctccagaggactacatgtcctcgccttgagagggctacacgccctcaccttgggtactacttaccctcaccgtgagaggactacacgtcctcgccttgagaggactacacgtcctcaccatcagagggctgcacgccctcacctcctagaggactatagtcctcgccttgagagggctacacgccctcaccttggaggactacacgtcctcgccgtcaaagggtcatgtgccttcacctttgtagggctacacgccctcaccttcagaggactacacgtcctcacctttagaggactacacgtcctcgccatcagaggactacatgttccccattttcaaaggggggcatgccctcacctttag

SEQ ID NO: 25662 - DNA, 309 bp, Glycine max
  Peptide Sequence Number=SeqID_117347
atggaaacgtgtttgggagtagaggaattgttacaacggatgatagatcaaggtcgactggaagttggcagtgaaggaagagaagagaagcacatatgcatgcagtccacggatgggagcagtgttgcgaaacccaaacccttggtgatatacttcactaaaggcacagcttcgcaaaagcccggacaccccttagtagctaaacctgttcctttcccgtaccaaaatagccacacagtaccatggagatatacacctccgagggagaaggaagaagaagccaccgacgtcagctcattgtcggctaaa

SEQ ID NO: 25663 - DNA, 350 bp, Glycine max
  Peptide Sequence Number=SeqID_117348
ttcgccgtcaaatcccagggctcaaccctggacaggcggtggaaactaccaagctggagtacgagacgaaagctaggggagcgaatgggattagataccccagtagtcctagccgtaaacgatggatactaggcgctgtgcgtatcgacccgtgcaatgctgtagctaacgcgttaagtatcccgcctggggagtaccgaagaaccttaccagggcttgacatgccgcgaatcctcttgaaagagaggggtgccttcgggaacgcggacacaggtggtgcatggctgtcgtcagctcgtgccgtaaggtgttgggttaagtcccgcaacgagcgcaaccctcgtgtttag

SEQ ID NO: 25664 - DNA, 438 bp, Glycine max
  Peptide Sequence Number=SeqID_117349
atggcgtctatgccatatacccttagacttgtcgagtctagtacacagggccttgaggatgactctgttagctgcatctgcctgaccattagtctgaggatgttcgacagaggtgacaaggtgttggacacctatccttgtcaagaagtcttagtatgtatgagctgtgaattgagtgtcgttgtccttgacaatggcatgtgggaggccatacctgcatatgacatgtttgcagatgaatttctccacctcattggccgtaatttcccacaatggtcttgcttttatccacttggtgaagtagtcgatggcgactacaaatggaaaaggggagctcggactgtggagattgtcatgaagggtgcgtggaatgtctacaaactcttggtatcatctataattctttgtaaagtcaaaggtgtctgccttgagtgttga

SEQ ID NO: 25665 - DNA, 208 bp, Glycine max
  Peptide Sequence Number=SeqID_117350
gtcgactctagaggatccccctacagcagttggaggattgagatgctatgagaatccaaagaataagattactgcaatacctgctgaggaagaggaaatctggggtgcattcttcaaggtaatcttagagcttaagaagttagagttgaatatcctttatgtaactaggattgtggaagggtcagcagtccttgcaggcacagagtaa

SEQ ID NO: 25666 - DNA, 144 bp, Glycine max
  Peptide Sequence Number=SeqID_117351
agcataaaatttcgtgcttttctcttcctctctgatgcaatcctccctaggaagggaccagtcactagagccatgagcaagaggctccaagaggattgggctagagctgctgaagaaggccctagggttctcatgaaccttagg

SEQ ID NO: 25667 - DNA, 939 bp, Glycine max
  Peptide Sequence Number=SeqID_117352
atggccaagtttgatccagaaatagtccttgagttttatgccaatgcttggccaacagaggagggcgtgcgtgacatgagatcctgggttaggggtcagtggatcccgttcgatgccgacgctatcagccagctcctgggatatccgatggtgttggaagagggccaggaatgcgagtatggccagaggaggaaccggtctgatgggttcgatgaggaggccatcgcccagctgctatgtataccggggcaggattttgcccggactgctgcagggaggcgagtgcgaatcatgcgcaccaacatgaccaccctgacccagatatggatgacgttgctcctcagcaacatcctgcccaccgatcataattccgacctccccatgcctaagtgccagctggtgtatgccatcctgtcacggatgagcatccatgtggctcagttgatcgctgatgccatctatatttttgcaggactctgccagtcgttcggagtccccgttgcacctaccaaggtgattcgaccgcccatcacccgggcttttattgagaagtactgtacccagagacaggctcagggtgatgctccacaggccgcaggcgcgcccccaccacctcatcaggctggccaggctggggcatttgacatggagcagtatttacggcatttggttcgccagcaggcggccaaccaccgagcacatgtacggacccatgattgtctgtaccagatgagccttagcatgcagagccagggcttcgcttctttttcatgccctactccagaccagttcagggcagaggttgcatggcccggagattggcccgaggcccaagcaggagaggcacccccagaagctcccggcgacggagaagaggcccacgaggatgaggagatggccgatttgcttgacttcttgggagggagtggagatacgtga

SEQ ID NO: 25668 - DNA, 144 bp, Glycine max
  Peptide Sequence Number=SeqID_117353
tttagggcagagtgcatgccagagattggcctgaggcccaggcaggggagcgccgcagaagctcccgacaatgcagatgaggcccgcatggatgaggagatgacgaatttactcgatttcttgggagggagcggaaccacatga

SEQ ID NO: 25669 - DNA, 264 bp, Glycine max
  Peptide Sequence Number=SeqID_117354
atgtacaatggtgatgagaatcatgaaactggtggcgtctacccagacttatcttccttaactggaagtggcgtctacccaaacttatcttccttcattggaagtggcgtctacccagacttatcttccttaaccggaagtggcgtctaccatgacttatcttccttcactggaagtggcgtcatccaatccttcgtagcctgtatcaagcgatccgctgctactcaggttcacatcatctggtatcagagcttcggctcttga

SEQ ID NO: 25670 - DNA, 480 bp, Glycine max
  Peptide Sequence Number=SeqID_117355
atggcccaggtgattgctgatgccacttatttgtttgcaggaatgacacctactaggcaccctctggacctagagaagtccaacagggccctggggtttccggctctaatcacgggcctctgccagtcctacggagttcctatcacccccagcaaggtaatccgaccgccgatcacccgatccttcatcgagaagtactgcatgcctaggcagacgcagggtgacgcacatcaggacgcgggcgcaccgccaccacctcagcaggccgattcggatgggccactgggcgtggagtgcctcaatcaacaggggcagggttccgccccttttgtatgccctaccctggaacagtttggggctgaggtcgcatggcctggagactggcctgatgcccaggcaggggaggagcctgcaggatcccccggtgaggcggatgaatcccgtatggatgaggatatgactgacctactcggtttctag

SEQ ID NO: 25671 - DNA, 870 bp, Glycine max
  Peptide Sequence Number=SeqID_117356
cacgcgtgatttccaggccgagctgacccgcgagatctacaagatcggcgcacgctcgctgccgatcatcgccgtcggcggtgccttcgtcggcctggtgctgaccctgcagggctaccgcacgctgaccaccttcggcgcggccgacgcgctgtcgaccctgctcggcctttcgctgtaccgcgagctggcaccggtgctgaccgcgttgctgttcatcggccgcgccggcagttcgatcgccgccgaactgggcatgatgcgtgccaccgaccagatcaaggcgctggagctgatggcgatcgatccggtagccaaggcggtggcgccgcgcttctgggcggcggtgctgactgtgccgttgctgaccggcatcttctgttcgctggcgatcagcgccagctacttcgaagccgtgcacgtgctgggcctggacaacggcgtgttctggtcggcgctgcgcaacagcgtggacttctgggacgacttcggcgtggcaatgctgaagtcggcgatctttggcggcactgccgcgctggtcgccgcctacgttggtttccatgccgagccgaccattgaaggcacttcggtggcgaccacccgtgcggtggtcaacgcctcgctgctggcgcgcgcggccaccacgactcgatcaggtaatccacatggccatccgcggtcccagactcgaattctccgtcggcgctttcctgctgctggccctggcctcgctgatggtgctggccgtggcctcgacccaaccagcgctggagctggggcagtgaaaggctatgacctgaaggcgcgccttctcccaggtcggccagcttgcgccaagcaagcgcccggtgaagaatcggcggcgtcacc

SEQ ID NO: 25672 - DNA, 186 bp, Glycine max
  Peptide Sequence Number=SeqID_117357
atgggacaccttagtgatcaaggggttcccatgaaccctaagagaataaaggtcattcttgagtggcctactccaccaagtgttgagggaaggagcccagagtatgaagaacctcgggatttgaggtcaaatcccttccaaggtggagggaatgatgcaatcctaccccgcaagggcattggatag

SEQ ID NO: 25673 - DNA, 267 bp, Glycine max
  Peptide Sequence Number=SeqID_117358
atgcatctacgtgatcaaggaagccttctttacaacaaagagaagaacaagatgaaagattgcaaaaatacaagtggtgaggatgtctccttcacctctaggatctcacaatcactcacaaactcatctcaagctctcagaacgactcctacttcaagctctagtctctgcagatcttcacacaacaaaatgagtgatgccatggattgttaccaatcgcatgcaccattgaaggatggcaatggattgttacactttggtatatga

SEQ ID NO: 25674 - DNA, 162 bp, Glycine max
  Peptide Sequence Number=SeqID_117359
atgactagtgaagttgtcatcatcaaaaagggggagattgtggaagcaaagcttcatgatgaatcaaaaatgattcaaaggtgttttgatgataacaatgatgacacaaagatgatgacaaaggtgatgaacaaaaagctcaaagatcaaagaacaactcaa

SEQ ID NO: 25675 - DNA, 267 bp, Glycine max
  Peptide Sequence Number=SeqID_117360
atggcatccttcagccagatgcagtcccagtttcaatcacacatgcaatcacaaggaattgcattgcctctggagcctgaggttggtccctcagggcctcgtgtcagcacaaaggagagttgtgttgatccctcagggaacaatccagagacgggggactcaggcaagtatgtgttgtacatcgaagcaaatcggccccgcttggttgccctaggaagactttatgagggatcaacagttcacaacattcattttttgcctggttaa

SEQ ID NO: 25676 - DNA, 282 bp, Glycine max
  Peptide Sequence Number=SeqID_117361
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtgtaactttcatctgagcaaaccctctggtaatcgattacaacctattgtaatcgattacaggggcctgttctatggtaatcgattacagggagtggtaatcgattactag

SEQ ID NO: 25677 - DNA, 510 bp, Glycine max
  Peptide Sequence Number=SeqID_117362
atgggacccctccaaaggcaagccttccgcaaagtgtacggaaagattttagatttgaccacagcggaggtatttacggaagccattgtatccctcgcccaatactatgaccagccgttgagatgtttcacatttggggacttccaaatagtaccgactgttgaagaatttgaggagatattagggtgccctcttgggggaagaaaaccatatcttttctccggatttcttccctccttgagcaagattgcagctgttgtcagagattcggcaagagagttggatcgtatgaagcaaactcgaaacgacgtagtgggcctaccgcggaaatacttggaaggcatggcaagggatatggcgaatcaagaggagtgggtcccgtttgcggatatactagctttgctaatctttgggggttgtcctctttccaacgtggacggtttggtggacctagccgcgattgatgctttcctttgcattatcaccatagcaaggagagcccggtggtag

SEQ ID NO: 25678 - DNA, 541 bp, Glycine max
  Peptide Sequence Number=SeqID_117363
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 25679 - DNA, 273 bp, Glycine max
  Peptide Sequence Number=SeqID_117364
atgactaattttgcacgttattttcaaatcatcattgtcacgtgtgccttatggaataatgcggaagttcgggccacgagcgaccccttgacacccaaattgtctcgccccagatatcaagattggggttcccacgacctctttgaaccttggcctatcgaaagaatcctcctcctttccccgaagcaaaggacagtgaaatctcctcaagggagagcgaatggaatgttaaaacccgatttcccaaagaaagggatggggaaggaaaattga

SEQ ID NO: 25680 - DNA, 228 bp, Glycine max
  Peptide Sequence Number=SeqID_117365
atggatgataaatggatgcagttcagtgactacattgcacctgtaggacaaatctgtgtagtgcctagccagtgttcgtcagattacatggattggttctacatgatttcacacccattcatgagtccggcacaaccaagggatcttcctagagttcgactagttcagcatatgacacattttgttgaccagatgtccatcagcaccgatggcggcagtagcacctga

SEQ ID NO: 25681 - DNA, 324 bp, Glycine max
  Peptide Sequence Number=SeqID_117366
atgattcctggtcaagcccctgttctgaaaaactggttcccaatcgacaacaggattaaaatgctctggttgggtattgtgatgctgattgggctggaagtgcagatgacagaaaaagcacttcccctggtggatgcttctgatctgggcaacaatcttatttcgcatggttccacccgcaagatacagaactgtgtgtcctctctatcacccagcaacagaggatcaacagcaggaagggtcagctgttcacaacagtggacccctgcaccaagggcaccagactgcgctcaaggagtgacctcatgtgaccggaagaagtag

SEQ ID NO: 25682 - DNA, 204 bp, Glycine max
  Peptide Sequence Number=SeqID_117367
atgttgtcctctgatgaaaacaatgatccagagggaatggaggaaggaattggtgttcctgtgacccggaatgccgttgactccgactcgaagtgtcctttcgcttcttcgatggttctgccaattgaagagatttttgagatttcaatcggttcaaataaaagagagtggaaaaagaagaagtttgggctttgtggggagtga

SEQ ID NO: 25683 - DNA, 84 bp, Glycine max
  Peptide Sequence Number=SeqID_117368
gtgcttggcacccctgtattatccgttaggcaattcgtgaaaattccggaacgcagtcatggtcacccgcgtctcgtcaaccag

SEQ ID NO: 25684 - DNA, 512 bp, Glycine max
  Peptide Sequence Number=SeqID_117369
gcggcgggcccgatgacacgcgagataccttacggttattcgcacccttttgtcatccagaggcggcgggcccgatgacacgcagagacaaaatttggtcattctgcacccttgtgtcatccagaggcggcgggcccgatgacacgcggagataccttacggttatccgcacccttgtgtcatccagaggcggcgggcctgatgacacgcggagataccttacggttatccgcacccttttgtcatccagaggcggcgggcccgatgacacgcagagacaaaatttggcggcgggcccgatgacacgcagagacaaaatttggtcattctgcacccttgtgtcatccagaggcggcgggcccgatgacacgcagagataccttacggttatccgcaccctattgtcatccagaggcggcgggcccgatgacacgcggagataccttacggttatccgcacccttgtgtcatccagaggcggcgggcccgatgacatgcagagactgacatag

SEQ ID NO: 25685 - DNA, 427 bp, Glycine max
  Peptide Sequence Number=SeqID_117370
atgggtgaccaagaggagatacaggaacagatgaaagctgacatgtcagctttgaaagagaaaatggcttccatgatggatgccatgctaggaatgagacaactaatggagaataacgtggccatcgctgccgctgttagttcgactgccgaagcagacccaactctccgagctaccgcgcaccatcctctcccaaacgtggcaggacgagaaagaagcacactggggcacatcaacaacccccatctgggatacaaccgagtggcttacccttatggattaccacctaattacacgccaccagtcatgcgtgatgatgcgggacatgtcccttccctcatccttgaagggagcctcctcgacagtcggacgtggttcacgaggatcgtagagagtatgctcaaggagacatcgatttctacccccg

SEQ ID NO: 25686 - DNA, 591 bp, Glycine max
  Peptide Sequence Number=SeqID_117371
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggcagcctgtaatcgattacaacatcctgaaatcgattaccagaaggcttattactcctgtaatcgattaccacgccttgtaatcgattacaactcgtcctcgtctataaatactcacgaaatcagagttgccgcgcagccaaggcctcccctcgtgcctcctccatacctaaatcgtccaaccttcgtatcttactcaaatcttcaccaaatcacgtcccgtaaagcccaatcttcctctttttcactcctctttcacttccaccgattgaaatccactaaaacttcatcaaatggcagaaccatcgaagaagagaaagggatcatcctccaccgccactgctgctgtccatcgccgccacggaccatccgaagcacccacagcacctattcatccctctttgtcatctccaaaatcatccacattgttttcatccgatga

SEQ ID NO: 25687 - DNA, 480 bp, Glycine max
  Peptide Sequence Number=SeqID_117372
atgctgatcaccctcggtgctgaacgcacggcttgcatgtcagctgacgcgcgtggtgcatcttggcgaacccgacgcggcgctgcgccagcgcattgtgacgctggcggagatcacgccgatatgctgtatgccacccaggcgcagcgcagctggtcagcggtttttgccgacatcactcaggcttatcaacgccacggccacgctgaggcatggcgcgatcatcatcagggcggtccggccggctacggctgccgcgactggattatcactccggagagtcgcggcgaggtgcagcccgacaccgccgtggcgtggaacccgacgctgagcggcgtgaaaagcgaagacacttttttgctcacccgtagcgggctggtgccgctcacgcgcagcgacagctggccgctgattcgcctgcagcgcggtgataataccttagagctggccggctggctgattctcccgacatcctcataa

SEQ ID NO: 25688 - DNA, 723 bp, Glycine max
  Peptide Sequence Number=SeqID_117373
atggggtcaagtaaaacgccttctcttaaaaagaggttctatcaagtcaaggtcaagagcctaggaatcaccagtctaaaagagttagggcagttgatgggtcagctccagcgacaagcttttcacaaagcttacggtaaaatctgggacctagccatggcagaagtctccacagaggtcattgcctccctcgcccaatattatgaccagccgttgagatgcttcacttttggggacttccagctatcacccatgatggaagaatttgaagagatcctaggatgtagaggtgaatgggccccgttcatagacatcctcgcacttttgatcttcgggggagtcctctttccaaatgtagatgggttggtggacttggcagcgatcgacgctttcctcggctatcatgaccgcaaggaaagcccggttgtcactatactagccgatctatatgacaccttcgaccgaagatgtgagaagagcagtacaaggattgtttgctgtactccggccctctatgtatggttggtttcgcaccttttttgccaagaggtgaggcttgcttgcccgctagaaagccaccgttcatgcacagagaaaagaggggcaaattgggaccgactcttagcaagcaaagaagagcgtctgtcaactggttccctcgatggaaagaaggaagaaccgagattcttatttcgtgcggaggatttccaaatgttcccttga

SEQ ID NO: 25689 - DNA, 210 bp, Glycine max
  Peptide Sequence Number=SeqID_117374
atgtatcctttcacggccaggctaggtttcgattgtaccaacaatatggccgaatatgaagcgtgcgcctttgggattcaagcggccattgattttgacgttataaagatagatcccgagaaagtgaagccattcttgaaatccagaccacacacgggaagaaacaagttcgaggtttccgataggcaggttgacaccttacatccatga

SEQ ID NO: 25690 - DNA, 402 bp, Glycine max
  Peptide Sequence Number=SeqID_117375
atgcaagacacaattgattgcaacaaaataaataagataagggaagagagaatgcaaacacagttttatactggttcggccacaacccgtgcctacgtccagtactcaagcaacccacttgagatttccactatctttgtaaaatccattacaaagtctgaaccacacagggacaacccatcccttgtgttcaggaatcctttacaacaagagactcacagtctcttaaccaatctcattaataagaagaatggaagaagaattctctcttcaagagaagaatattacaatgaagatcatacatatggtaatcgattacatgttgaaaattcaaattcaaaacctttttcaacagctatttctcaatcctgtcttcgggtaatcgattacacttcctggtaa

SEQ ID NO: 25691 - DNA, 276 bp, Glycine max
  Peptide Sequence Number=SeqID_117376
atgcagatagctgacaagtcatccaacagttttgtggcaaatacagagaagaatcccagggaggaatgcaaagctgtgatgacaagaagtaaaaggtttgtggagaatgaggaagagaagagtgttggacacaagaagaaagctgttgaagagaaaggtattgatggaaggaaaaataatgtgagagggaaactggagataaccatggcccttttggagaagctttacaggcaaaatgcccactctactcccaaattcttggagggatatggttaa

SEQ ID NO: 25692 - DNA, 522 bp, Glycine max
  Peptide Sequence Number=SeqID_117377
atgggtttaggcaaagacaacgacgacagaaccggccctgataagcgcccagaggaaaccgtgggaagtttgggtttaggctataaactcacacaagcggacataaggaaaaagcgttgcaggaaggaagagtgggggtcaaggcttgcgattggggcaagaattgaaggaggcccgccctgccacatcagtaggagctttataagcacgggtctaggacacgaaggccaagtcattgcgatatgtgaagatgattcgctgagtggatccgacgataagtccctcgaaggtactaatacctgggacccgaccatcaatttcgagcaagaaacaaatcaaacggaggataaaaaggacgaggatgtggaacttcccccggagttggagaagatagtcgcccatgaggaccaagaaatggggcctcatcaagaagagacagaactagtgaacttaggaaccggtagtgggaaaaaggaagtaaagataggcacgggtatgaccacacccatccgtgaagaatga

SEQ ID NO: 25693 - DNA, 426 bp, Glycine max
  Peptide Sequence Number=SeqID_117378
atggaaaaatctgaaaagaaaaatcatagtgagaagaaactaaagaaagcatacatcacatgggatgaaaatgatttggaatcctctgatgattctgaaaatgaagagataaatctttgccttatggcaaaacgttacgaaagtgatgaagagaagaggacatggcatatcaacttgctacttcagaaaaattacagtaatattaaaatgatatgggtcccaaaaggatcctcagttaatactaacatgcaaggacccaataaaatttgggtatctttgagaaagaagtggtacatagatagcggatgctcaaaacatatgactggagatgcatcaaattttacacacatatctccaaagaaaagcgggcatgtcttaagcatagcctgcttagcgttagtcaactatgtgacaaaggctatctag

SEQ ID NO: 25694 - DNA, 324 bp, Glycine max
  Peptide Sequence Number=SeqID_117379
atggtgggaggcataggtcccataactagacctcactctcaaacaagagaaaaggatagaaggtctcgagagagtattggaatgatcttaagagtgcccttaggaagagagacattccctcctactatgaaaaaggagcttatggacaagctccaaaggcttagacaagggagtgtgattgtcaaagaatatagacaacaaatggaagtactccttttaagagttggacttaggcaggaggaaagaacaagcatagctacgttccttagtgggcttaatatgaaagtgagggacaaggttcctttcatatggggacctagatga

SEQ ID NO: 25695 - DNA, 106 bp, Glycine max
  Peptide Sequence Number=SeqID_117380
tgcaattctccattctcaatcttttttcggagccccattgtcataccctaatttcgtccggggacctttgctcgatgacgtgcgaccattctttggtcctcgtgag

SEQ ID NO: 25696 - DNA, 643 bp, Glycine max
  Peptide Sequence Number=SeqID_117381
atgttagggattattggcggcaccgggctgacggcactggataatttgaatatttctaaacgcctgattgtgcgcacgccttatggagagccttcacagccgctggtatttggcgagatcaatggcaaagaagtggtgttcctggcgcggcatggcggtggacataccattccgccacatgcggtcaattaccgcgccaatatctgggcactgcattctgtcggcgtgtgtgacttgctgtccgtggctactgtcggcggcatcgcccgcaatttaatccctggcgatatggtgttgccaaaccagattctggattacacctatggccgcagcaatacctatcatgatggggtggagttgcctgtgcggcatatcgactttacacaaccctattcacaagccatgcgtgaacgctgtctcaaggctgcagcagatgtaggatatagtctggtggatggaggtgtctatgcctgtgtgcaaggccctcgattggaaacggcggcagagatagaccgatacgaacgtgatggtgcgacactggtaggcatgacgggtatgccagaagctgcgttggcacgcgagatgggtgtctcttacgccgcaatttgccctgtggctaactatgcggctggacgcggggata

SEQ ID NO: 25697 - DNA, 864 bp, Glycine max
  Peptide Sequence Number=SeqID_117382
atggtggcgggagaggcctccggagacttgctgggttatcacttgatccaggagctgaagtcaatgcagcctggcattgagattttcggtattgctggtcccaaaatgataagtttgggcgccaagtcgttgttcccgatagagcgcttatccgtgcgtggataccttgaagtgctcaggcatttatggggcttgcttaaattacgcaagcagctttataaacagatactcaaagaaaaaccggacgtatttataggcattgatgcgccggattttaatttctggctagagcgtaaactcaaggcaaaaggtatcccgacgattcattatgtcagtccatccatctgggcctggcgcaaaaaccgtatccacaaaatcaaacgggccgtctcacatatgctggccttgtttccatttgaatcagcgttatatcagcaagtaggggtgcccgtgacttatatcggtcatcccttggccgatgccttgcccatggagccaaatgccgggcagaccagggaaaagctcaagttgaaaaaggacagtgtggtgattgccatgctgcctggaagccgtcaatctgaagtgaacttccacgccacactggtgctcgaaacggcaattgtatttgatcgcttgatgcgtgaaaacggaaaaaaggtacagttcctggtaccactggtgacgcgcgaaacacgggacattttccaaaatgcctggcatgagctgctgacgcggctaccagataccagcatcgatttacaaatcatgtttggtcacgcccatgatgcaatgaccgcggccgatgctgtactggttgcgtcaggcacggcaacgctcgaggccgcgttactcaaaaaaccgatg

SEQ ID NO: 25698 - DNA, 297 bp, Glycine max
  Peptide Sequence Number=SeqID_117383
atggatctcattgaaaatatggctgcaagtgacattgctattttgagagatagagctcacattcctaccaaaaagagtttattggatttaacctccaaagatgcattgttagcacaaaacaaattgttgtctaggcaactggaagccttggctgaaacactaagatgtaccatctgtgggggagctcatgaatctggatgctgtattcctattgaagaacaccccacttgtgaagtcaattacatgggaaatcagcccaacaacaattttaatacaggaggattttctggattctaa

SEQ ID NO: 25699 - DNA, 474 bp, Glycine max
  Peptide Sequence Number=SeqID_117384
cacaagcctctgaggagggatttgattctgatgtgggcttttcttaccggtcgtcagatcgactgggctcatttggtttggtaccgaatgcataaggcattacgggccaatgcacctcttccttatccacaattgattactctgtttttgcgtcattttcaaattccgcttgatgatgagccctttgttcaagtcaagcgttcttttgcaattggtgctggtgcaatgacctccatgggtataaagatcggaagacaatggctgaagaaggatgcactccctcctcaagatgaacgtctccttccatacctccccctcaacattcacaaaaactttgccggtatggacattgagccttacacagctgaagaggaaagtcggatacatcctccagagttttgcccatcgccgccacagaccatcttccaccaccacctccgtcttctctccaagattttgttttcttccgattga

SEQ ID NO: 25700 - DNA, 110 bp, Glycine max
  Peptide Sequence Number=SeqID_117385
atgtccccagtggagtcgccaactgttgcaacctacctttcgcgggagggcaacaaggggctcacgggtgcgtcttccaagaaaggaaaatgcgtggagtcgccaccaag

SEQ ID NO: 25701 - DNA, 276 bp, Glycine max
  Peptide Sequence Number=SeqID_117386
cttggaggggttgatggggacccggtgctgagaggaatgaggataggggctacgtgggaagtggtacctgcagatatgttgcgggggtcaggagaccttggagacgtcaggcgagctcctggcagtcaaccaataaaaggacaaagtccacgaagcatggaggcttgtgtggcggctggccacctatgtatcttgggtggtatctggaaattagcctctggtaatcgattaccattcggtgataggacacttgtaaatgattacacagggtggtag

SEQ ID NO: 25702 - DNA, 606 bp, Glycine max
  Peptide Sequence Number=SeqID_117387
atgcgaggtaatcattacattgattggatggaataccatgcggagtggattaatatctggaaaaacaaacgtagtgatgttttagctggacaatgggttgaaggaatagtgacacatacaccagtgtacatggaatggtataggaaaaacactactttgttcttgtctgttgcacaacaactacatgatccacgcacagcaattacccataatgttacagggctaggtgttgaacaaacacattttgaaattccacatccttggtccatgtattctactccttcacctgttcatcaaacttttggccacactagcgagtcagtcaccgcaaccacccatgaatggatgaccgatttatttggcgtcgatttcaatacaccaaattcagtggcatcatatttagctactttacaacagtttgatgcaccacatttatttggagaacaaggtcaaagttcttcaactgcaacaaccaacattgaaaatactaacacagaacaacaacatcatcatgacgtgggagaaccagtcatactggaaagaagaaatctgcgacgtaatcgtcgtccaccaccttgtgggactggtcatcgtcttggtcattga

SEQ ID NO: 25703 - DNA, 456 bp, Glycine max
  Peptide Sequence Number=SeqID_117388
atgacacgcagagacaaaatttggtcattctgcacccttgtgtcatccagaggcggcgggcccgatgacacgcagagataccttacggttatccgcacccttttgtcatccagaggcggcgggctcgatgacacgcggagataccttacggttatctgcacccttgtgtcatccagaggcgacgggcccgatgacacgcggagataccttacggttatccgcacccttgtgtcatccagaggcggcgggcccgatgacacgcggagataccttacagttatccgcacccttttgtcatccagaggcggcgggcccgatgacacgcggagataccttacggttatccgcacccttgtgtcatccagaggcggcaggcccgatgacaagcagcggccaataccttacggttgtcattatcgcaccctttttgtcatccagaggtggcgggcccgataa

SEQ ID NO: 25704 - DNA, 654 bp, Glycine max
  Peptide Sequence Number=SeqID_117389
atgacattgaccatcccagagcttttcttgaggccttatcaggttagatgggatgccaccgtgttcggggtcattaatccagatttccccctgtacataaagcacgaagacctctccaaaatcgcacacggtggtcaatgtctcagcatatcagtgttacagttgtggattctgcatctcactgaaacatgtatgcgagcgggaaattctgatatatatggattcctcgagcctcagtccattcagaggtctgggcaatcgcagtttgaatctgaaagttacataaagagttggatgcagagttcacaacgcgatgtgtatcttggagcctacctaatgggttccactgcagcggacattggcagatggtggccagacaactaccttaaggggattattaatagtgctatcaagggtcttgatgatgctccacagcctaaatcaaaggctcctgctaggtggattgtcgtcaagtgtaatagacaaaaaggaactactgagtgcggctactatgtcatgcactggatgtccaccatcattttaggaagttttagaaataattgggaagcgtattttaacgaccctagaccattggagcctgagagattaaaagcattgccggatccagtgggcacagttttatctccgagttag

SEQ ID NO: 25705 - DNA, 973 bp, Glycine max
  Peptide Sequence Number=SeqID_117390
agcaccctggacgtgtccgtgctgttggagccggtgtcaccatcaagcaatacttcggatcggctcaacagatgtccctaactcttcctcgttgcctcctaaagaattgcagcagctgacccagcaaatcagggaccagctagaggagtcgatcacagaaaaagtggctcggcagcttatagcatcgttcaaccagacgcagtcccaggtgcagtcccagatgcaatctcagggactggcactgcctccgaagcctctggttggtctctcaagtcctcgagtaagcacaaacgagagttgtgttgatccctcaggaaatgatcctgagacgggtgactcagataggtgcgacttgtacatcgaagcaaatcctgctcgcctggttgccctggggagagtttatgagggatccactattgttcataacactcctttgtttcctggccaagtaaaggtgggtatggaggaggttaaagatccagatgcttcaattcttgtacccactgatgaggtttccatagtggggcaggcaattcacaccttccttgcttggccgacacatctggtcaagtctttatcacagcagacagttgtgtctccaacaaaaccacctccaaagttggatccagaggtcgatgatccactttatctgatgacattgaccatcccagagcttttcttgaggccttaccaggttacatgggatgccaccgtgttcggggtctttaatccagacttcccgctctacataaagcacgaagacctctccgaaatcgcacatggtggtcaatgtctcagcatatcaatgttacagttgtggattctgcatctgactgaaacaagtatgcgagtggggaattctgatatctatggattcctcgagctacagtccattcagaggtctaggcaatcgcagtttgagactgaaatggacattggcagatggcggtcatcatgcccaaggaacacctag

SEQ ID NO: 25706 - DNA, 330 bp, Glycine max
  Peptide Sequence Number=SeqID_117391
atgctgagaacaagagagggtacatctcttgtggatcagttcacgtggaaggtacatccacttgggttttcaaagagaacaagggagggtacagcccttgtggatctttggcttgtaaaggattttacatggttgaaagaaatcttaagaaccataggttgcttggggactggatataggcacggtgttgaggaaagaatccctgagtttcaagaacctatggatttgagggcattggatagaaaactccaagaagattgggccaaagatgcaagagaaggccttaaggttctcatgagccttagggtagattttgggttcatgggttaa

SEQ ID NO: 25707 - DNA, 360 bp, Glycine max
  Peptide Sequence Number=SeqID_117392
atgtacgaaactgatgatggtatcacatttgaaggccctaaaaaagctattcaaataaagcgtggtattagttttgagagttttaaaaaaggatacacgacaagatttttagttgcaggtaaatatattgcactgcaaatttgtgacgatgaagatgttgaaacaatgattcaaagttttgaacaacaacaagaaatgtctgtcatagaattatgtgttgaagttgatgttgcgggtacttctgcaattaatttcacaaattcattgttatcatgcggaaataatatgtctcacaatgaatcgggtagtgcaagagttggaacaaattcagaagaagattttgatgattattattattaa

SEQ ID NO: 25708 - DNA, 420 bp, Glycine max
  Peptide Sequence Number=SeqID_117393
atgttgagtcaacatcccaatatgttaaactacactgactctgtgatgaagagagaatcgcctctatccctgcattacaaattgtttgaggggacacatgtcccagacattgtctcgacatcagggaaagctgctgcttcaggtgctgtgtccaaggatgccttgattgctgaactcaaggacacatgcaaggtgctggaagcaaccatcaaagccaccacagaaaagaagatggagctagaacggctgatcacaaggctctcagaaagtggcattgatgatgaagaagcagctgaagaagaggaagaggcagctgaggaagacaaagaagcagctgaagaagaagaagaagctgctgaggaagaggaagatgcagcagaagagacagaatcagatgatgattctgaagccaccccatga

SEQ ID NO: 25709 - DNA, 648 bp, Glycine max
  Peptide Sequence Number=SeqID_117394
atggcagaacaagctaaacatttattttatgttcaagacccttatgatgaacggtggtcagtggttctacatgggaaaacaattggtgttaatgttgaagacgatgattcacacattgatacttatgttagtcctttgtccacacaaatgttgcctaacatcgttggagaagaagaagctaacaacgttcatgttaatccaaatgactgtaccacccagctcctctcctcctcctattggtgcagcatcaattcccctcctaccttgaagcggacaagaaaagccacacgcctgagatcattggctactagaccagttggggcaaagagacccctggtccatgtggatcctgagatcgagaaagtcgatggtccccacagaaagaagttaagaacctatttggggatcgtcgcttgtgataagatggatgctaaatttggtatccctgaagcatttgatctgaggaaaaaaaagaaactacttcaaactgtgggggagcggtggagacaatttaagtctgatttgacattgaaatggacacttgtagtcgacaaggacaatatcaatgacactgtatgcgaaaagtacaacattagcaaggagaagtgggcccaattttgtcagagtcgcaaagacccttcgtgggag

SEQ ID NO: 25710 - DNA, 339 bp, Glycine max
  Peptide Sequence Number=SeqID_117395
gattataagcagcaaagaccttctcaagaacttgttgccaaagatttgcatggtgtggagtggaaatttcaacatatttacagagccaaggtggcatctgctcacagtatttttgttagccaaaagaatcttgtttctggagatgcagttctctttcttaggggttgtaggtgcaattacaccttggaactttccccttgctataattactcgaaagttggtccagcccttgcatgtggctgtacagtggtcataaagccctctgaacttacacctctcactgctttagctgcagtggaactctccattcaagttggaataccaccgatagtttggtga

SEQ ID NO: 25711 - DNA, 201 bp, Glycine max
  Peptide Sequence Number=SeqID_117396
atggtgttaaaacgaactatagcggtttgtggtggctactggtggttgtgggtggtgaagaagaagcttgggacattgaggaagggttttgaaagaaagaaggagaaaggaataagtgttttccaaggctacacgaaaaacaaagcttgcaacactcaagtgtttctgctctcgggaaaagaagcgttgctcacacactag

SEQ ID NO: 25712 - DNA, 243 bp, Glycine max
  Peptide Sequence Number=SeqID_117397
atgattagtcatatgaacataactgtagaagcaaagcttcatggtgaatcaaaggtgattaaaaggtgttttgatgataacaatgatgatgacaaaggtgatgacaaaaagctcaaagatcaatcaaagaacaactcaagtgaatcaaagaatcaatcaaagaacaactcaagtgaatcaagaacaattcaagagttcaagataagaatcaagaagaattcaagactcaagaagaaagtttag

SEQ ID NO: 25713 - DNA, 432 bp, Glycine max
  Peptide Sequence Number=SeqID_117398
atgtctgggccatccgacaaggtcagtggcccaaagcaagtgacaaagaccctggaagatcagtgcacttcgccccccatgaacatacacaacatccaacgtatgaacgtggcccaaagcaagtgccaaagaccctggaagccaaaagcaagtgccaaagaccctggaagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcgcgcattaa

SEQ ID NO: 25714 - DNA, 1416 bp, Glycine max
  Peptide Sequence Number=SeqID_117399
atggatacctcagagccctacaatggggcaatgaaaggcaccatgcataaacctcaagcaaacctaggggcagataagaaattctcacccaataggttccctactacaagggtggacccttgggtactagtacctattgcctttagagggctgcacaccctcaacttcagaggactacacatcctcgccttaagagggctgcacgtcctcgcctttagagtgctgcaagcccttgccttaagagggctgcatgccctcgccttcagaggactacacgtcctcgccttaagagagctacacatcctcgtcttaagagggctgcatgccctcatcttaagagggctgcacgtcctcgcctccagagggctgcacctccttacctttaaagggctgcacgccctcgccttcagagggctacacgccctcaccttcaaaggaccacgcgccctcaccttcagaggaccacacgccctcgcctttagagggcttcacgtcttcgccttcaaagggctgcacgccctcaccttcagagggctacacgccttcaccttcagaggactgcacgtcctcgccttcagagggcttcacgtcctcgctttcagagggctgcacgccctcacctttagagggctgcacgtcctcgcctacaaagggcttcacgtccttgccttcagaggactgcatgtccttgccttcaagggattacacgtcctcgcctttagagggcttcacgtccttgcctttagagagctacacatccacaccttcagagggctgcacatcctcgccttccgaggactgcacgccgtttccttcagagggctacacgtccttgcttttagagggctccacatctgtgcctttagggaactcaagaccgctgcaaggagacgagtgcggatcaagcgcaccaacatatggataatgttgctacttagcaacattctgcccagccaccacgactctgatctccctctgctgaagtggatcgcacccacaagacacccagtggacccgaagaagtccaacagggtcctggggtttccagctctgattacgggcctctgtcagttctacagagtgcttgtcgccctcagcaagggtgaggcaccacagcgccctggggacggccaacagcgggcaacagacacgcctctaccacctctagagcccctcaactcatctacaaaggatatagcattgcctatgacacgtggccgactagctggtgaccaagtccaaagccaaagctcctcgcgaagaggtccaggaagggcaccattgaagagggttccagtatggcctcgcaagccggcacaggctttgacaaacaccgattctagaccgtggaacatcagtagcgtttcgaggccatcgagggatggtcattcctcagacagagacaagggcagctga

SEQ ID NO: 25715 - DNA, 367 bp, Glycine max
  Peptide Sequence Number=SeqID_117400
tgctggtgcagatgactttgggtcttcaaggactggagttggtgatggggatgacttaggaacaagctctgaggcctcaccccctcccgaaggagaaggctggactcttggtcaagccatcttgctaatgaactcatccacactcatgatagagctgactgtggaaggtcctgaaggaactggagcaggaactggcaaaggagtggatgaagctggggcaaaaagagctgttgtagaagtcgaaggagctaaagctggagctggtaaagatgaagctacagcagctgaagctggagctggtaaagatgaagctggagtagatgaagctgcagtagaagtagaaggagctggggtagggagaccataa

SEQ ID NO: 25716 - DNA, 501 bp, Glycine max
  Peptide Sequence Number=SeqID_117401
atgatttatcatacagaatttgatgagttcaaggctgagttggaaagaaggaattggcacaaggagctgaccaatttcatggatgggagcatcgatgttgccattgttaaggagttctacactaacctttatgatcttgaggataaatcacctaagcaggtgagggtgagaggccacttaattaagtttgatgaagacaccctaaacacctttctgaggacccccatgatcatagagaagggggagaacctgcctacttactccagattctatcgtttgaggcaagatccacaggaactggcagcccgactatgcatccctgggaagggatttgagcttaatgctgatgggctgccattgaagatcttgcaaaagaatctgaccatgcttgctcaaacatggagcgttttatcattctctaacttggcccctagttctcacacgtctgacatcacactggacaaggccaagttgatctatggcattattcagaagatggat

SEQ ID NO: 25717 - DNA, 499 bp, Glycine max
  Peptide Sequence Number=SeqID_117402
gtagcagatgaccataatttgtcctcgcatgctatcggactcgcttgtctctggatagcaagggtagcggatgaccataatttgtctctgcatgctatcggagtcacttgtctctggatatcaagggtggcggatgaccataatttgtcttcgcgtgctatcggactcccttgtctttggatagaaagggtggcggatgaccataatttctctccgcgtgctattggactcgtttgtctctggatagcaagggtggcggatgactataatttgtcttttgttatcggactcgcttgtctctggatgacaaatgagactgtggcagatgaccataatttgtctccgcgtgccaatggactcgcttatctctggttggcaaagggagactgcaataaaaaggtggcggatgaccataatttgtctcagaatgctatcggactcgcttgtctctggatagcaagggtagcggatgaccataatgtagaagcaaagcttcatg

SEQ ID NO: 25718 - DNA, 2961 bp, Glycine max
  Peptide Sequence Number=SeqID_117403
atggccaaatcttcaattctaagcatttttattactttgctacaactgcttatggtcctctgtttgtccgctgcttacaagaatttcatagaggagtcttcaatagtttatacatacgatcgtgttgctgaaattgagaaacactgtaatccatatcttacttcatcatccaagtcaattcctgatgaaaatagaggctacacacttcaaacagaactctctttcactaatggagattggaatcaggagaatggcggtttccctttgatgccgttcgatgaaagtgacttgcaagggcataggatccatcatggaacagatccattacaacttgtttcattccaagtgcaggataccaatgtagctcatcaatttgaaaacgcttcagttaatgttggagggatattgtccttagccatatctagaaatactacattttacccttctcttcggtcgccgtcttttaccatgattcctggtttctccatcctcactgttgtctttgaaggggtctattttgaaagtgggcaagatcgtttattgtgtcttttggggaacacagctttacccatatcagaaccccatgttgaaaattgggacatagccaatagccattggcctggttatagccacctgccacatcttttgcaagatgatcagattttgcttcttcttaggtaccctcagacattcaatttgactagcagggctataaagggtgaaattagaagcataagcaaacatggaagcttgaagtactttgatgatgttcatatttcttctcagctgagtcggtattccgaatatcagtttagtcctgaattgatgccaagatcttgtgaagataaacacctttgtcaagaggatttggcacaatatgatgcgctcacattcagtggctatgagttttgcagaactctccaaagtatatcagaacctttcaatgttgtcccgcataataagttcactgataggtatgcttaccaaagcaaagtaagacctcaccaaccaggaaaggaatttggctttggtaactggagattgaaccatgaaaatttcaggcttatcttgcagcatgtaatatgtgaggaggaacctagaaatcataatataaaaaatgcaagaatttcagcaacactgagactgtttcctacgtccattccagaagacactgcaagagatagaacaggcctctccaaccttactttgttagctgaggggacatgggattcctcaagtgggaaactatgcatgattgggtgcgctggtgaagttgatcctattttggaagattgtaactatcagatattcttgtactttccacgagtgtactccatcaagcagagaagtctcatgctggggagtatatccaacattgcaaatgaaacaaacatgttcttccctctgctgattaattatgcaccgcgtccggtgtttcttcatttgagtcatggtccgtgcggttctcacttatcatataattactcaatgatccagctagcaacttcaattagaaggagagaccagtcatcaaaattcagacttctcaagcaatcatcattcttgaagtatccagctttggatgatgaacaagatgtacttgcttctcagcttcgttttctttccgcgaatctcatttttgatgcatttgcaatttgcaagcattgctcagacaaacataactcaagggtcttcatccatatggatgtgttttctttaggtccatatgtaccctggctgcgtaaagatgatggatcaaagaaacaagtagaaactgaaaaactcactagtatccaaattctcaatatctcattgcatcttatattcaatgaaggatcttcagtgtttacaatcaagcaatatagacatttgtcacctttattcttggaaggtgtatatgatcaactagctggtcaaatgtctctaattggttgcagaatggtttcaaatgtcagcaccaatgttggacatggcctagattgtctcgtggatgttaaggttcagtaccctcctttaactggaagatggctgaaaaatccttctgttgaaatgactattactagccaaaggcatgaaaatgaccctcttcattttaatgctgtgactcttcagacagacattattccatacttaaagcatcacgatgatgtggccttcagaaaactctgtgatggagttcttaggatgctgacttcatgtgctcttgtaggaatcatcttaagccaactcagttacatgaacagaaacgtggcttccattcctcacatatctcttgtcatggttgctgaacaaattcttggttatggtgctgagttgtttggggatactgagatacttgttgaatcatctcatgatcttcatgataataaacacatgttgaatcccatagaaatcatgacaaggcttcttgtgctgattgccttgcttctcactataaggctgtacaagaaggtgtcacaagctaagaaaagacaaaacgcttatggatctgctaaggaaaagcgcctaccccaacataagaatgttgttttatggaacttcaaggttcacattgttgtgtgtcttgtgctaacaggtctacttgcaattgagccttctctcagaaacaatttaaggtctctaagcttgatagattttcttcttctgtctggcatcttgattcgacaagcgcatatcctttgtgctcaagacctttttctggttcctcaagctcttgagaagtctgtgtggcaaagaaaagttaaacctctgaggaaaatgtactatgttggactcacattgctaaggctaattctcttttcctatgactacatcagagaccctattctagatccatactctgataatggtgtcgagggaaggagcctaaagtatgaagaacctcgggatttgaggtcaaatcctttccaaggtggaggggatgatgcaatcctaccccccgcccccaagggtattggatag

SEQ ID NO: 25719 - DNA, 411 bp, Glycine max
  Peptide Sequence Number=SeqID_117404
atgtttgcatcaggccaattttatgcgcaagtactaaacaaggtcatcaaagacgcacaaagaaaggcaaatgttcacattgttcttgagtttgatcaatgcaacacacgattcatggtccaagaagcaataatcgagagagaggttcggcctgctggagatttcacggtcaggctagatgaacggtggtgtgactatgacaaattccagaaattgcacatgtttttgctactttgtctccaatgtatacaaatgatttgtcctgacccagacaagaaaagaaattctaagggttgccctaccttctctcgtatccacactgaaatggatatccaagaacctggtcaaccaaagcgatattctatgtgtcgcatctcaggtcattcaaagaaaaattgccccagtgtatag

SEQ ID NO: 25720 - DNA, 885 bp, Glycine max
  Peptide Sequence Number=SeqID_117405
atgtcaaaggttgaaggttttaagtacgaggaacttagaatgcagagaattacagagaatcaagcaaaaatagaagctttagggttgtccaaattggccatcattttcaaggatagaattcaaaaagctaagaaaaaggataaaaagccaataatgatgatgaagactatgtacctaaatatgaagggggacttggatcaaattcttagtgaaaattacaagaatgacaaacgtgatgagtttgctgctacaaatgatcttaagtcacggaaaagaaaggtgataaaatcatcgatattgaattctaaaagagtctataatgattcgtccatacaccactctcttgataaagaagtgaaggagtctttacctaataatgcatctcatgcctcagaattgaccaatgtagaacaagttgaatcaaatgcaggccagcatgtcataaagaagggacgtgggcatacaataaatgcaaaatttcaaaagaaaaaggaaaatcttatggcaaaggaaaaaagtatcgacatccaatttcctccaccattttataagatttacgaaaaacatgcaaaatatttcaagtctgagacacaagtgcgtattcaccagaaagctcctttacaagttaatggttggagtgaaattagtaaggatgatgtagatgaaatgtggcgacatatgaaggaaagaagcttgacaaacaaagcaaatagaagcaagcaagaaataaaatcaattattggcacaaaatcaattgtgcaaaaggcatttgaaatgaaagaagattcaatatctggtgagtggtcagatgttgtggaagtttggaaggccacacacatgagttctaatggaacttggtgcattccaaaaggagaagaaatcatg

SEQ ID NO: 25721 - DNA, 96 bp, Glycine max
  Peptide Sequence Number=SeqID_117406
atgaagaaagagtgtcccaaggttgcctgtggagccgactgccaagtgatgatgaaaggttcatctttgtgggtgatggcaagaagtttgcggtga

SEQ ID NO: 25722 - DNA, 276 bp, Glycine max
  Peptide Sequence Number=SeqID_117407
atggttcatcaaaagctcttcttttggaatgatgatgcaaacttggagatggttgaagctgaccattcatcctatggaatatatgttgcctttgcaagtgaaggtgatcaagcaatggcaataactgctccattcgaagtcaaagattcattctatgtgaacaagtcaggtgaattcttgggttttgttattcatcaaaagggaatcgaagtagataaaaataaggctaaagccattttggagacttccccttcaaagaatcggaaaaaactttag

SEQ ID NO: 25723 - DNA, 408 bp, Glycine max
  Peptide Sequence Number=SeqID_117408
atggacgtggcagtggtagtcgtggcagttttcctgatcgtggtgctagacatagtgatggtggctccggaagaggttgaggtggtggccgatttgccaattttcagtgtcaaatttgccttaaatatggccacactgcaaatgtttgtcgcttccaccacacttcaaccaattccttactcctctagttttgccagaacctccaatacttggattaatcccaattccaagcctgtcgttccagcatcaaatcaacccagtgctatgcttaccaattcctcctctcatggaaatggtcatgctagctccacctggattccagactctgctgttagcttccatgtgactggtgaatcacagaatatcaggcagttcactcactttggtggactgatcagattttcatag

SEQ ID NO: 25724 - DNA, 834 bp, Glycine max
  Peptide Sequence Number=SeqID_117409
atgtctatcgatcgagactactttagtctccccctcgtcatccagagacaatcaagtccgatgaaacacaaagaccaacatagttgtctgcaccctttttcgaagactcaatgtccatcaaccgagactactttagtctaccctttcgtcatccagagacaatcaagtccgatgacacatagagaccaacctggtcgtctgcaccctttgtcgaagactcaatatctatcgatcgagactactttagtctccatctcgtcatccagagacaatcaatctccctctgccatccagagacaagcgagtccgttggcatatggagaccatcatggtcatcatctacatttcaaagatgacaatgtcttcagtcattgcatgctttcaaaaggcgacaatgaccttcatctatatttcgaagatgacaatgtcttcagtcattgcatgctttcaaaaggcgacaatgaccttcatttgcatttcaaagacgaaaaagtctttagtcattgcatgctttcaaaaggcgacaatgaccttcttttgcatttcaaagacgacgatgtcttcagtcattgcatgctttcaaaaggcgacaatgaccttcatctatgtttcgaagacgacaatgtcttcactcattgcatgccttcaaaaggtgacaatgaccatcatttgcaattcgaagacgacaatgtcttcagtcattgcatgccttcaaagggcgacaatgccaccatttacgctttcgaagatgacaatgccaccatttacgctttcgaagacgacaatgtcttcatctcaaaaatttcaaatgtcttttgtccttgtgcttcatag

SEQ ID NO: 25725 - DNA, 276 bp, Glycine max
  Peptide Sequence Number=SeqID_117410
atgaaagacaaaggtgaggactttgagtcctatgaaagtgaggcaaggactttgagtcctatgaaagtgaggactttgagtcctatgaaagcgaggactttgagtcctctacaggcgagaattttgagtcctatgaaggcgaggactttgaatcttctgcaggtgatgactttgagtcctatgaaggcgaggactttgagtcctctaaaggcgaggaccttaagtcctctgaaggcgaggactttgagtcctctgaaggaagccaataggtactag

SEQ ID NO: 25726 - DNA, 708 bp, Glycine max
  Peptide Sequence Number=SeqID_117411
atggctctccatcaaccgcaacagggtaatgcttttcaaaatggaatattatggaggcaaaatcagatcatccagcaaatgggagctcacaaggacacagggtgggagtggaactttatatggaggagaccattgtttgacagtgagatcgccatggctggtagtttccaaagagatgttgaaggcaagtcaatccacccacatagaagagatgattgggtttggaaagcagatccaagtgaggacaatcatgatggagcttttgaggaattatggaaattaaagattccaagcaaaatttcagtcttcgcatggagtaacatgaaagaggatgcagcccatttatttctccattgcagcaaaatccttcctatatggtgggaatctttgtcttgggtgaacatcctaggtgctttcctgcaaaatccaaggcaacatttccttcaacatgtaactggcttggctgatggaataagggctaacaggtggaagtgctggtggctggctttgacattgaccatatggcagcagcggaacaagatacttttttccaatgacaacaaactgttggatgatgcaacattcttactttggacatggcttagaaatttggagaaagattttgtaatccattttaaccaatggtcaagtaatcttacagaaggttttgtttatcagccgagggtagcagccataggatatcagtag

SEQ ID NO: 25727 - DNA, 831 bp, Glycine max
  Peptide Sequence Number=SeqID_117412
atgactgatgtgcacagactagaatggcagctggatagtattgttgttggtggtctgaaactgtatgtcaacattccgaaatatgggagagagctagcgagaaatgtagaacaagaagctgctggcaaagcaaagggtttcaatgcaagacacgaaactggcgcaggtggacaaagacaaccacagtatacaataactctagcctcgtacgcgacggtggcggcgagaaacaccaggaactcagggcaaaggtggacccaagagactgtgattcacaggcaagaaggatcacacttatcggttcagctcaatatttcaatggatgagaagaaatggttcaacgatgtgtgggtgggagttgaagatgagctttcgtgggaagtaggagtagaaatagtgtcgaagtacatgggggatgatttggttctattactaggcctcaccgatgctagagcagaacacatgatccaggaagaaaccacgaatggatcctccctgtttcattcgttggagaaatggaatccgacgatgcgaatagggtacagcttgggacacgacgcaaatccagaagattgtcgctacgataggggacatggtggaggtgttttttttttttttccccaccttgttgaagctccgagggtggatagagtaagggtactcatcaaaacaatgtggcggcccccaatccaacacatggtcaacgcgcacattggcggggagatttacagaatacacatcgtggaagaaaatgggcctagcacgggaacatgcaactgtcgattcaggagcgctttcagatcatcagaggaaatcgaggggatcctctag

SEQ ID NO: 25728 - DNA, 720 bp, Glycine max
  Peptide Sequence Number=SeqID_117413
atgcaccggacatactttcattctacttcacaaggttcccagaagacatgggagaaaaggaactatagatcgagttcaagaagtggggcattgtcagggaggtattcatcgcaaggaattgaaataggagtgctcgtagatacgggattgaagctacacgtgaacctcccaaagcacggaaggaaacaaaatccgacagagacaatcaacaagaaacacaaagaaaaggaggagatagcaatagagaaggtggaagagagagacaaaggtaaaggaaaggggacagcagaacatatgacaatgactaaaggattacagcagcagaatccccaacgagcaacaggtttcagatcgtatgtgaatgtggttgcaacaggcagtaagcatctgacaaaacgatggacaccgaagtatgtgcaggcatcaaatatgaccgctcactcatctatccaactaacaatatcaatggataagacatggctaaccaaagcttgggtaggtagactgaggaacctaatggcatttgataggcttgaagaagaacttatgtgggacgaaggtgaagagattaaaccaaagtacattggcggcaacatggtgatgtgctgggggattccgttacacgcatgtggaaaacatcacaaagagcgtggatgggattggggaggtggtggatgtgacgaagacgtagatgatctccaaaggctggataggacatga

SEQ ID NO: 25729 - DNA, 195 bp, Glycine max
  Peptide Sequence Number=SeqID_117414
atgggcgaggaagagaaaaaaccagaggaaaacaaagtggaggagaaaaaagtagaggaagaagaaaagaaagaagaagagaaaaaaccagaggaatcaaaagatgacaaggaatccaaggaggaatctgcgctgccagaaatcgtgcaaggcacaaccttcgcaatgcatgaacactttgagcacaatttctga

SEQ ID NO: 25730 - DNA, 411 bp, Glycine max
  Peptide Sequence Number=SeqID_117415
atggaaaggagttcgtcatcgtacacctctgaggctcgaagtcgtgtgttttgtatgtgtaacatagaggctccactagtgacatcgtggactgaggaaaattcagggaggcgtttttatggttgtggtctatacaaggtaggaaaagggtgtaatttttttcagtggcatgatccagttggcaacaatcgtcaaaagaagatcattgtagccttgatgaaggaggttgatgaattgaagttgagggaaaagggtttgcaaagcaggatcagtgacatgaagatgaaggaaaaatattgtcatagtaatgatggtatattggttaatgatgttatattcaattgtgatggtatgggtgagggtcatttcatgaaacataggcattttttgtttcggttgataaaaagttag

SEQ ID NO: 25731 - DNA, 1095 bp, Glycine max
  Peptide Sequence Number=SeqID_117416
atggacgatgtagcaatgagtggaactcaaaatacttgtttgaatgatgaaacactttggtgtcaaaaccctaacaagccggtgtccaccccgacactaaggtcgatgaaaaacgaagcatattccaaatcgaaggcaactttgaacaatattgaaaccatattcataccaggggacgacgatgatgaatttatcaagctgttgccaatgggaatgaagggaaaatttgtgactcgggaaactaaaacgacctactcatctccgaaaacagtaaacctttcaggatcgaacaaggtgaacacgacagatgactcgttcccacccaaaccattcatgagcaactacgttactggactgacagcaaaggacatgccctgctgcttcaagccaactgtggacatgaatcttacatttgaggagacacaggtttgtgcatatgtgttcaaccctaatgtggacccgagtgggaacgaaattttatatagggtaggaaacaacttgggcacacgacaaacctttcagtcgttgtgtcccaataagctagtaagggaggagataatactattcatggctttgaaggttgcttacagccaactctaccgcacaaggagtgtttggtgtatgccaccagcctttgcggtggatgtcattaatggaagtccagtggaaactctgattcaacattatggaaaggattgtatgcctccattttccaacttgaacctgatttacattcctattgttcaaaattcagatcattggtatctcatggccaatgtcatgctcagtgttctagaaattgtgtttccaacacaagaatttgttattggctttgatggaatggattcttgggatattgtggaagccagaggaatcccaaattgtggatccagtgagaaatcagcattatgggtcctagaatggatgcaaatggagaagtcatttgtcagtctcttgtatggagtgctagaagaaagggccgtcagaatgaaggtggcaatgatcctgctgttagggacacacaaccagtacaagggagacttgattagaaatacaaagcgaaattggcatgactgtatccatgcaaaacactga

SEQ ID NO: 25732 - DNA, 264 bp, Glycine max
  Peptide Sequence Number=SeqID_117417
atggaggcgcttgcgggaacaagaaggagaagacacagaacgacagaagagaggtgtcttcctgttcaaccgcgtccggtgacggcggaggcgacggacaccgcgtcgcaccggagtcgtacgctcatgcgtgtccggtgcgagttcgacgcgggacacgccggtgatgagccgcgtccgttcttcatagcttgtattagagtaaaaatagcagcacttcaagtatcagaatacaagagttatgtgttagaattaatgtctcat

SEQ ID NO: 25733 - DNA, 150 bp, Glycine max
  Peptide Sequence Number=SeqID_117418
atgacattccggttggctgaggtaggtggcgagagaaaatgttggagtaatcgaggttttgatgaggtgaagatgaagaaatgtaacggattacaagcaacagacacgcaaaacgaaatccatattgaactcatacttataggcatgtaa

SEQ ID NO: 25734 - DNA, 201 bp, Glycine max
  Peptide Sequence Number=SeqID_117419
atggaaggtcatactttgatgtaccacgtgtcgcaacgtgccctttgcgggcgagcgagggcgaggctcacgggtgcgctttccaaaggaggaaagatgcgcggagtcgccaccaacgtttatttgtggaaaacgtcggaaaaaccgaaggaaactggtcaaaatgaaaattctaagttcgggagttgtatttacgtttga

SEQ ID NO: 25735 - DNA, 1509 bp, Glycine max
  Peptide Sequence Number=SeqID_117420
atggagagcaaatccaaaggggagagaattgaaaggcacaatcgaaatcggaaaaatgaaaatggcttcaacagtgcagacccaagcggaactggaagaggccaaacaataagttcagcgcagcaacaacaagagcatgttgttgaggatcctcctatggctgtagaggaattgcacgaagagcagcaaaaagcacctgttgaggatcctcctactgatgttgagggttttctaggtggaccccatgacacatcagttctgagtgattatgaaaatcacaatgctttcaaaatctggaatggagaggaacgtcctgagttgaagttatcttcccttggaaggaagatgactaagtttgggaggctggcactagtgattgaaggccttgaaactagtagtttccatttgcccgtcggagaggtgactatcaccttggatgacatggcatcgttgctacatttgcctatcgtaggagcgttccacaacttcgagcaacttcatgttgacgatgctgtcgagatgttgatgaagatcaatgcatgtcattggattgtagcagcgcgagcgtatttgttgcatctgcttggatgcacactctttgctaacaagagtgtcacacacgtgcatgtggtattcttggatgcactacgtgacttgacgcaaagtgtgacttatgcttggggcgctgctgcacttgtgcacatgtatgataatttaaatgaggtgttgaaaagcacgcatttttcgtctattggctccgccttagctgccgaggattatgatgggaggagaccacgcacatgctggtggacctttggcaaggcactgcccgtgtcgacgtatcacaggtatttggaaagactgacccctgacatagtgtgctggattccatatggtgaccatcgttcatttagagaatttgaggtcatcacgttgttttccggccatctcagatggggtcccttaatggtcattcaccgaccagagagggtggtacgacagtttggatacatccagactatttcgtcacatcctgctacgacttcggtttcttttgaagaaatggacgatagatggatgcagttcagtgactacattgcacctgtaggacaaatctgtgtagtgcctggccagtgttcaccaaattacatggattggttatgcatgatatcacacccattcatgagtccagcacaactaggggatcctcctagagttctgtcggttcagcaatatgacacatttgttgaaccagatgtgcatcagcaacaggtggcggcaacgacacttgatgaggcagatgctgatgtgcatcatgttggacatgcaatggatgcttttgcggcaattattgataagttggagaggctactgaacctgagaatcctgaccgaaggaatagaagcctatattgttgttgaagagtgtgtgggcatcacaagaagattcactagccaaccagctgtaggtcacagatcgaggcgtaggaggcggacggacggtcattga

SEQ ID NO: 25736 - DNA, 816 bp, Glycine max
  Peptide Sequence Number=SeqID_117421
atggccctatttgatacagggactgattcaaactgcattttggaaggattagttcctacaaaattctttgagaaaacttcagaaaaattgaccacaacaaatggcttaaaattaaagattaactataagttatctagtgcaattattgaaaatcaaggtcttaggattaatacaaactttcttttggtaaaaaacctaaagaacgaagtaatcatagacttgccgcatgcattctggaatagaagaaaacatattgtcgatctcccctatgagaaagactttaggttgaagaaaattccacctccttggtctgacatacatactcaagtagtcaaagatatcaaattcaaaatccaatctatcaaatgtctgtatctcccaattccgcaggcattcaaaattattgaaactgatgtatctgacataggttatggtggtatcctcaaacaaagagtccatgaccaagagcataatacatatagggcacctcaaattctctacctgactatctcacctgtgaattcttatagaaaaacggtcatgccacctaaggcaacgggaacctccctaagaggaggcagaagcacagaatatgacaaaggtgatgacaaaaagctcaaaggtcaatcaaagaatgagttcaagatagaatcaagaacacttcaagattcaagaggaaagtttatttcaagaatcaagattcaagagatcaagatttcaagaatcaagattcaagagatcaagattcaagactcaagaatcaagagaaagcttaatcaagataagtatgaaaaggttttctcaaaatttgagtag

SEQ ID NO: 25737 - DNA, 786 bp, Glycine max
  Peptide Sequence Number=SeqID_117422
atggaagttatacctaattattggctaacatcgctagatgtggaatctcatgaatctctggtttctggtgctgagtgggaaagtgaaagccccaaggctggtttttcttctacagcttcaggatggccttcctttgatgacatcaaatcatcttctctcacttattctttatcagcagaagagaaagcaactgtggcagtgctgcaattgcagcacagagcattagaagcttgccagaagttcttagttggggatgctggttctgacagtgacgaagatgatgaggaggcagaggatgatgagctgctagataatgattctaaagaatctgaggagtataagttctttgaaaaagtgtttgcagaagatggtgaccttaggagatattatgagaacaatcataaggaaggagatttttattgtttggtttgtgggggtattgggaacaaggtatggaagaggtttaaggattgtattggactaattcaacactccactgccatactaaggacaagaaggaagcgagctcacagggcctatgcacaagtcatctgcaaagttgtaggttgggatatcgatcaaatgccagctattgtgttaaaggatttggattcctcattggctggttcaaggaagctttttgttgagcccaaaaatcttgttgtgggttgtactggtgatacaaattcaaatttaagttgttttcacagggtgaagttgctaattctactgattaatcatactgaagttgaagctaaagctgaagctgctaattctactaattaa

SEQ ID NO: 25738 - DNA, 270 bp, Glycine max
  Peptide Sequence Number=SeqID_117423
atgacaatgtctgtgatgatgacaacaatatcggtgccaataccgatgggggttggtgatggtgttgatgtcgatggtagcaatatcggtggtaatggtggcaatgtcaatggtggtgtagatgtaccctctacttgtaccacaaaggatgtaccctccaatgtgttaagacaaagatctcaggcggttaaacctttgatactttgtgaatggggatacaaaaaattgtcagacgggagaagggagacaccaaagaattcaggcggttag

SEQ ID NO: 25739 - DNA, 78 bp, Glycine max
  Peptide Sequence Number=SeqID_117424
atggtggtggcgaccgaaggaggagtttgcggttcgattctagttggagatgtacggtatgtaattaatcaaaagtaa

SEQ ID NO: 25740 - DNA, 168 bp, Glycine max
  Peptide Sequence Number=SeqID_117425
atggtcaatgtcatcagctgctctaggtctttgaaagccattgacgaagatgtatgggaggtccttggagccggtccaaagtattatttgatcatgacaccgactccaacaacacggacacgaccagggtgttctagtcacccaatggcaacaggcagtacatcctaa

SEQ ID NO: 25741 - DNA, 180 bp, Glycine max
  Peptide Sequence Number=SeqID_117426
atggaaaaattaaagcgcctaagcatcccctcaggaatgcttagattctctaaccacgctagttacccacgtactgaccatccgacaaggtttttcaaaggaagcataagacatgcaatggcggttccaaaggcagaaaagatgcaaagacaagatgaaactaacaagaaacaagcatag

SEQ ID NO: 25742 - DNA, 270 bp, Glycine max
  Peptide Sequence Number=SeqID_117427
atggataagagcttgaaggtaggaaaagatgagtggagggagaaggagataaggagcacgaaattttatgcctcaaatgaggctcatgagaaccctagggtcttctcctacatctctggcccaatcttcttggagtctcctagccatggctctagtgatgggtcctttccttgggagaattgcatcactggatatggtgatgcaggaaacatgtatgctgctcagagttctggagccagggcaagtgctaaatattttaaattggtttga

SEQ ID NO: 25743 - DNA, 240 bp, Glycine max
  Peptide Sequence Number=SeqID_117428
atggtagaggcttgtgtggaatcgacgagcaaggacgaaaaggaatctccaagtgacgcgacaaggaacccgcgggtagctcacaatagggggctgtcactcggtagggaacacctttgggctcccaggctgatcacctatgggaggggggctgttacgtgcacaaccgggtggtcacgacaaactcagcacagttccctaatgagagtgtcgtgtggacacgctaaggctatttcctga

SEQ ID NO: 25744 - DNA, 475 bp, Glycine max
  Peptide Sequence Number=SeqID_117429
atggcgggacaagcacatgccgccaacagcaatggcgagacatatgccaacgtggaacgtgtcccgtcattgcttcttgcgagaccaagcaaaagcaatcccaccattactgttggcgggacaggaaaatatgttgccttgcaaatttgtgatgacgaagatgttgaaactatgatcgaaagttttcaacaacaacaacaaatgtcagttctagaattgtacgtagaaaaggatgttgctggtggttctatgtatcattttgcaaattctattacgtcatgtggacataatctatctcatcatgagtcggaactgccaagaaatataagcaatttacatgatgatgattatcttgcttctaactcatacgttgaagactctttggatgaagatgatagtgttgatgaaatatctgatacaaacgatgaagtcactgacatcattgaaccagtttcaattgttcacccaacagaag

SEQ ID NO: 25745 - DNA, 436 bp, Glycine max
  Peptide Sequence Number=SeqID_117430
atgattgatcagtggaacaatcaccatgcttttagggtcgacgcttatccccgacaagagggcctattgagctttaactcggactacatggtctggtataggcgaaagacaaagatgtttgttgacccacaaaatgcaaacacggctacattggctgaagttgcagagacattacaatacatggtgtctcctcaagagaggaatacatggacagttgatgatctcgtgccttatgtggagaaaattacaattttatccgaagagaaagagagaatcactgagcctgtgtcacatggtcctgcatcagagcgtcaatttccagcacaagagtttcacattcttctgtcaagtgttgaaactcagggcataggcaaacgaagggaggctgttgaagcggaagaatattcccaacaaatggcggagcgtgccatggaat

SEQ ID NO: 25746 - DNA, 276 bp, Glycine max
  Peptide Sequence Number=SeqID_117431
atgactcctcctgctgctttaactgaggaccttgcaccaaatggcgtcgtcgtggcagagagtcttccaccaaaaggcaacatggcagaggacattgctgccccaaatggggtcatcattgtggaagacgaagaagcaccaaacgatgccgttgcggcaccaaaaattgaagaaccgatggtgtcaaatgcaggtgcgggagaggaaaaggaggccaaggagaagaaggttacagaggaagaagaagcaaaggagaaagagagatgggacagataa

SEQ ID NO: 25747 - DNA, 156 bp, Glycine max
  Peptide Sequence Number=SeqID_117432
atggcatccatgtccaaggccatgaccccagaaatcaagaagcatgcatcttgcgccgaaggagatgattataacgggaatataaattatgtttttgcatatatggaaggtgatgacgatgatgatggtggttatgattatgctcccgcagcataa

SEQ ID NO: 25748 - DNA, 156 bp, Glycine max
  Peptide Sequence Number=SeqID_117433
atgctcaaagacgattgtgacagtaaggtacatttgatgttagccgctcatgcagactccttagggttccttttgaatccaaagcccatgtcatcaagttttagcaggattgacagaccattggcatcactctatgactttaaatcggtcacatag

SEQ ID NO: 25749 - DNA, 507 bp, Glycine max
  Peptide Sequence Number=SeqID_117434
atggtgggatatatgcctgtgagctttgcggatttggtgtttgcgggggaatggattgaagttagtttgaagaagggaaagtttgattatgctgcttcaatgaattctagtagtttgaggcctgagatgaatggagtgaagaagaaagagaaagaagcccatgtcgtggttgtggttcctacatgcgcaaacttctcgcaaaccccttacaaccccataagaagaagaagaagcaatcaatttaacaatgttcttttaaatgtgcaagacaaagtaaactgcagtaaaataactgagataagtgaagagaaaaatgcaaactcaatttatactggtttggccacttgtcgtgcctacgtccagtcctcaagcaacccacttgagattttccactatccctgtaaatcctttacagactttgaacacaccttgggatccctcacccttgtgttcaagattctccaagagacaaccagtctcttgattacaactgcgtttctaagatga

SEQ ID NO: 25750 - DNA, 276 bp, Glycine max
  Peptide Sequence Number=SeqID_117435
atggcttcctatggtggtgagtttcttcttgactcatcttctcctagaagtggtgtctccaatcatctttcttccatctccattccacttccattgatcttcaagaagcaaatgactccattgatgaagaagatccaaggcctacaagctccacatggagctacatcgtgtaggaattggaaaggaggattgatgccatcccttgaagaatttgagtcaagaagcaaggggccaaccaccttaagagctattggactaagaagcactccaaattga

SEQ ID NO: 25751 - DNA, 618 bp, Glycine max
  Peptide Sequence Number=SeqID_117436
atggatatagaaaaggattctgatattcctctaatattgggtcgttcattcatgtttattgcaaaatgtgttgtggacatggggaatggcaacttggagatgagtgtggaggaccaaaaagccaccttcaacttgtttaaggcaataaagcatcctagtgataacaagatctactttatggtggaagcaattgagcaagaagctgaccttgctaggcggaacctgaagtcaatccccttccattgtcttctcggggccaaggcgagtcaaggtcgaaccactccagacgctccaccagctccacctccggtaatccttcctccaatcaccttttctacagccgacaagcctttttccccctcttccccagcaagagcatctagtctagatgatgcagagccttcaccatggccatcacctcatcatctagaacttgcaccagctatccattcacctttctatgcaacctctactgatgacaccagaggcttttctatagcaggttgcctagccaggagtccaaccctcttctataggggggtgacacctctggcgtggaccttgtggcctcaaggactaacaagtggtatcagagcaggattcttgtataaagtttaa

SEQ ID NO: 25752 - DNA, 207 bp, Glycine max
  Peptide Sequence Number=SeqID_117437
atggcactcacttctaaggccattaaccaagaatgcaagaagcatgcatgtggcaacaaagacggtgattggtatctttattatgctcctacagcttgcactgaaggagatgatcataaaggcaatggagattcctgttttggccatattgcatacatgaaaggtgacgacgacagtgatatctatgactatgctcccgcagcataa

SEQ ID NO: 25753 - DNA, 294 bp, Glycine max
  Peptide Sequence Number=SeqID_117438
atggatgaagagcaatggagtgaggtcttggctttacgagttaggctgagtcggtatgcgcctatgtttgagatccatgaggtggatgatgaattacttttgatgttgaatttggaggatctcaaggatatggggatgaatatttttggttcaagaaggaaaattgactttcctggtgaagtacaagacatgctagcctatcagcatggactttgcatgaagaagacatgtgcatttaatgcaagtattaaatgctccaacaagctcaagactttagatgaagaaaaagagtga

SEQ ID NO: 25754 - DNA, 93 bp, Glycine max
  Peptide Sequence Number=SeqID_117439
atggcttggattgcaccaggatgggcactgagtggcctaaatagcactatacatcctgatgtcaagcatggtagggttgctggagaagcttga

SEQ ID NO: 25755 - DNA, 138 bp, Glycine max
  Peptide Sequence Number=SeqID_117440
atggtgtgtggagaaccgaaacggtttggggcaagaccgatgcatatgggggtattggatagaagactccaagaagattgggccaaagatgcaagagaaggccctagggttctcatgagccttagggtagatttctga

SEQ ID NO: 25756 - DNA, 561 bp, Glycine max
  Peptide Sequence Number=SeqID_117441
attcattccaaaaaaaataggcttgagcacaagaggttgcatgatttggtgtttgtcaaattcaaccaacaattgaagcaaagatataatgcaagagatgaaattgatccaatttctcttaatgatattgatgtgtgcaatgaatggctcgtgggagagatggatgaagatgatgataatgatgctggaaatgatttggtatttgaagatgatgatgcactaaatagggcaagtgtgtatgaggcatcgggggttggagagtgtaggatgtatactaggcggaaaaaaatggaaagaaatcaaccaacaagtgttgctgctgctgcccaaacttctaaaaaacgggcaatcattgttggatcttcatcaaggaagcaaaatgcaatccaagaaaatgatgaggatctagattttgagaaggatattgaacttgaatctgaagaagaagaaatcatggtcaattttgaggcgtatgatggagaagagggagagggagatgatgctccattatcttatgataacaacgaagatgattatgttgggattggagaagatgattag

SEQ ID NO: 25757 - DNA, 690 bp, Glycine max
  Peptide Sequence Number=SeqID_117442
atgacgcacgttgcatgggatacaaacacaattgtttgtaatttctgtggaaaaatcacaaagggaggaataaccatacccaaagaacgcttgattgagaagtcggggaatgttgcagcttgcaagaaaactccaccaaatgcagtcgaagagctgaaggaatatatggttaacaaaaaaagtggaaccacttacaatagttctggcagtggtaatatggcaaatataagatattttgaatttggtgaaccaattggatgtgatggaagtgaagatgagtttgcagactcttgtaatgctactgcaaagacaaagtgtgggactaaaaagggagcaatggacaaattttgtaagaatccaaaaaatgcaattaatcggagaaaaatggagatgttgaggcaaatgaacataagagagtcaatggataagaatgaagtattgaaggtgcatcaatatattgctcgcttttggtaccaagcaggtttgtcattcaatctcattaaattgaaaagctttgagaatatggttgtagtcattggccaatatgggccatatttgcccattcctagctattatgacatcagagttccactcttgaaaaaggaagttgaatatactaaaaatttgatgaaaggccacagagcaatgggtcaagtatggttgtactattatgttcgatgcatggactga

SEQ ID NO: 25758 - DNA, 405 bp, Glycine max
  Peptide Sequence Number=SeqID_117443
atggtacaagaaggtgatgaaggattttggtttgaggttagagaaactagcaaaacagttgctggaccaacttttggcaccaaggttgccaactaccctccatgccccaacccagagctgttgaagggtcttcgtccccacactgatgccggtggaattatccttctcttccaggatgacaaagtcagtggactgcagcttctcaaagatggccaatgggttgatgtgcctcctacacaccactccattgttgttaacattaatattggtgatcagcttgaggttatcaccaatattggtaagtacaagagtgtggtgcactgtgtgatagcacaaacagatgggaccagaatgtctattgcctcattctctacgtgtgatagcacaaacagattgaagttttga

SEQ ID NO: 25759 - DNA, 174 bp, Glycine max
  Peptide Sequence Number=SeqID_117444
atgtggccaatgtatgtagctgcaattgtggttgcagagatattgatcctcaacccagactgggaaattgttagggtgctcaaccagtggatgaaaagactatcggatggtacagagcaaatatttgtcatgtcaatagatagagtagatggtctgaaggaggacctggcttag

SEQ ID NO: 25760 - DNA, 114 bp, Glycine max
  Peptide Sequence Number=SeqID_117445
tcacgggaggtcttgatgatgcaatcctaccccgcaagggcattggatagaagacctcaagtagaatgggccaaagatgcaagagaaggccctagggttcttatgagccttagg

SEQ ID NO: 25761 - DNA, 306 bp, Glycine max
  Peptide Sequence Number=SeqID_117446
atgaggaaagatcgagagagaggagtgagtacccgcagagagaggagtgagcgttggtattggagagaggagtgctcggaacctccgaggaaagatcgagagaaaggagtgagtacccttaaagagaggagtgagtgttggtactggagaaaagagttctcgaaacctctaaggaaatatcgagagagagaagtgagtacccgcagagagaggagggagcactggtactggagagaagagagaatattcaatatctcatttaaaatgaattactccgttgaaagtatccatccaaacatagggtga

SEQ ID NO: 25762 - DNA, 107 bp, Glycine max
  Peptide Sequence Number=SeqID_117447
atggctggacggaataatcgtgcgatagctgatgctcttcaagccttagctcaggctatagggaatccaaattggggagaagctggtggagctgttgagtaccaagg

SEQ ID NO: 25763 - DNA, 148 bp, Glycine max
  Peptide Sequence Number=SeqID_117448
atggaggagttgattaacaaaacacaactctctcccaaaataatcccaatgccatcacgtcggctcggcggctcctcaacaaaatctcacttcttgcaccctactgctgtcattctacttccacgaacaaggttcacgatcatcacag

SEQ ID NO: 25764 - DNA, 531 bp, Glycine max
  Peptide Sequence Number=SeqID_117449
atgcgcaaggacattgatcgtccaatggcaagagaagaatgttgcatagtaggttcggctcatccagcgctgcttgactatttggaagtggccatcaaaagacaaggaagtgcaagtgaatctgaagatgacaatgagagaaatgatgttgtagaggaagaaacagatgatgatgacaatgccttttttgatactcatgattggtacaacagtagctacaagtggaccaacagcttgcaactaccatttcgtcttcggccttcaaaaaattgttgtttgggctgcaagattgatctcattcatttgttgcgtgaagatactccaccagaatggatatttaaggaaattcaaaatattggaaacatagatttcagatttgtggaagagcagcctccacatgattattctgttgagcttgcagtatattggacatactacgtcgtagaaggccattgcctacaggcacatataaagacggtccctcccaacccgtcgttgttggcagaactttctaagacggttatacggtaa

SEQ ID NO: 25765 - DNA, 306 bp, Glycine max
  Peptide Sequence Number=SeqID_117450
atgaatgacgcgcgtcggagcatagtgagtcactgcgcgagggagggcagacttgttgacaaaggccggggaacttcaagagaggtcgacgtagagagtacgggtagtagtgcttcgagttgcggcggagtcaaagctatagaggacagactggttgacaaaggccggggaacttcaagagaggtcgacgtagagagtacgggtagtagtgcttcgagccgcggcggagtcaaagctatagagggtgaagctattcgcaacattgttgtcgtaccccatccacacgtatcactaaaatgggggtga

SEQ ID NO: 25766 - DNA, 459 bp, Glycine max
  Peptide Sequence Number=SeqID_117451
atgttgtctcagaagcaagcagaggaagccatagtcacaaatgagacaaaacatgaagttggcagcactaaggaagaagagaatgaacaagcccactccatttttagcctcaagagcatcctttggcatggtggttcttgcttctttcatccaaccatgaacatctattacataaatgacaaattggataaacggacttcgacttatatttttggagcttgttgtgccaccattgttttcataccttccttccacaattatcgaatctactatttcttgggtcttggaatgaccacctacacggcttggtaccttgttgttgttgttacgaggccaggtgataaatcacttgtatgtaacaatagtatgcaggtcgcagtggaagaaaaagggatcaagggaaccaacactatccattgtagcaaaaccgtagctttcagcagtagaactccagattga

SEQ ID NO: 25767 - DNA, 462 bp, Glycine max
  Peptide Sequence Number=SeqID_117452
atgttcatttggatcggtggtcccctcataccgctccaggttgagtggtttccgacctgggagtatggcagcttccatgatgcggtcgatgaaggggtgttgacgagtggtccaccctgcaagactgtggatgtgggagaaacttggatcatcttgagtgttgactgtgtgtcgggggtgttattccccttgagtgtgctcaggcaatctttctcaactcctcctcatggtgttgctctatctccgcaatgcgattttggagttgctggagagtatcaatatctagcatggttagaccgagtgctgaccatgggtgctaaagagagagaaaacgagagaccacaaggcatgttttactgtagccccacagtgggtgccaaatgtacttaccaaaatccaaagctgagtgatgtcagggtggatgtggctaaggtgggctctaggacttcacacgttggctag

SEQ ID NO: 25768 - DNA, 240 bp, Glycine max
  Peptide Sequence Number=SeqID_117453
atggagcccatcttggctacgtcgaccctgacatcagtcagtcagcttcagattttgatcttttcaccaatgattagcacgtggtctggcctcagacgcgagacacctctagagagctccaatcctcccccaacaaccatgatagacaacgacactctccaacaactccaaacgcgtattgcggagatagagcaatgccacaaggaggaactcaaaaagctaaagattgaccacgactag

SEQ ID NO: 25769 - DNA, 1698 bp, Glycine max
  Peptide Sequence Number=SeqID_117454
atgtatggatttacaatcaaatattctcatctaccttgccttcaagtaggaagtcaaaggaaggtgaactatttgccaatggaggcatgcaagatagttgggggccagagatatacaaaagggctaaatgaaaagcagataacttctctgctgaaggtctcatgtcaaaggccccgcgaacaagagacagacattttacagacaattcaacaaaacaattatgagaataatccctatgcaaaggagtttggcatcagcatagacagcaagcttgcatcagttgaggctcgggttcttccggctccatggttgaaatatcatgacactggaagagagaaagaatacttgccacaagttggtcagtggaatatgatgaacaagaaagttataaatggaagtactgtaagatattgggcatgtatcaacttctcacgaagtgtacaggaaagtgcagctcgtggattttgccaacagttagttcagatgtgccaaatctcaggcatggaattcagtcaggaccctgcgattcctatacattcggctagaccagatcaggtaaagaaggctttgaagtatgtacattctgctgttatagacaaacttgatgggaaagagctagagttgctgattgcccttcttccagacaataatggctctttgtatggtgatctcaaaagaatctgcgaaacagatctggggttgatttctcaatgctgccttacaaaacatgtattcaagatcaatagacagtacctggctaacgtggcactaaaaatcaatgtcaagatgggaggaagaaacacagtacttttggatgctttaagttggaggattccactggttagtgatattccaacaataatatttggagctgatgtaactcatccagaatcaggagaggattcttgtccatccattgctgctgttgtagcctcccaggactggcctgaagtaacaaagtatgcagggttggtttgtgctcagcctcatcgagaagaactaattcaagatcttttccgatgttggaaagatccacagaggggtgtaatgtacggtggtatgatcagggagcttttactatcatttaagaaggcaactggacaaaaaccattgagaataatcttttacagggatggggtaagtgagggacagttctaccaggttttgctatatgagcttgatgccatacgcaaggcttgtgcatctttggaacctagttaccaacctccagtaacatttgttattgttcaaaaacggcatcacactagactcttcgcaaacaatcatgatgacagaaatagcactgataagagtgggaatatcttacctggtactgtggtagattctaagatctgtcatccttcggaattcgacttctacttgtgcagtcatgcaggaattcagggtacaagtagaccagcacactatcacgtcctctgggacgagaacaatttcactgcagatgagattcagtctctaaccaacaatttgtgctacacttatgcaagatgtacgcggtctgtttcagtagtgcctccagcatactatgctcatctagcagcctacagggctcgattctacatggaacctgatgttgctgagatttcaaaactgcgaggaacaagatcgaaagaagggcctgttcgggcactgcctgctctgaaagagaaggtgaagaatgttatgttttactgttga

SEQ ID NO: 25770 - DNA, 354 bp, Glycine max
  Peptide Sequence Number=SeqID_117455
atgaagcttgcttctacattcccaacaaagtgtgatccatcattaccagaatctgcttctccatctccactctctgcagcttcttccttatgcccagagcctctctacccaccaccttcatggtacggcggcgaagaaggagagggagagcgagctgttgttgctgctgcggcagctaaagctaaaggtgctgagctagttataggtggagtcagggagggttatggaggatcagttgttgttgttatccgaggattcgtccatggtcatcgaagccatagacatggtggtaacatgtatgcttttttgttttgttttgtgagatgtgtggtgaggaaaatgagagcttcatag

SEQ ID NO: 25771 - DNA, 261 bp, Glycine max
  Peptide Sequence Number=SeqID_117456
atggcacaagtgcatggtggcattgatgagaaagtcgaggtcacatgggacttgccaaggtgcgtgataaagacatccttgttgatgtcgctaaggccactaatagcgatgatgaaagggttgttgggatttagggagaaaggggccaagctaaagtggaacctatggaagcttctaagatatggagaaggatttgatgcctattggaagcattccatatttgtggaaactgtcaacattgctaaggaaacacttgtgtga

SEQ ID NO: 25772 - DNA, 660 bp, Glycine max
  Peptide Sequence Number=SeqID_117457
atgggtcaaacacatgctcaaattcagtgtcgatctccagttgcatgtgacaatggaggggatgccacgatgggcccatgtcgagagggacccaaggattgcagtgatggtattgcaattcaagatggagttgccaagtttgtaggttgtggacaaggaggacacgttgaggattttgcatatcaatttgaggttgagaggggattggagtgggaaacctgtgattggtataataggctcattaaggatcgcttgtcaactaggacaaacttaaggaccagacaagtggagctaaatgactctcggtgcccactgtgcaacagtccggacgaagatgcaacacacctatttttctactacactaagaccctacccctatggtgggaatctcagtcatggataaattcatcgggtgtatttccacacacttccaaagatcattttctgcaacatgataaccggtctgctgttggagttagagctagaagatggaagtgctggttgataacactaacatggacaatttggaagcatcgaaacaggatagtctttgataatcaatcttttgatggaagtaaagtcatggatgacgcactatttctactatggtcttggctcaaggttatggagaagggtttcactatgcactttagttattga

SEQ ID NO: 25773 - DNA, 1656 bp, Glycine max
  Peptide Sequence Number=SeqID_117458
atggggggtagtgattttgggggttcatttcagcaacccctgatggaccgaaaagtcatttccattggcgtttcctcctcagaggatacttgttgtggtgcctctgaaaatgaatccacttactcaaagaggttgaaggctttgcgctgtactggtggaggcacctctcacttccgtaggagggcacgaccttccgctacttccccaatcagggatcctgtctcagtcatggtgactggcaagattggttgggtctccttgaacaatgtgtccaagaagctttttgagtttgactcgaatgtttttcaccgcttcaaggaccatttcttgaaggtcatggctactgatgtcgtggctgatggaactgttgatccttgtggaaagggtcgacaaagttattttggaacagttgtgggcctcattggacatgtgggccatcctttctctttcctcgacgagcaatcctttcgaattatgggtgacttccctttaaggccactggtgaagcaggttggccttgttgttattgttgatgaggtctcccctagtgctctttcctctattttggcaaataggaaacaagatgatggtgttgggccatctggccgtaaaaagtcgagggcccctatgagcctttgcatcctaaggcaagttgtagggttgaagcccggtgcgggtcaccctttgagtttgcaagatgcacctacggctccaacagtcatcgagactcctgcttctgctactattgttgctactattcctgctcctttacctcctcctgccatagttgttcaggaggttactcctaccactagagttggtgtgccaactacttcggctagttctgttttggtgtcttcgtccaccgctgccacacccttactaagtgttggtgtagcaaccactagtgctcccataatgtcacctcctccttctttagctccccccgattcgaccttttgttgtgttggtggctgcgccgccttcctcgtcttctttcccgatgtctctttagaccacatgtacacttccagcaatgttaattcactgtggggtggtaattacaaaccagagcagaagacctcgactggcattgtgtcaacctttgataaaaacctcatctggtcagttggggtgcagaacgctacgaactttgccaaagtcttcctccaaagaagtttgacaattctagaggagaatgaacagcggcacagagaggctttgtgcaaggtgtcgtccttggagatagaggttgccaaatggagggctaatgctcacatggtttggagacaaaagcgccctaagttagctaacgccaccatcgccttcgctgaagttgaagagaaaaaggacttggctggcaaggtggaaggcattgcggcaaagacggacaagctttccaagatggttgctaatttagaggcttggctaaagaaatcggagtccagactggaggaggccgagctgcggatagctaaggagagggaggctagcaaggagcttgaagaggagctaataatgcacaagaaggaggccaagtacttcgccaaggatcttgacttggatccttttggccttttcaaggacatgaagaacggtgttctacttgacgaagaagaaattgttgcagaggaagaggttgctgatgaggagtag

SEQ ID NO: 25774 - DNA, 300 bp, Glycine max
  Peptide Sequence Number=SeqID_117459
atgcaagcaaaaaatgaaaaggaggcgtgggagactctgaaaaatgaatttaaaggcgcagacaagataagaaaaataaccacggtaaatttcctcgaaaaagaggaggagcatttactaatcgtggtaaaaggagcgaaaagcaatggagtaataatgcttcaagctcctattgcaaattatgcaagaaaaataatcatgatacaaatgattgtcggtacaaatgcaaaaagtgcaaaaggcacctacactacgaaaaagattgtttttaccgacaaaaagaagaagcaaattttttag

SEQ ID NO: 25775 - DNA, 156 bp, Glycine max
  Peptide Sequence Number=SeqID_117460
atgactctaagacaatatggattaagcctaggatcttcttcattaatggattcctttgcttcttggaagatgaatgatagcggaatggagaaggaagagagagaggagacaccacttcaaggagaagatgagtctagaagaagctcaccaccatag

SEQ ID NO: 25776 - DNA, 246 bp, Glycine max
  Peptide Sequence Number=SeqID_117461
atgtggctactcagcaaagaaatggcaccaagtttttccaactcttccaatggcctatggcatgccttaaattttggggaggatgtgattgtgggtgttattgatattggtgtgtggctagagagtgaaggcttcaaagatcatcgaatgaccaacaaaattctaaacaaatggaaagggagctatgaggaagtacaggacttcaacactcatgtaggctgctcctgctgcagccatgatgagtaa

SEQ ID NO: 25777 - DNA, 1470 bp, Glycine max
  Peptide Sequence Number=SeqID_117462
atgccatcacaagcagagctaagcatgatggattacaagccctacagctactccacactgctgaaatcatttttagatcaaactgaaactgatcagacctacaagcttgaagagttcctctctcgcttagaggaagaacgtgtcaagattgatgccttcaagcgcgagcttcctctctgcatgcaactcctcaccaacgctgtggaggcttcaaggcagcaactacaagccttcagatcaaaccaaggaacgaggccagttctggaagaattcatgccaatattaaagcatccaaactctcaagaaagcgctgaaaaaacatcaaacatatctgacaaggcgaattggatgacatcagctcaactatggagccaagcaagtgaaggaaccaaaccacaatccacaattacatcattacctaaagaaggtgctgatattggctttagcgtgagcccgaagctagccctagacaacaaacataggaatgggggagcctttttaccattctcaaaagaacgaaactcgtgtcaaggattaaggggtcttcctgagttggcccttgcatctcctgagaaagaaattgaggaaaataagtgtgaattagaggcagagaaatgttcgaaaagggagaatccaggcaaaggagggagttgtgaaggggttaatgttgatcagggaaaaagtgcttcagttgcatctgaggcacaaacagcaaatactaccaccaccacaactaacactagtggccaaactcataggaaagcaagaaggtgttggtcaccggatttgcaccgtcgatttgttaatgctcttcagatgcttggtggatctcaaggtactaaaaatagatttgaaaagattacctcatttgtacttaaaacaaaactattgcagagaaatgtggccaccccaaaacagattagggagctgatgaaggttgacggtttgaccaatgatgaagttaaaagccatctccagaaatataggcttcacactagaagacccagtccgagcctacataccggaggaccaacaccccagcttgtagtccttggaggaatttgggtgccaccggaatatgccacaactacagcagccatgacaaattccggtgaccccacactctatggcccacatcctacctcacaagtggcaccaccacactactgtgcagccacccaaatgccccaagaattctataactcagcgttgccgttatcgttgctgccaccaccacatgactacacccttcatcatcatcattttcacatgtacaagacagcagcacagacacaaaactctccggagtccgatattcggagcagtggcgaccggtcagagagcattgtggatgggaagtcggagagtggtaaatggaatggagagagtggagagaagaaagggttggcagcactaagagatcaagaaggggaagagagcactggaagtgagattactcttaaattctag

SEQ ID NO: 25778 - DNA, 291 bp, Glycine max
  Peptide Sequence Number=SeqID_117463
atggcttcctatggtgacgaagcacctaagaaagaaaagtctctagctctcagcagtcagaaggtcaagcaggccttgttgtctaaagagcaagtctccataagcttgtccaaatcccttgaagctgaaactcctctaatgaagattttgagtaagagtctaatgaagatgaactcaccttcatctcatgaaatattttcaagatgtggaagaacaaagggagatccaaatagaagaacttctcaaaaatgttgttcaaggaaaagaaagacaaagacaaaagctccataa

SEQ ID NO: 25779 - DNA, 277 bp, Glycine max
  Peptide Sequence Number=SeqID_117464
attgaaatttcaaataactccttctaatggtggaaccatcaaagtagcgaaagggctcttcgagttgaagccaacggcattccgagactcaagaaacgcaaattccttcctccatttcctcttcctcattgttctctgtcataccctaattttgtccggggaccatacgttgttgggatgcgaccctcatttgatcacttcgaggtatttggaacccatcgttaggcaatttgtgaagttccgagacatgtcggaagccaaaagaaaagcgttgtag

SEQ ID NO: 25780 - DNA, 418 bp, Glycine max
  Peptide Sequence Number=SeqID_117465
tgaagaacttcgtgactattatgaaggaagacataggtcacatcttagacctcactcccatatgagagaaaatgaaagaaagcctcaagaggctaacattaacctcccatacttccatgggaaggacaataaagaccaaggtctaggcatcttaggggcagcaccttctaagcccaaagatgataagggaaagacaatagaaaaacaatcccctaaggctagtacgcaagagaaaactagctctataaagtgctttaaatgtcttagaagaggacacatttcttctcaatgccccaccataaaaaccatgattatgaggggccaagaaactgaaaaagcaaaaggggaagaatctagtgaagaaatctacccccaagaagaaggacaaccattagtggttaaagagaagtgtaaggag

SEQ ID NO: 25781 - DNA, 240 bp, Glycine max
  Peptide Sequence Number=SeqID_117466
atgactgggggcaatctaggtgatttacaaccctttgatcctgaaatagatagaacctttcatagattagttacagatagtgtgcatcctggtcattctgtgcattttgagcattttgagcattctattgagggtgattctgaatattctgattttgagcattccactactaattttcatattgggaacatggctcaacctccacctcgtgacaggactcttgggagatggctgccctga

SEQ ID NO: 25782 - DNA, 120 bp, Glycine max
  Peptide Sequence Number=SeqID_117467
atggccctcggcgttcgcttactcgaacccactcaagtggcgtttttcgcttgtcccgagccgggaagggacgacgatttgtcggtcgtgaccctagcctttatttgcatccgtccctaa

SEQ ID NO: 25783 - DNA, 159 bp, Glycine max
  Peptide Sequence Number=SeqID_117468
atgctggaagcggcaactgcaaccacattggcttccattatcttcttcatgctcatcatggcctccatcattgcggccatttgctcttgtacctcctctacttcacccattactctagctcagttgaggaaaaaatgcaatgagcaatgcaaccaatga

SEQ ID NO: 25784 - DNA, 456 bp, Glycine max
  Peptide Sequence Number=SeqID_117469
gtcgttcctgctgccgtcattgctgggcgccctgctgagcctgtggctggtgtcggatctggcacggcggctgtggtcaccgcggcattccatctatgccctcgcggcgctgttctgcaccctgcagttcgggctgatggccaagcgtgcgcagatcgacatggtgctggtggggatgaccaccgtggccgtgtggggcttgatgcggcacctgtgcgaacgtcgcgtcggcacggtgaccaagggcgtgggtttcctgccgttgctgatggtgctgccctggttcggctggtggctgtaccagcgccgtcgcgggtaccgcgtggagggtccgcacccggcaacgctgctgtggctgatcccggccttcctgctgggtgtcggggtgtggctggcgccgctgggctgggccctgctgcacacgcccacggccgaactgcaggcctacgcgcatga

SEQ ID NO: 25785 - DNA, 363 bp, Glycine max
  Peptide Sequence Number=SeqID_117470
atggaagatgaaggtcccacagcccaggtacctcagcatgtggaggataagtcatctgaggccaccatcctagagccatttgttataggagaagaggcagaggagacacaggtgagacaagtagttgttgccacgcctgagcgatcccttgaggctacttcagagccttctgcacaaggggaaaacataccctcacctcagcctacagcaggcccctccactcttcttctagagatgccagaggacccgactacaccagtcctagctatggactcttctcctctagctactccagtgttacatttgacaaatgaagaggatgttcagacacaggacacccaggaccagtcacaggaattttga

SEQ ID NO: 25786 - DNA, 480 bp, Glycine max
  Peptide Sequence Number=SeqID_117471
atgggtttaggtaagaacaacggcggcaggaccagcctggtaagcaccaaaggaaatcgcgggaagtttgagttaggctataaacctacgcaggctggcataaggaaaaatatctcggaaaagaagaacaaaggccagagcctacggttgggacaacgagccaaagagcccccgccgtgccacatcagtaggagcttcataagtgagggcttaagacgcgaaggtcaagtcgccgcgatatgtgatgatgagtccccgaggagatcggatttggtacggccatgccctaccagtctccaactaggaaattggcatgtagaggaatgcccggacgtttatgtgacaagcataatatctgacgacgagtcccacaaaggtactaataccggggacccagtcgtcgatttcgagcaagaagcaagtcgggcggagaatgaagaggatgaggatgtggggcttcccctagagtggagaggataa

SEQ ID NO: 25787 - DNA, 717 bp, Glycine max
  Peptide Sequence Number=SeqID_117472
atggccgttttggagagagaaggtagcgacggactcggttccacagaggcgcagctcaccacctcaaaggattggaaagctgtttccaatgattcttccgccgcttctacgtacggtgcggaggaggggcagctcactaacatatcctcttcacccgacactatcactaaaagtccacctactgcgaacttcaattttggtgaagcgttgaacgggacactcccagagcatgaatccacggtcttcccaagaggcagctatagctgcaggaatgtcgatatccagaccgggcatggtatcaagtttcccccatggggtagcttcccgcggtccatcaccggttccctaccttcgagcttctttcgttttaaacctcggtggtcccacaaagtttaccaattcggtttcttcttgggaggcattacatttaaactcgatccgttgtcgataagtacctttgagcgacaacgtggtccatactctggcaccgacacatggagtcctcttcctcttcctcgtttatcgtcttgctatatctcgatcgaaatcgcgattgtcaaaccctcgttgcggtatagacttctgactggcttatcacgcgccagttccccacttgggaatcggggtggcatggttgcacaaaacttggtgggtcttgagggaactcctcttctattgctgccacctcctcctcggacaccattccagcactggtga

SEQ ID NO: 25788 - DNA, 216 bp, Glycine max
  Peptide Sequence Number=SeqID_117473
atgggtgttaagtaccttgaggcaattaagcgaagatttcatgccaacaaacaatggttcccagatgaaattaggggaaaactgccaggaaaccacattacaagcgaaacctcaaagagagttgggcttcgtcctcaaaaggaaacaacaccagaaaatctagccttcaatggattcaaacagaaaacgcaaatgaaacatgaagcagaaacgtaa

SEQ ID NO: 25789 - DNA, 561 bp, Glycine max
  Peptide Sequence Number=SeqID_117474
atggaggaccttttgcaacagatgatagatcaaggccgactagaagtcgacgatgaggggagggaagagcagcatatatgtatgcagtctgcggatgagagaagttttggaaggccaaagcctttggaggtatatttcaccaaagacgcaactcctcaaaagcctcaatacccctcggtagttaaacctgttcctttcccataccgaaacagccacgcagtcccgtggaggtatgcacctccaagtgaaaggaaggaagaggccaccaacatcagctcgttgtcagccaaggtaaccaatatcacggggttgagcggcgtgacccgcagcggtcgcgtgtttgcacctcccgacctgccgacacaacccgcaaatgttaaagggaaggcaaagatggtggaagaacaaaatgacaaaacgacccccactctgaacgaggatattccagtgaaaggtcttctggaaaaaagggatggttgtggcaagaaggaagtgtcgctagaggaagcaagcgagttcctccgcattattcagcaaagcgagttcaaggtcattgagtaa

SEQ ID NO: 25790 - DNA, 549 bp, Glycine max
  Peptide Sequence Number=SeqID_117475
gagcgtcctgagttgaagttatcctctcacgggaggaaagtccatagtttaggcaggcctgtccctgccattgagggactcgttgttgggacaggactaagtcctctaatcgcgtgttcggtagacaccggcgatcggggacttttgtcctcgtttgtggaacggtggcactgggagacgtctagtttccatttcccggtgggagagctcacgatcacgctggatgacatctcctcgcttctacattcgcccatggttggcgacttgcacgcctttcaacccttgcacgtggacgatgcggttcagatgctggtggacttattgatggtctctgcagagtctgccagggctgagacagcccagtgtcatggatcgtacgtatgcctacaatgggtacgtgatatatatgagcaccgatgccaggcaggtcattggacagctgcgactcacacatatcttcttcacattctgggttgcactctgtttgctaacaagaatgcaatcaatgtgcatgttgtgtacttggaggcccttcgtgacctcagttag

SEQ ID NO: 25791 - DNA, 255 bp, Glycine max
  Peptide Sequence Number=SeqID_117476
atgccatacagcaatgtggaaaaacattggcaaggagtacaaaatttgccaaatttagagagaattgaactccgaggctccaagcaccttgtggagtgtccaaggttgtctcatgcaccaaatcttaaatacgtaagtatgcgtgattgtgaaagttttccatatgttgatccatcagttttctccctcccaaagcttgaaattttaaatgtgagtggatgcacatcgcttgagagccttagcaacaacacttag

SEQ ID NO: 25792 - DNA, 366 bp, Glycine max
  Peptide Sequence Number=SeqID_117477
atggcctctggtaatcgattaccaagggtgggtaatcgattaaaaggcttaaaaatggagacaggaggcaaagatggtctctggcttgaaaacgaagtcaggaaactaagggagcctctgagggatgggtcactggtaatcgattaccagatgaacctgcacggacgcttcagcgcactgtggagtggatactaccatgcctacaccatatcgtctagtggagcccgtccaagtgatcgagagggtgatgaggatccactacttgaggtgaattctcccgaggaagtcatgtcggcatctgaggcagactctacggaggatggtggtccgggggagatggcgatcagcggaggctcttcatcctag

SEQ ID NO: 25793 - DNA, 753 bp, Glycine max
  Peptide Sequence Number=SeqID_117478
atggcccacttggagctctcgattccatggcgcggctcaacagagcagccgcaccgtcctacctatttaaactatcctgagggaaacttcggagggaaccagctactagacggttcgattagtctttcgcccctatacccaagtcagacgaacgatttgcacgtcagtatcgctgcgggcctccaccagagtttcctctggcttcgccccgctcagcatagttcaccatctttcgggtcccgacaggtatgctctcactcgaacccttcacagaagatcagggtcgtcggcgtgcaacccacaggggatcccaccatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcacctccttttcatctttccctcgcggtacttgttcgctatcggtctctcgccagtatttagccttggacggaatttaccgcccgattggggctgcattcccaaacaacccgactcgccgacagcgcctcgtggggacttgggcccggtccgccactgaggacgcttctccagactacaattcggacgccgagggcgaccgattttcatggtgggcttttcccggttcgctcgccgttactaagggaatcctt

SEQ ID NO: 25794 - DNA, 165 bp, Glycine max
  Peptide Sequence Number=SeqID_117479
atgggcctcaacatcggggaaaactcgacccctcctaagcaatatggtaaccgtcgtgacaatcagaggactgttgctaggggatttgtagttggtagtgacaaaagggacatactcaaagggattgttcacaactcaagaaagagcaaaatggtgggggcctga

SEQ ID NO: 25795 - DNA, 186 bp, Glycine max
  Peptide Sequence Number=SeqID_117480
gggtgcaaacagtaaccaggcccacttgggccttgtcgcaacctacccttcggtgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaag

SEQ ID NO: 25796 - DNA, 270 bp, Glycine max
  Peptide Sequence Number=SeqID_117481
atgaggacacgtagccctctaaaggtgagggcgtgcagtcctctcaaggtgagggcgtgcagccctctattggcgaggatgtgtagccctctcaaggtgaggggcgtgcaacccctctgttgggcgaggacgtgtagtcctctaaaggtgaagggtacaaatacccaagggtccacccttatgagaaagcaagagatcgactcatcgagagggccggtcatcccaaatccacacgactggatattagatgtaggaaatctatgcagttaa

SEQ ID NO: 25797 - DNA, 1149 bp, Glycine max
  Peptide Sequence Number=SeqID_117482
atggctaccgcaacaaaagaaacctcagctcttggttcaccctctgtaccatcatctccatcatccaccaaagcaccatcaaaccaggaacaacctgaattccatatccaacccatacaaatgattcctggtcaagctcctgtccctgagaaactggttcccaaaagacaacagggagtgaagatttctgaaaaccctagccttgcaacaagtcctagggaagtagacccggagatggataagaagatccgcagtattctgatgaagatgtcccaacatcttccaccccaaatgtttctgtgcctgatgttgataaaagatgttccaacatcttccgctccaaatgctgaagccctcccttcacccagtgaagaggaatcaacagaagaagaagatcaagccacagagaagacccctgcaccacgggcaccagaacctgctccaggtgacctcattgacctcgaagaagtagaatctgatgaggaacccattgccaacaagttggcactggcattgcagaaagactacaaagcagaaaaggaaaaacccccgttaagaggtctggacgaatcaaacttatggcacagaagagagcactccaatcactctaccacatccagacggagcaaagttgccatcccttccaagaagaggaaagaaatttcctcatctgattctgatgatgatgtcgaattagatgttcccgacatcaagagggccaagacatcagggaaaaaggtgcctggaaatgtccctgatgcaccattggacaacatctcattccactccattggcaatgctgaaaggtggaaatttgtgtatcaacgcagacttgccttggaaagagaactgggaagagctgccttggattgcaaggagatcatggacctcatcacggctgctagactgctgaagactgtcaccaagttgggagattgctatgaaagtctagtcagggaattcattgtcaacattccctctgacataacaaacagaaagagtgatgagtatcaaaaagtatttgtcagaggaaaatgtgttagattctcccctgctgtgatcaacaaatacctgggcagaccaactgatggagtggtggatattgctgtttctgagcatcaaattgccaaggaaatcactgccaaacaa

SEQ ID NO: 25798 - DNA, 855 bp, Glycine max
  Peptide Sequence Number=SeqID_117483
atggaagcttctcagaacctagctcccacatcccacacctcagatttgaatatggacagagctaggttggtctatggcttggtaaccaacatggacatgaacattggagcccttatctcaggtcagatttcttctatttctcagagtaactcctctaggctcagatctctagccttgatcactgccctaagcagagctagaggagttacctctgacaatctgacctatgagagcctgagcccggccattaacttggcctacattaagaaaaattgttggaatatggatgatctaacagttaacttcaaaggggcaaagaaggaaaaggttcgaccagctgaggttcctttttcttctactctaccagctccttccacttctgctactcttacaccagctccttcagactcatctactcaagactctcagtgctttgagtccatgcttcagagtcttcataaaggacagattttgttaatgcaaagcttgcaggttgtagctcctccaggatccattctgacagtggagcagtttttagagaaggtatcccggccaggaaccctgccttctcttgagagagaaggtgggggtcccagtgctcaagtaaggcaggaggttgctactacagagagatcaccacagatttcaccagatccaccctctccagtggtggatcaatcttctcttcaacagccagcagaccctcctacactagtgcatgagattccagcagacccgtctacactattacttgatcttccagaggaccattctacaccagtcctgggattgactaccactcctccggccactcctatgctatgtcttacaaatgaggaggacaactcaggatga

SEQ ID NO: 25799 - DNA, 348 bp, Glycine max
  Peptide Sequence Number=SeqID_117484
ctacacgccctcacattcaaaggactacacatcctcaccttcagagggctacatgctctcgccatcagaggactacacgtcctccccttcagaggactagacgtcctcaccatcagaggactacacgtcctcgccttcatagggctacacaacctcaccatcataggactacacaacctcaccttcattgggctacacgccctcaccttcagaggactacatgtcatcgccttcagagggctacacgccatcgccttcagaggactacacgtcctcaccttcataaagctacacaccctcaccttcagagcgctacaccttgaaggaagaaaaagggagagaagttga

SEQ ID NO: 25800 - DNA, 231 bp, Glycine max
  Peptide Sequence Number=SeqID_117485
atggcggaaaatgcatattcctttgggtcctcgggtttctactctctgttcttcgacaatgacaacattctccgtcttctttacgatggtcttgaagtttctgccattactggccacatccatggctggcatcttggaaagctcattaggacgcagtgcatgcccgacggagtagtgaaggacgtgtcttctcaaaaatattcattcataatgtttctaaggatacactaa

SEQ ID NO: 25801 - DNA, 129 bp, Glycine max
  Peptide Sequence Number=SeqID_117486
atgggtgccaagtacctcgaagtggtcaagcaaatgttgcatgccatcaaacaatggtccccagacgaaattagggtgaagatcctcataagcatcttaaggagttccatattatctgttccaccatga

SEQ ID NO: 25802 - DNA, 177 bp, Glycine max
  Peptide Sequence Number=SeqID_117487
atgggggtgcaaatagcacccaggcccacttgggccctccagaatattcctccagaaggctgttgcttctggaggaaacaacctggctcgcctgggcgagctgagctcgcctgggcgagctgggcggcaaccacctcccaaaatctaagccgaggcgcttccgaaacgttttcgtaa

SEQ ID NO: 25803 - DNA, 249 bp, Glycine max
  Peptide Sequence Number=SeqID_117488
atgtcgtcacttcatttggctttgaaaagaacatcatggatcaatgtatataccaaaagctgttggaagccttattttatgctcatatttgcaccagacctgacattgcgtatgttgttggagttttgggaaagatatcagggtaatccaggtattgaccattggaaagctgcaaagaaagtgatgagatatcttcaagggacaaaggattacatgctcatgtacagacaactgattgtctggaagtga

SEQ ID NO: 25804 - DNA, 645 bp, Glycine max
  Peptide Sequence Number=SeqID_117489
atgaaggaaggcataggtcacatcttagacctcactcccatagaagagaaaaggaatgaaagcctcaagaggctaacattaacctcccatacttccatgggaagggcaatggtagagcaacaacttaaaaagaagtctacatcaaaatcttatggctctcacttttatccaaagaaagaccaatgtcaaggcatcttaggggtgacaccttctaagcccaatggtgataaggggaagacaatagaaaaccaagcccctaaggctagtatgcaagagaagactagctctataaagtgctttaaatgtcttggaagaggacacaatacttctcaatgccccaccacaaaaaccatgattatgaggagccaagacatttatagtaaccaagatgaggctactatgtcaccttcctctagtgaaagtgaagaagcaaaaggggaagaatctagtgaagaaatctaccatcatgaagaaggacaacctttaatggttaaggaggagtgtaaggagacaacctccacatcttctccttttaaaaagacacttgttagtactgccacaccacttgggcttgaggttattcgtcaagtaaaggagctgttggatgagggtttggtattattaggcaccaaatccctaaaatag

SEQ ID NO: 25805 - DNA, 414 bp, Glycine max
  Peptide Sequence Number=SeqID_117490
atgagatttggtcgacggcccgggcggccgcaaggggttcgcgttggccgattcattaatgcagctggcacgacaggtttcccgactggaaagcgggcagtgagcgcaacgcaattaattgggatccccgggtaccgagctcgaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagctgaatggcgaatggcgcctgatgcggtattttctccttacgcatctgtgcgggatttcacaccgcatatggtgcactctcagtacaatctgctctga

SEQ ID NO: 25806 - DNA, 180 bp, Glycine max
  Peptide Sequence Number=SeqID_117491
atggagaattggcgaacagcgctaggcaatcaattcgcggggctccagactcgaagcgctaggcaatcaattcgcgagtggtccatactcattgttggaggatggatgaagagcgcttgggaaggaattcattgggctccgaataacagtggagaatggagaattggcgaacagctctag

SEQ ID NO: 25807 - DNA, 258 bp, Glycine max
  Peptide Sequence Number=SeqID_117492
atgggggtgcaaatagcacccaggcccacttgggccctccagaagattcctccagaaggcggaagtgaagtggaaaaggatcccagccccttaggcacttctctctccttcgaatttgcttggaaaaatcgtttccgtgaagaaaatctaagccgaggcgcttcgaacgtttccgtaacgttttccgtgaagaatctcgcaaggtttaaccgttcttcgacgttctcattcgtcttcatcgttcttcgatctcaacgg

SEQ ID NO: 25808 - DNA, 439 bp, Glycine max
  Peptide Sequence Number=SeqID_117493
gcacacttcaagaactctgtagcacccctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 25809 - DNA, 291 bp, Glycine max
  Peptide Sequence Number=SeqID_117494
atgacggtgaaaacctctgacacatgcagctcccgggagacggtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccccagatag

SEQ ID NO: 25810 - DNA, 480 bp, Glycine max
  Peptide Sequence Number=SeqID_117495
atggacaactattcatggtgctatttggcttgtggtcaatgttataaaaaaactggcatgcaaactgtgtcgttcacatgtctgtgtggcaaagagaatgatcaacctgaactgaggtatcgggttgaggtgattgttaatcacaagggtgaacaaaccaaatttttgatctgggattgtgaatgtgcacagttaattggtcagtccacggatgaagtcaacaggttcaaaatagaagatggggacgttgatttaaatgcctctcctcaagcactagataggctattgggttgtttccttgcattcagagtgaaggtgcaaccaacgttcaggaattctgttgttcttaaatattcaaatgaatcagacttgatcaatgttgtgctagatatgattcccgatagtgagcaatctttgtctattaccgctgatcatgatgggccaatggttggctcaagtgagcctatagagtttgaatct

SEQ ID NO: 25811 - DNA, 462 bp, Glycine max
  Peptide Sequence Number=SeqID_117496
atgaaaagcctaaagatcgtgatggcagcgcagctaatccatgatcgagtggagatggagtgcctagagggagcttgggagaccctcgaaggcaacgcgaggtgccgatttcggggcacgattagatttacggctacttcattggtgcatccagatgaacccgcgcgcacgcttcagcgtactgtggagtggatactacccatgcctacgccataccgtctagtggagccaatccaagtgatcgaggtaacgtcatccgaggaagaccctgaggaggatctcgaggagctacctcctgagcctgttgtggatgctcttgactttctagagggtgatgaggacccactccctgaggtggattctcccgaggacgtcatgtcggcatccgaggcagactctacggaggatagtagattgttctatggactagttttatatacttttgagggtgggtgtatctag

SEQ ID NO: 25812 - DNA, 459 bp, Glycine max
  Peptide Sequence Number=SeqID_117497
atggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggggtggcttgttttggttttggcgcatttcatgtaacaggattgtatggtcctggaatatgggtgtccgatccttatggactaactggaaggatacaatccgtaaatcccgcgtggggcgtggaaggttttgatccttttgttccgggggggcttttgtcgttgctggaactatgtggtatggttcagcaacaacccctattgaattattcggtcctactcgttatcaatgggatcagggatactttcagcaagaaatatatcgaagagttggtgctggactag

SEQ ID NO: 25813 - DNA, 677 bp, Glycine max
  misc_feature (677)..(677): n is a, c, g, or t
  Peptide Sequence Number=SeqID_117498
atgggtgatcaagaggagacgcaggaacagatgaaagccgacatgtcggctctgaaagaacaaatggcctccatgctggaggccatgttaggtatgaagcagctcatggagaagaacgcggccactgccgccgctgtcagttcggctgccgaagcagacccaactctcttggcaactacgcaccatcctccctcaaacatagtaggacggggaagggacacactggggcacgatggcagccctcacctgggatacaaccgagcggcttacccttatggattgccgcccaactattcaccacccatcttgcaagaagatgcgggccacattgcttctcccgtccatgaaaaagagcctcctcagcagcccgacgaagtccataaggaccttcaagattatgctcgaagggatgtcgagttctatcccccgatccccgaagggccggcaccaggcacggctgtggaaggatttggggactatccgtttgcagacatgacggatctttgcttattacccgatgttgttattcccccgaagtcaaagtgctggacttcgacaagtataagggacgacttgtccaaaaaccatctcaaaatcttcccgtatccgtacttggaaggatctgattaccgcttcctaaggcagtatcagtacaattctgatatggctcctgaccn

SEQ ID NO: 25814 - DNA, 318 bp, Glycine max
  Peptide Sequence Number=SeqID_117499
atgttagccgtcatcagcaagtaccaagaggaactaagtctagccacggcccacgagcacaaagtggcggacgagtatgcccaagtgtacgcagaaaaggaggctagaggaagggtgatcgattcattacatcaagaggcaacaatgtggatagaccgatttgctcttaccttgaacgagagtcaagagcttccccgactactagccaaggccaaggcaatggcggacacctactccgcccccgaggagatccacggacttctcggctattgtcagcatatgataaatctaatggcccatataattagaaaccgctag

SEQ ID NO: 25815 - DNA, 585 bp, Glycine max
  Peptide Sequence Number=SeqID_117500
atgatcattgatcaatcattgctatatgctttgactaaattacctagtcaaggtgcaccttttgagggcaccattgttgatgactggaaatttgattattctagtcatgatgctcgccgtatgatcgactgggcttacttggttcggtaccgaatgcataaagcattacgggccaatgcacctctcccttaccctcaattggtcactctgtttctccatcattttcaaattccacttgatgatgaaccttttgttcaagtcaagcgttcctttgctataggtgctggggcagtcacttcatttggataccgtaaggatcggaaaggtcattggcttatgatagatgcacttcctccacaagatgagcgtactccttctcctcctcctcagcgagatgattcagcccttatgactgaagttctttccgagttacggggtcttcgtacttatgttggtgaacgctttgattcttggataatcgctttgccggaatggatatccgtctcacacagcttgaagaagatgtgggttatattcatccgagctttgatcttccaccaccacctccaccttcttagagtttag

SEQ ID NO: 25816 - DNA, 96 bp, Glycine max
  Peptide Sequence Number=SeqID_117501
atggaatcttatgaagattcagaaaatgaagaaataaacctctgccttatggcaaaaagttatgaaagtgatgaagagggtctagagcccccataa

SEQ ID NO: 25817 - DNA, 282 bp, Glycine max
  Peptide Sequence Number=SeqID_117502
atgggggtgcaaatagcaaccaggcccacttgggcccttcagaagattcctccagaaggctgttgcttctggaggaagcaaccctgctcgcctgggcgagctgagctcgcttgggcgagctgggcacttctctctctttcgaatttgcttggaaaaattgtttccgtgaagaaaatccaagccgaggcgcttccgaaacgtttccgtaacgtttccgtgaggaatttcgtgaaggtttcgatcgttcttcgacgttcttcatcgttcttcgatcttcaacgg

SEQ ID NO: 25818 - DNA, 701 bp, Glycine max
  Peptide Sequence Number=SeqID_117503
agggatgcatgccctcacttcagaggactacacgtccaccctttcaaaggactacacgtcctcactttcggaagactacacatactccccttcagaggactacacgtcctcaccttcagaggactacacgtcctcgccttaagaggattacacgtcctcgccatcagaggactacacgtcatcaccttcaaagagctacacgtcctcgccttcagagggctacacgccctcagcttcagaggactacacgtcctcgccattagaaggctacacgtcctccccttcacaggactgcatgtcctcgccttcagaggaggactacacgtcctcgccttcagagggctacacgccctcgccttcagaggattacatgtcctctcctttagagggcttcatgccctcaccttaagaggacttcacgtcctctccttcagaggactacacgtcctcgccattataggactacacatcttcgccttcagaggactacacgtcctcgccttcagcgggctacacatcctccccgtcagagaactacacgtcctcgcattcatagggcttcatgccctcaccttcaaaggaattcacgacctcgccttcagaggaatacacgtccgcgccttaagaggattaaacgtcctcaccttgggagaactacacgtcgtcgacttcagagggctacacgccttcgccttcagagg

SEQ ID NO: 25819 - DNA, 174 bp, Glycine max
  Peptide Sequence Number=SeqID_117504
atggaagtatgggaggttaatgttagcctcttgaggctttctttccttttctctcctatgagagtgaggaaaggatcagtcactagagccatgagcaagaggctccaagaggattgggctagagctgctgaagaaggcccaaggattctcatgaacctcagggtagatttataa

SEQ ID NO: 25820 - DNA, 276 bp, Glycine max
  Peptide Sequence Number=SeqID_117505
atgaccggccctctcgatgagtcgatctcttgctttctcactaaggtggacccttggctactagtacctatcacctttagaggactatatgtcctcgccatcagaggatgcaccctcaaacgacctggattagaaggtctacccaatagttccttgctacaaggtcatgacgaaggacaacgattgtacctcaaagccttacactggggcaatgaaaggcaccatgtaaaaacctcaagcgaacctaggggcagattagaagatctcaccgaatag

SEQ ID NO: 25821 - DNA, 318 bp, Glycine max
  Peptide Sequence Number=SeqID_117506
atggtggaggcctctggtaatcgattaccagcctgtgtaatcgattacacagaggaatgggtcactggtaatcgattaccagggagatcggtagtcctgagagaaagaggagggctcgtgggagtacgtgagcctcaattggaggtgggcaacacggggatggtggcgtttatgcgcgatttgaggatagtgaagtaccctgaggaggaatcgcgggggtcgaggagacctctggggagccggtgcgtggatgctacttgcccaaactttcagaggcgattgaggatcccgactcctgaggtggatcccgaggcatag

SEQ ID NO: 25822 - DNA, 175 bp, Glycine max
  Peptide Sequence Number=SeqID_117507
gatatgccttatttgcaagatggaagacccgttgatatggtcttcaatccactaggggtacctttcacgaatgaatgtggaggtcatcttcaagtatttttcccttcggggagggctgctacaacgggtgaggcgaaactcgaggctttgggaaaaaaccttgaaggatacttag

SEQ ID NO: 25823 - DNA, 72 bp, Glycine max
  Peptide Sequence Number=SeqID_117508
gaatctcgctaaggtttcaaccgttcttcgacgttcttcattcgttcttcatcgttcttcgatcttcaacgg

SEQ ID NO: 25824 - DNA, 457 bp, Glycine max
  Peptide Sequence Number=SeqID_117509
gtcgactctagaggatccccgacccaaagaagtccaacagggccctggggtttccagctctggttacgggccttcgtcagtcctacagggtgcccgttcccccagcaaggaatcgcacacacaaagacacccagtggacccggagaagtccaacagggccctagggtttccagctttgggatcgcgcccgcaagacacccagtggacccgaagaggtctaacagggtcttggagttgtcaagctctaattacaggcctttgtcagttctacggagtgcctgtcgcccccaacatggtcatcaggccccctactaatcgagctttcatcaagaagtactgcatccccaggcaggcgctgggcgaaacaccacagcagcctggggatggccggcagcgggcaacagacgcaccgccatcacctctagagttcacctcatctcatccacaaaaaggttag

SEQ ID NO: 25825 - DNA, 808 bp, Glycine max
  Peptide Sequence Number=SeqID_117510
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctggacgaatcaaagcgacaagggctgaatctcagtggatcgtggcagcaaggccactctgccacttacaataccccgtcgcgtatttaagtcgcctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtg

SEQ ID NO: 25826 - DNA, 969 bp, Glycine max
  Peptide Sequence Number=SeqID_117511
atggccaagtttgatccaaaaatagtccttgagttttatgccaatgcttggccaacagaggagggcgtgcgtgacatgagatcctgggtaaggggtcagtggatcccgtttgatgccgacgctatcggccaactcctaggatatccgttggtgttggaagagggccaggaatgtgagtatggccagaggaggaaccggtctgatgggttcgatgaggaggccatcgcccagctgctatgtataccggggcaggattttgcccggactgctgcagggaggcgggtgcgaatcatgcgcaccaacatgaccaccctgacccagatatggatgacgttgctcctcagcaacatcctgcccaccgatcataattccgaccttcccatgccgaagtgtcagctgggtgtacgccatcctgacacggatgagcatccatgtggctcagttggatcgctgatgccatatatatttttgcagggcctgggattccccgcactgatcacaggactctgccagtcgttcggagtccccgttgcacctaccaaggtgattcggccgcccatcacccgggcttttattgagaagtactgtacccagagacagggtcagggtgatgctccacaggccgcaggcgcgccaccaccacctcatcaggctggccaggctggggcatttgacatggagcagtatttacggcatttggttcgccagcaggcagccaaccaccgagcacatgtacggacccatgactgtctgtaccagatgagtcttagcatgcagagccagggcttcgcttctttttcatgccctactccagaccagttcagggcagaggtagcatggcccggagattggcccgaggcccaagcaggagaggcacccccagaagctcccgacgatggagaagaagcccacgaggatgaggagatggctgatttgcttgacttcttgggagggagtggagacacgtga

SEQ ID NO: 25827 - DNA, 458 bp, Glycine max
  Peptide Sequence Number=SeqID_117512
caaatgttctgcaccgtgatctaaagcctagcaacttgctactgaatgccaactgtgatcttaagattgcagactttggtctcgctagaactacatctgagactgatttcatgactgagtatgtggttactcggtggtaccgagctccagagttacttcttaattgctcagaatatactgccgccattgatatttggtctgttggttgcatccttggtgaaatcataacaagacaacccctatttctggggaaagattatgttcatcagctcaggctgattacggaggtattagctagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 25828 - DNA, 399 bp, Glycine max
  Peptide Sequence Number=SeqID_117513
atggagcagcgtggccatggaatgtactacacgtcaccaacattttctcagtatcattcgcagatgtatcagtatcctttcgaaggtcatgatactgatatgtctgcaagctcacattcgtatggtggtgttgcggaaacacaccctcatttttcatggccgaccatgaccccttcgcggcaacatgatgccccaatggcaacacctaatgccccattagctccgcaatggaatgtgttgatttgcgtcacgagttttctgctgaggctgagcaacaagggcggtgacaacgggcaagaagaaatcctgatcgtgaagcccgaaggtgggatcgaccatgtggcacaggctcacgccatcacggacaccataatgactgatttttatgtctctatttaa

SEQ ID NO: 25829 - DNA, 315 bp, Glycine max
  Peptide Sequence Number=SeqID_117514
atgatcaccttttacgtaaaaaagaatcacttgataaaaaagaactacgtaggtctgatttcctctatcgcattgaaatcgcccacttgggcccatccagaagattgctcaagggggagaagtgaagtgaaaaaggttcagccccttaggcacttcgtctctctttcggaatttttgcgaaaaattgttttccgtgaagataaacgtccagccgtaggcgacttccgtaacgcgtattccattgtgaggaattcacgcaagttcaccgtcttcgacgttcttcatcgtcgttcgacccttcccgccgaagggtaa

SEQ ID NO: 25830 - DNA, 546 bp, Glycine max
  Peptide Sequence Number=SeqID_117515
atgaaggctcatatgaagggaattacaggagccccgtaccgggcacgttgtgatgctttgacggtcacagacgtgtgctggttgccttacagtgaccatcgaggggttagggggtttgagccgatttcatcattccagggtcagataagatggggtcctacggtggtcacagttcgaccggagagggtgctatgccaatttgggtacattcagagcatccctccgccgcctgttagcgcttcgttgtcatatgatgatatagatgacaggtggatgcatttctcggaccacgtagtagttgtgggtgacctttgtgtagtgcctgggcaggtatttgcagattacatggagtggtttttccagatatctcacccattcatgataccgacccaggcaggtgaccagcccagacatgcacctgccccagaccatgaggactacatgcagccggacatcccacaggttctagtggcatttgacccccctcgacatgtagtggattgcctaaggatcgccagggggtgccagcgcagatggaagtgttag

SEQ ID NO: 25831 - DNA, 1113 bp, Glycine max
  Peptide Sequence Number=SeqID_117516
atggttgaatcggaaaaacttaactacatcaggaacaaccaaaagaaactcagagttgacaaatattgtagcttacaaaattcactagatgatgggacaatccaaggtttaaataaaggcaagagagtaatttggccttctacctttgttgggagcccgcgctacatggatcaactatattttgatggtatggcgatatgcaaccacgatttcccaaatctttttatcactttaacatgtaatctaaattggcctgaaatccatagattacttgcgccattgaatttgaaagtagcagatagaccagacattatgtcacgagttttcaagttgaaatatgaagaaatgctttcagacctaacaaagaatcacctacttggaaaagcagtggcatatgaaattgaccagattatatcagcagagataccttcaaacgaagatgacccagaactgtatacattggtgcaaaatcatatggttcatggcccatgtggaattatatgctttgaatctccatgtatgaaagaaggaaagtgtaacaggttttatcctaaaatgttccaacctcgcactcttttagatgcaaatggttatccagtatatcctaggagaaatgatggttgtacaatttcaaagaatggtgttatcattgataatagacacatcgtaccttataatccaaaattaccgaaaaaataccaagcacatgtcaatattgaatggtgtaatcaacgtacttcaatcaaatatttattcaagtacataaacaaagggtatgatagagtcactactattatggtttatgatggcaatgataaaatccagaatgctaccaaccagaaagatgagattaaagaatatatagactgcagatcatggcaccttagaaagaaaggatacactattggaaggcttatatgggtcccaccaacgataggagaattgttttatttgaggatgatgcttactgcctacaaaggagcaacttcatttaaggatattagaactgttacaaatattcaataccctatatatagagaaacatgctttgtcatggggtttttacaagatgatagagaattcgttgaagcaatcaaagaggcaaaggactag

SEQ ID NO: 25832 - DNA, 272 bp, Glycine max
  Peptide Sequence Number=SeqID_117517
atgggtgccaagcacctcacaaggaccaaagaaaagtcgcatgtcatcaagcaaaggtccccggacgaaattaggcaagccaaagaggccccgccctaccacatcagtagaagcttcataagtgtgggtttaagatgtgaaggtcaaatcgccgcgatatgcgatgatgactccccgaggagattggatttggtacaaccatgccctcccggtttccgactaggaaattggtgggtggaggaacgcccagacgtttacgtgacaagcataat

SEQ ID NO: 25833 - DNA, 581 bp, Glycine max
  Peptide Sequence Number=SeqID_117518
tggctcagttaatcgctgatgccatctatatttttgcaggtatggcggcctaccaggcactttggatccagataagtccaaacagggccctgggatttcccgcactgaacacaggactcctgcccagtcgttcagaagtccccgtggcacctaccaaggtgattcggccgcccatcacccgggcttttattgagaagtactgcacccagagacaggctcagggtgatgctccgcaggtcgtagacgcgccgccacctcatcaggctggccaggctggatcgtttgatacggagcggtatttgcggcatttggttcgccagcaggcagccaaccaccgggcacatgtacagacccatgattgtctttaccagctaagcctcagcatgcagagtcagggcttcacttctttttcatgccctactccagaccagttcagggcagaggtcgcatggcccggggattggcccgaggcccaagcaggagaggcgcccccagaggctcccggcgatggagaggaggcccacgaggacgaggagatggccaatttgcttgacttcttgggaaggagtggagctacatga

SEQ ID NO: 25834 - DNA, 489 bp, Glycine max
  Peptide Sequence Number=SeqID_117519
atgggtaatcaagaggagacacaggaacagatgaaagccgacatgtcggctctgaaagaacaaatggcctccatgatggaggccatgttaggtatgaggcagctcatggaaaagaacgcggccaccgctgccgctgtcagttcggctgccgaagcagacccaactctcttggcaactgcgcaccatcctccctcaaacatagtaggacggggaagggacacactggggcacgatggcagccctcacctgggatacaaccgagcggcttacccttatggattgccgcccaactactcaccacccgtcttgcaagacgatgcgggccatattgcttatcccgtccttgaaagagagcctcctcaacagcccgaagaagtccataaagaccctcaagactatgctcgaagggatgtcgagttctatcccccgatcccgaagggccggcacccagcacgttgcctcaacccaacatcacgacacaaccaatag

SEQ ID NO: 25835 - DNA, 561 bp, Glycine max
  Peptide Sequence Number=SeqID_117520
atggtttcagaggtatcatccccttcgaaaaaacatattgcagcagtagggactaccagcaacaacatgctatcaaagagaaaaactctagatgagggttcactgttatcaagcaagtcagagacccagcatgaccacagattcacctccactccttatgttcccatggacccgggtatagggcccctttacaactcacccccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 25836 - DNA, 63 bp, Glycine max
  Peptide Sequence Number=SeqID_117521
atggtgaccctagggctgcaaactcgtgaaatccgtgcaggggtgctcgcccaggcgagctaa

SEQ ID NO: 25837 - DNA, 342 bp, Glycine max
  Peptide Sequence Number=SeqID_117522
atggaaacaaaagaaatacggatcaaggatctcccaatcatgtggctccgcatgccaccgggctcttgggtcacgacctacgtagttcttgacaactgtgagactaaaaatagtctcggtgttttcttcaccaaaatgcgaacatgctttagtaaagagacaaaacttccaactgatcagagcaacagatgctttttggatgaaaaacaatgtgtctatcggggaaggagatgttcggacgtagaaatcgctagtacagtggatcctttggttggcaatcaaagaggagagggccaacttggtcgtggttgtctctatatgacactttttttgtttacttag

SEQ ID NO: 25838 - DNA, 279 bp, Glycine max
  Peptide Sequence Number=SeqID_117523
atggcgcttagtgcatcctttcccgctaagcccagtgtcgcaacctacccttcggcgggagggcgacgcgagactcgcgggatgcatgttccacaaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgcgataaggaaatcagacctacgtag

SEQ ID NO: 25839 - DNA, 420 bp, Glycine max
  Peptide Sequence Number=SeqID_117524
atggctagatttttgaatggcttgaatagggacattcaagatgtcgtagagcttcaaagctacaacaacatggatgaacttatatatagggctgtgaaacatcttgaaaggaagtctttaagaggtaatcctacttctcctactcaagcccttcccaataaaagtagtttcattaaatgctataagtgtttgggaaagggtcatattgcatcccaatgtcctaaaaagaggaccatgattgtgttggagaaaccagctcgcctgggtgagctgcaactgcctcaaagtgaccctttgcctataaagatctatggcttctataaagatctgcattcgggttttccaatagtgataaccctcgccattgaacataagaggcctattaatagaatttccctcaagaaatggaaagttggatga

SEQ ID NO: 25840 - DNA, 90 bp, Glycine max
  Peptide Sequence Number=SeqID_117525
atggtttttatcaaatcttctttgaggatactggagaagatgatagagaaaggaggaaaacaatggcataaaattgtgaaccctatataa

SEQ ID NO: 25841 - DNA, 573 bp, Glycine max
  Peptide Sequence Number=SeqID_117526
atggggacaaatcaaatcggaaaaatattctatcaagtcaagattaagggcctagatgtctccagccttaaagagttaggccagttgatgggtcagctccagcgccaagcatttcgcaaagcttacggtaaaatctgggacttagccatggtagaagtctccacagaggccattgcctccctcgcccagtattatgatcagttgttgagatgctttacctttggggacttccagctgtcacccatggtggaagaatttgaagagatcctaggatttcctctagggggaaggagaccatacctcttctcagggttccatccctcattagctagaatttcaaagatagtccaaatctcggcgcatgaattagactatggaaagcaagtcagaaatggggtggttggaataccgaggaaatgtttggaggaaaaagcaagaaccttggtaggtagaggcgagtgggccccgttcataggcattctcgcattgttggtctttagaggagtcctctttccaaatgtggatgggttggtggatctagctgtagaagcaaagcttcatggtgaatcaaag

SEQ ID NO: 25842 - DNA, 330 bp, Glycine max
  Peptide Sequence Number=SeqID_117527
atgccaatctcccctgcagatgcccacaagacgcccggtgggcccaaagaagtccaacagggccctggggtttccagctctggttacgggcctctgtcagtcctacagggtgcccgttcccccagcgaggaatcgcaccaacaaagacacccagtggacccggagaagtccaacagggccctagggtttccagctctggttacgggcctctgtagtcctacagggtgcccgttccccccggcaaggtcacgtcatcatagggatcgcacctgcaagacacccagtggacccgaagatgtccaacagggtcttggagttgtcaagctctaa

SEQ ID NO: 25843 - DNA, 273 bp, Glycine max
  Peptide Sequence Number=SeqID_117528
atgcccttacggacactattcctacttccccatcaaggctctgataccagagatcagcggaataagatcaaacggacagataggaaatatcaagggcacaccgaaacggcttacaaacccaggtttttgaaaacaaagaaaccgaagcggcggcagagccgcacaggatcggtggagggagaagagagaaggatgaaaaatagaaatttattgaatctagaaagaagcgcttacaaaaatcttgtttcagagcacctctcttccgaaacctga

SEQ ID NO: 25844 - DNA, 405 bp, Glycine max
  Peptide Sequence Number=SeqID_117529
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcggtatcagctcactcaaaggcggtaatacggttatccacagaatcagggataacgcaggaagaacatgtgagcaaaaggccagcaaaaggccaggaaccgtaaaaggccgcgttgctggcgtttttccatag

SEQ ID NO: 25845 - DNA, 346 bp, Glycine max
  Peptide Sequence Number=SeqID_117530
gacctttgcccgagaatgtctttaatccgaaagcgtggggtgcttcgccatcttgttcctccacccacttttcctttccctttgacgtccgcgggttggactgctgacaacgagctgacgtcggtggcttcttcttccttctccctcggaggcgtatatctccatggtactgcgtggctactttggtatgggaaaggaacagtatatcaccaagggtttgggcttcgcaacactgctcccatccgtggactgcatgctgtcgcaacctacccttcgacgggagggcgacgcgtgactcgcgggatgcgtgttccacaaaaggaatacgcgcggagtcgccaccaac

SEQ ID NO: 25846 - DNA, 204 bp, Glycine max
  Peptide Sequence Number=SeqID_117531
atgatgatgacaaaagatgatgacaaaggtgatgacaaaaagctcaaagatcaatcaaagaacaactcaaaagaattcaagactcaagaagaaagtctagagacaagaatcaagattcaaggttcaagatctcaagaatccagatcaagattcaagactcaggattcaagaatgaagagaagactcaatcaagataagtattaa

SEQ ID NO: 25847 - DNA, 375 bp, Glycine max
  Peptide Sequence Number=SeqID_117532
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcgggtcgttcgggctgcggcgagcggtatcagctcactcaaaggcg

SEQ ID NO: 25848 - DNA, 135 bp, Glycine max
  Peptide Sequence Number=SeqID_117533
gggcaggatcatcttgagctaccttctggggtggggacaaaacatgaacagcagaaaccagtcaaggtacttaggaacggatgcaagtggggatggagtcacgaccgactggtcattgccccttctccgtgctaa

SEQ ID NO: 25849 - DNA, 228 bp, Glycine max
  Peptide Sequence Number=SeqID_117534
atgagaaagcgccacgcttcccgaagggagaaaggcggacaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtga

SEQ ID NO: 25850 - DNA, 105 bp, Glycine max
  Peptide Sequence Number=SeqID_117535
atgcctatagtttttcttcaaattccaaagattcttacttcattcatagaccataaatacgagtcaatcgtcgcacttgaagtacaaaagggaggttcaggatag

SEQ ID NO: 25851 - DNA, 117 bp, Glycine max
  Peptide Sequence Number=SeqID_117536
ggggagaatatggagaattaagtgagaaatcaactaggaaaaagaatgtgtatgtgtttcttgatttcagggttgtcatcatcaaaaatggggagattgtagaagcaaagcttcatg

SEQ ID NO: 25852 - DNA, 156 bp, Glycine max
  Peptide Sequence Number=SeqID_117537
atgacctttttcatcatggcagaacaagctaaacaggcaaatggctacaccacccagctctcctcctcttcctccttcgactggtgcagcatcacagtcgccatctaccttgaagcgcacaagaaacgccacacggctaagatcattggtgactag

SEQ ID NO: 25853 - DNA, 153 bp, Glycine max
  Peptide Sequence Number=SeqID_117538
atgccgatgatgaagactatgtacgggcgacttggatcaaattcttcaagtgaaaattacgagcacgacatacatgatgagtttgctactataaatgaccttgagtcatggaaaagaaaggcaacttttcaatgcaagaaacaatttagttaa

SEQ ID NO: 25854 - DNA, 297 bp, Glycine max
  Peptide Sequence Number=SeqID_117539
atgactcaacgtttagccacgccgactttttctagttcgcgcaaggtggtcaaactcgccagtgtactgtcgattctgttttcgccgcttgcaaacccggcatttgcagatactgtatggcttaaaaatggcgataaaatcactggcacgctaggtgtcaaaatttctaacaagctcacggtcaaaaccagctatgccgatgaggtcaaaattaactggaacgatatccacagcatagacgctgaaaaacccatactcatgcagttgtctgatggcagcatcgttaatgggcgcctg

SEQ ID NO: 25855 - DNA, 204 bp, Glycine max
  Peptide Sequence Number=SeqID_117540
atggtttttcacttaaggcttgtagtgagcttcaaaacaaggaaagggaaacaaggctcaaaagggttatcaaaggaattaattcaaggacgcatcacaagaccccccatcactagccagcttttgcactcctgggcaaaagatacaaagaacaaaatcggatataagaggagagctcaaacaaaggaaaccatttcaatatga

SEQ ID NO: 25856 - DNA, 396 bp, Glycine max
  Peptide Sequence Number=SeqID_117541
atgacaggtcttgcgagtgagggagaaaagaacgactttgtttgtgagactgagcgcgcagggggaaaaaggttttgggttttaatttatatcacaacattcggctccattgtcggcatgatccgcctattcttcaatccctcaatgttccacgagctcctctgtgcggtcatggtcagcgtcttcacgctcctgcatggcttcaaaggaagctacatcaaaagtgtgcttacggagttgataaatctagtttctcagaagtcgcaacttctaaaaccctacatcagcgatatggttcttgacgtgcttccgattgccgagagtggtcagcttgagtgttttgttgattttgggagttatatgtccattgggctagtttctccaaatattagctag

SEQ ID NO: 25857 - DNA, 846 bp, Glycine max
  Peptide Sequence Number=SeqID_117542
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccgatcaataacaagaagcaacccaaagagtatcattcccatgaaagaccgtaggagacgcaacgccgtcgtttcatggagcgcgctcttttggtgcaccctcctcctcgtcttttccaccatcatcttcaccaccctaatcttctctcccttcatcaccaccttctctcacccattcaaatggatcaaaacaaccactaccaactctcgcgccacaatcacaatccgcggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 25858 - DNA, 516 bp, Glycine max
  Peptide Sequence Number=SeqID_117543
atggacatccgcgtaaaagtatcatcgtttgaattgatacgagctccgtttcaacttggagcatctcgatatattacgggactcaatcagacatccgagttaaaagttattgctgtttttatttgctacgagcatccattttcaatttcgagcgtctcgatatattatgggactcaatcggaaatccgagtaaaaggttattgtggtttgcttttgatacgagcttccgttttcaatttggagcgtctcgatatattacaggactcagtcggacatccgagcaaaaatttattgactcaatcggacattcaagttaaaagttattgcggtttgcatttgatacgagcttccgttttcaaattcgagcgtcccgatatattacgggacacaatcggacatccgaataaaaagttattgtcgtttgaatttgctcagtacttctgctttcaattcggagcgtctcgatatattacgggactcaatcggacatccatgttaaagtttaatgtcgtttga

SEQ ID NO: 25859 - DNA, 447 bp, Glycine max
  Peptide Sequence Number=SeqID_117544
atgcataaggcattatgggccaatgcacctctgccttatcctcaccttgttactctttttcttcatcatttcaatattcctttggatgataaaccatttgtcaaggtaaagaggtctttctctattggtgctggtgcggttatctcctttggttaccgaaaggatattgatggtcagtgggttcgcaaacatgacttgcctccgcctattcctgacgaacgtaccccatctcctccaccacaacgggatgattccacttctcttctgactaaagtcctcacagaactctgcggtcttcgagcatttgtgggtgaacactttaatgcgatggatactcgccttgatgcaatggatactcgctttgatgggatggatatgaggatcactcgactcgaagatgatatgagcttcattaggcgttgcttcgatcctccggccgactcttag

SEQ ID NO: 25860 - DNA, 225 bp, Glycine max
  Peptide Sequence Number=SeqID_117545
atggaaaaatctgacaagagaaatttcaaagaaaagaaagaaaagaaagcatacaacacttgggaagataatgtagaagcaaagcttcatggtgaatcaaaggtgattcaaaggtgttttgatgataacaaaggtgatgataaaaagctcaaagatcaatcaagaacatttcaagagttcaagataagaataaagaagaattcaagactcaagaagaaagtttag

SEQ ID NO: 25861 - DNA, 680 bp, Glycine max
  Peptide Sequence Number=SeqID_117546
gcattggagagattcagagacttactgagaagaactctcacccatggattctccgagccaatccaactgaatatgttcatagatgggctgagaccacaaaccaagcaattactagatgcttatgttgggggaaaaataaagctgaaaacccagaagaagcaactgagctcatagagaacatgtcagccagtgatcatgccatcctgagggatagaacccatcaacccacaaagaagagcctgttggaactaacatcacacgatgccttgttggcacagaacaagtcacaggttgtaccatttgtggtgaagctcatgagacaagtcaatgcattcccactaacactcaagaaattcatttcatggggaatcagtagaggcaagggtacactcaaggagggttttcaggcttccagcaaggtccttataatcagcaaggacaatggaggacacaccctgacaaccagttcaataaagaccaaggtaacgatgtcgaatcataagagtactgagccagcactagagaaccttgaagtacaaatgggacaactagccaagcagatggctgacaagtcatcaaacagctttggagcaaatacagaaaataatcctaaggaggaatgcaaggctgtcatgaccaggagtaaaaggtttgtggaagatgaggatgaagaaaatgtg

SEQ ID NO: 25862 - DNA, 636 bp, Glycine max
  Peptide Sequence Number=SeqID_117547
atggaaacatgtttagcagtggaggaccttttgcaacagatgatagatgaaggccgactggaagtcggcgatgagaggagggaagagcagcatatatgtatgcaatccacagatgagaaaagttttggaaggcctaagcctttagtcgtatttttcaccagagacgcagctccccaaacgccccgatacccctcggtagttaaacctgttccatttccataccaaaacaaccacgcagttccgtggaggtttgcacctccaagtgaaaggaaggaagaggccaccgacattagttcattgttagccaaggtaactaatatcacggggctgagcggcgtaacccgcagcggttgcgtgtttgcaccccccgacttgccgacacaacccgcaaatcttaaagggaaggcaaagatggtggaagaacaaaatgacaaaacgaccctcactctgaacgaggatattttagtgaaaggtcttctggagaaaagggatggttgtggaaagaaggaagtatcgctagaggaagcaagctttggaggactcgtcaataacatcatcgccaacaactatcttgccttcgccgaagaagaaatccctgtcgaggggagaaggtataatagggctttgcatgtgtaa

SEQ ID NO: 25863 - DNA, 394 bp, Glycine max
  Peptide Sequence Number=SeqID_117548
gtacacgatgaattcggttataacagtgttgtatttcaatggaagggtatatgaagataatgatggtgtaatatttgaaggcagtaaaaaagcgattcagattaaacgtggaattagtttcaatgctttgaagaaaaaaattggagacaagacatatcagtgtcatggccctcgaaaggatactgatacatctgcgaaggatactgagcaaatgttggtggcgtgtaatacattccatgaccacgctgctccatatgttgggaaaaatcttccgcttgaacaatctcccttcgtctgtcaaaacctcgagtttcaacacttgactgaagcatgtgaaactcttgtgggggaaatcgacgctctgatgctggaccatgtgccacaggctcagtga

SEQ ID NO: 25864 - DNA, 453 bp, Glycine max
  Peptide Sequence Number=SeqID_117549
gccacacttcaagaactctgtagcacgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatggggatcctctag

SEQ ID NO: 25865 - DNA, 619 bp, Glycine max
  Peptide Sequence Number=SeqID_117550
cgccacgcttcccgaagggagaaaggcggacaggtatccggtaagcggcagggtcggaacaggagagcgcacgagggagcttccagggggaaacgctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtttcccgactggaaagcgggcagtgagcgcaacgcaattaatgtgagaaacagctatgaccatgattacgaattcgagctcggtaccctagattacttgttattaagaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 25866 - DNA, 192 bp, Glycine max
  Peptide Sequence Number=SeqID_117551
atggcgtttttccaaagctctttggggtacaagggtcaaaacgccaaagtgaaaaaggctttcggaaacggaagggtcacgcacactccggagggggttacacccccccccccccccctctctctctctttcttttcctccattgaaacttcctccctaagcttcttatccaaggcactctcttggtggtga

SEQ ID NO: 25867 - DNA, 450 bp, Glycine max
  Peptide Sequence Number=SeqID_117552
aaacacttggtaagttgccatctaaattgcctattggtcaacctacgcattcttctgtttgcaggttgcatgttgtaccatttgtggtgaggctcatgaaacaggccaatgtattcctagtgaagaacacactcaagaagttcactatatgggaaatcaacagaggcaaggatatactcaaggaggattttcaagcttccagcagggtccttataaccaacaaggacaatggagatcacaccctggcaatcagttcatcaaagactaggaggactactaagctagaggagactttgactcaatttatgcagaatcctaaggaggaatgcaaagctgtgatgacaaggagtaagaggtttgtggaggcagaggatgaggacagggttatcatgcctaagaagaaagctgctgaaaagaaaggtactgatgataagaaagatgatgtgagag

SEQ ID NO: 25868 - DNA, 291 bp, Glycine max
  Peptide Sequence Number=SeqID_117553
atgcacacacgaagtttcacaattccacactttcctaaaataggcctaactcacaaaaacagtcgccaactgtcgcaacctaccctttggcgggcgagcgaggcgaggttcgcgggtgcatcttccaaaggaggaaaatgcgcggagtcgccaccaacgcttatttgtggaaaacgtcggaaaaaccgaacgaaactggtcatgaagaatattccagattcgggagttgtatttacgtttgaggaaggtattagcacctctaacgtttgtcccaaaggacaacagccttag

SEQ ID NO: 25869 - DNA, 297 bp, Glycine max
  Peptide Sequence Number=SeqID_117554
atgagaggaagtcaaagaagacaaaacttcaaacctaaaagaaggactgaagagtcatctcaaatcccaaaatgctttgagtgcaatcaacccgggcatatgagggctgattgtccaatctttaagagaaagatagagaagtctgaaaagaagactattggagataagaaggcctatatcacatgggatgataacgacttaggatcgtctgatgattctgaaaaagaaatggttaatctatgtctaatgggcaaaaattatgaaagcgacaaagagcaaatatgtagaagaaattaa

SEQ ID NO: 25870 - DNA, 294 bp, Glycine max
  Peptide Sequence Number=SeqID_117555
atgaaggccgacatggaggccattaaagagaaaatggccacaatgatggaggccatgatgagcgtgaagaagataatggaagccaatgcggttgcaattgccgctaccagcgttgttgctaaggtgaacctgatgtccccatccggcatcaaccaaaatgaatcatccaacctcatatatgaagtatgcccgagtcatgtcatccctatgagggaaatattggcatcagaattggccattaaggaggccttgaagattatagggctttgcaaccaaaagatgcttgttccatag

SEQ ID NO: 25871 - DNA, 429 bp, Glycine max
  Peptide Sequence Number=SeqID_117556
atggaggagggattttctaaaggattagttcccatcattctaggcagaccttttatgaaaactgctagaactaagatagatgtatatgcaggcacactatctatggagtttgctgatataactgttcattttagtattcttgatgctatgaaacacccattgatgcaatcccaccctccaagggcattggatagaagactccaagaagattgggccaaagatgcaagagaaggccctagggttctcatgagccttaggggcaccgagactagtttttgtattaggggtagtgtcgcaacgtgcccttcgcgggcgaccgagggcgaggcttacgggtgcgctttccaaaggaggaaagatgcgcggagtcgccaccaatgtttatttgtggaaaacgtcggaaaaaccgaaggaaaccggtcaaaatga

SEQ ID NO: 25872 - DNA, 370 bp, Glycine max
  Peptide Sequence Number=SeqID_117557
gacagagagcttaagggaagcagtaaatgggatcatcggcggctatcataagtggctgagagtccgaacacaaggattggattggctcccaaatctaaagactgtgagggacgatgaggttaaagcttcggaagaaagtgatgaggtacaagccctaaaggcagagcttgaaagagcccaggtagtcgaagagaatttcaagtccatagccatcaaatcgagctcaagtcgaagaggtttgaaaggaaatcctgggatgcccactgggcagaaggaagccatatcttttctctgggttctatccctccacgagctaagagttgccaaggtggtgaaaaaatctcagcacaagcagttagcgagaccgtga

SEQ ID NO: 25873 - DNA, 301 bp, Glycine max
  Peptide Sequence Number=SeqID_117558
atgtctcttgccactctctttggaaaacttcaacaacatgaaatggaacttatgagacttcatcaccatgaagagaatgatataaagagaaaaggaataacactcagaacctcatcatcttttattcaagaagaaagtgacaaagaggacttgactgaaacagaagaagatgatgatgatttcagactctttgtgaaaagattcaataaatttctgagaaacaaaagaaataaaaggaaatcaaacatgaatacaaagaagaaagaagaagactcctccttagccccatcatgctatgaaa

SEQ ID NO: 25874 - DNA, 663 bp, Glycine max
  Peptide Sequence Number=SeqID_117559
atgaatcgagtatgtatgaaggggtcagtcaagcggttcgggttctcggtcggttcccgttcgcccgccccccctcatagtccattagtgggtagggtggtcaacttagagggcgcccgcctcctcttcagacgtgtcttcgacaacctggcggttgttcggtctccgcttttggaggcgggagtgcttggtcgctggggtttccttttcctcaaccaattcggttgtgtcagccctgagattggttggtctaacatttatgagctggctggacaaagatggatggaagttccgtgctgctcgccactccccgaggccaaggacggggtcgaaccgtcattccaggatttgcagtccgatacatttccattatgttacccagccaaacccgccacctcatgtgccaaagtcaaacggttgttcttccttccccgctccctctttttctacatatgcgggcggagcactctatatgaccggcggcgggttaccagagaagaggggacaacttctttctcccttgccttgctccattttccttttctgattgaaagtcgcaagccactccactactggtacagaggccagaaggttgcttcctccatatgttcaggcaaagaacatctagaagctagcttttgtcttgtaagcaaccatgcctaa

SEQ ID NO: 25875 - DNA, 501 bp, Glycine max
  Peptide Sequence Number=SeqID_117560
atggatagaggcatgacactaactgatgctcctagatctagcatggcattatcaaatttactgttcccaataatgcaaggtgggaatggaagaagggacaggcggctgtaccatctgccccatctgatttgtcagactttgaatggaggctattatctcttgctgaaattgcatattatgcatggtcattttgcctcactaactcttctaagggaggttgaggaggagcctaagttgcttgttgtctttgtggtgactgctgctattgctgttgctgtattggaggaggaacatatggcttgcttggaccagcaacattttgaaaaggagggacagactgttgttgttgtggaggacttgtccatctcagatttggatgattcctccaacctggattgtatctattgcttgaaaggtcataattattctgctgttgttggttttgctactgaggaggtctattataaatgtttgcagcataagcttcaagttgctcattga

SEQ ID NO: 25876 - DNA, 60 bp, Glycine max
  Peptide Sequence Number=SeqID_117561
atggcagtggaggttcttttttccgtcctttacatgttatctcttttgttcatcttctga

SEQ ID NO: 25877 - DNA, 820 bp, Glycine max
  Peptide Sequence Number=SeqID_117562
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggggagggacgaatcaaagcgacagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtg

SEQ ID NO: 25878 - DNA, 342 bp, Glycine max
  Peptide Sequence Number=SeqID_117563
atgaattgcatcttcatggggtcgcgtggttcgtactggatgtcaaactctgaaagttcgatggaacaagccaccatctttcttacgagttcaggatttctcaaaaacctgcttgatggggtagttcgtcttgactaccacttgatgactcgggaagtaaggcttgagtcgttgggccaagggaatgagtgggctgagctgataacttcgtcaattactgagagatacaagagcaagggtgctcttggccttgatcgactcaaagatggtagtgtggttatggtcttcttgaaagctagaaaggcttgttcacaagtctcgttcccattaaaaaaggcttaa

SEQ ID NO: 25879 - DNA, 348 bp, Glycine max
  Peptide Sequence Number=SeqID_117564
atgaccccgacgacgcacgacatccatcccgcgaccgacggcccgctcgccgacacgctgctggggatgggcaagttcctccgcaggggcgaggtctctgcggatctgcggtcgctgttcctcgacggtggtcgctccggcgacgtcttctaccgcgatcgctgggcccacgacaaggtcgtgcgctcgacgcacggagtcaactgcaccggctcctgctcgtggaaggtctacgtgaaggacgggatcatcacctgggaggcccagcagaccgactatccatcggtcggtcctgattccccccgagtacgaaccgcgcggctgtccgcgcggtgccgccttcagctg

SEQ ID NO: 25880 - DNA, 275 bp, Glycine max
  Peptide Sequence Number=SeqID_117565
ggaaagctgctgcttcaggtgccgtatccaaggatgccttgattgctgaactcaaggacacatgcaaggtgctggaggcaaccatcaaagccaccacagagaagaaaatggagctggaacggctaatcgaaagactcacagacagtggcattgatgatggtgaagcagctgaggaagaagaagcagctgaggaagaagaagaagtttctgtggaagaggaagatgcagcagaagatacagaatccgatgatgatgattctgaagccaccccatga

SEQ ID NO: 25881 - DNA, 306 bp, Glycine max
  Peptide Sequence Number=SeqID_117566
atgagtgataaacgcgcagagacaaattatggccattctgcgccctttgtcattcaggagcagcaagtcgatgagtcgagaggtgggcagagacaaattatggtcattccccacaccttttcgccatccagaggcgatcgtgtccggtggcacgcagagacaaattatggtcattctacgccttgccacctaggctcgatcatccccgagggcacacagagacaaattatggtcattctacgccttgtgtcaaccaaaaggaacgaactcggcagtatcaggatgatgttggtcgttcggtgctga

SEQ ID NO: 25882 - DNA, 417 bp, Glycine max
  Peptide Sequence Number=SeqID_117567
atggatgattacaaatctttgcaaattgagtttgaaaagttaaaaaaggctcacaacaaagaacgtacgaagttgaaaattgagttttcttatcttaaagatttgtttagaaaaataaacaaagtaaagagtgatcttagtcacttgctcaatgtgaaaaggcattctaccgagaagactagtttggggtataacaagcaaactaccttttctaagaaaaccaagtttgcatcctccaaaaaggtgaatccaaacaaagtcttcaaaaagaaaaacatagtgcaatccaagcctaaagcaaaggcttgtcattattgcatgaaaagaggacaaacatcttataaatgctatgttaggagatttgacgttcctagaggtgtgcctaaaagcaagagactcactatcgtacttggatag

SEQ ID NO: 25883 - DNA, 273 bp, Glycine max
  Peptide Sequence Number=SeqID_117568
atgaaacacaactccaaactcgaaaatggaggacacattgtcgcaacctacccttcggcgggagggcgacgcgtgactcgcgggatgcgtgttccacgaaaggaatacgcgcgaagtcgccaccaacgtttatttgaggaaaacgtcagaaaaaccggaaaagacgcgatctacgaacttttaagtgaaaggttcgggagttgtatttacgcacggggaagcaataacattcatgtggctccgaaaatgggtgagaatggaggattgccttga

SEQ ID NO: 25884 - DNA, 439 bp, Glycine max
  Peptide Sequence Number=SeqID_117569
gcatccgattgaaacaagtatgcgagcggggaattcctatgtgtatggattcctcgagtcacagtctattcagagatctaggcaatcacagtttgactccgaaagttacatcaagagttggatgcagagttcaaaacgcgatgtctaccttggagcctacttaaatggcgaacactggcaaatggtggtcattctgccgaaggaaaaccttgttgtctggttttgttccttgcataacaggccagacaactaccttaagggaataattaacagtactttgaaagaacttgatgatactccacagcctaaatccaaggctgccgctaggtggattgtcgttaagtgtaatagacaaaaaggaagcactaagtacggctattacatcatgcactggatgtccaccatcatcttaggaagtttgaggaataactgggaagcg

SEQ ID NO: 25885 - DNA, 496 bp, Glycine max
  Peptide Sequence Number=SeqID_117570
gaagctcaaaggcaatggaaggattagcatgggcagaaatgtgttagcattgataggtaaatttgttcctcacattcctaagaaatgtaaggacccaggtactttctatataccttgcattattgggaacaacaaatttgagaatgccatgctagatttgggagcatcagcaaatggaagtgttgcttaccccacaggtttcatagaggatgtgttggttcggataattgatcagattgttgatgattatatgtttgattttgattctcttcatggtaggaaacatccatttttatctgatctgcatacttgtcattccttatgcattgaatctgaatctgagtttgaatttgatcctatatctgatttttatgctgagagtaaatttgaatttgagtctggttctgattttctgggtgttgtacctcttgatgctgagaaaccttcttcttcttctcctaccctagttcctcccactgttcagccaccacccaca

SEQ ID NO: 25886 - DNA, 708 bp, Glycine max
  Peptide Sequence Number=SeqID_117571
atgaatacattgcctaggactgttcatgcatcctccaccaacgagtctgcaggcctgcgaattgattgcctagcgctgttacccaaatctccattgtccacttttattcggagacccatgaattcattgcctagcgctgttcatgtgtcctccaccttcgagtctggggccccgcgaattgattacctagcgctgttcgccaattctccattctccacttttattcggagcccaatgaattcattgccaagcgctgttcatgcatcctccaccaacgagtctggaggctcgcgaattgattgcctagcgttgttcgccagttctccattctccacttttattctgagccccatgaattcattgcctagcgctgttcatgcatcctccaccatcgagtttggaggccttcgaattgattgcctagcgctgttccccagttctccattctccacttttattcggagccccatgaattcattgcctagcgctgttcatgtgtcctccaccttcgagtctggggccccgcaaattgattgcctagcgctgttcgccaattctccattctccacttttattcggagcccaatgaattcattgccaagcgctgttcatgcatcctccaccaacgagtctggaggctcgcgaattgattgcctagcgctgttcgcccattctccattctccactttttatttcggagccccatga

SEQ ID NO: 25887 - DNA, 849 bp, Glycine max
  Peptide Sequence Number=SeqID_117572
ggtaaactgctgcgcgccggtcaggagcaggtggtgactgcgctgccgctttatcacatctttgccctgacggtgaactgtctgctgttcctcgacctgggcggcaccaacctgctgattaccaacccgcgtgatattcccggcttcgttaaagagctgagcaaatttccctttaccgccatcaccggtgttaatacgttgttcaacgccctgctgaacgatgccaattttaaccagctggatttctccacgctgcgtctgtctgccggtggtggcatggcggtgcagaaagcggtggccgagcgctgggagaaactcaccgggcactatctgctggagggctacggactcaccgaatgctcaccgctggtgtcggttaatccgtatgatattacctgccacaccggcagcatcggtttgccggttccgtccaccgacgtgcgtatagtcgatgatgaagaccgcgacgtgccaccgggcgaaccgggtgaactgtgcattcgcgggccgcaggtcatgattggctactggcagcggccggatgccagcgaggaagtgctgaaaaatggctggctgcacaccggtgatattgttaccgtggacgcggaagggtttatccgcatcgtcgatcgtaaaaaagacatgatactggtgtccggctttaacgtgtatcctaacgaaatcgaagatgtgctgatgcagcacgccaaggtgcgcgaagcggcggcgattggcgtgccgagcgatctctccggcgaagcggtgaaagtgtgcatcgtgaaaaaagatccatcgctgacgaaagagaagtgctggatcattgtcgcccgtcagctcaccggctataaa

SEQ ID NO: 25888 - DNA, 705 bp, Glycine max
  Peptide Sequence Number=SeqID_117573
atgggttctccacctgcctctactactcctcctccttctcctccttcacctcctcctcctcctcctacttcggacgcatcggcttcgatgtctgccagaccagtggtgcatgttgatcctgctacagggaaggccgacggtccccacaagaagaaattaaaacatatttgggggattgtggcacgtgataaggtggacatcacctacgagaactggaaggaggcggaatttgatatcccagaggcttctgacagtaggacgaaaaggaagttactacagaccgtgggggagagatggaggcagtttaaatcagacctcacgaggaaatgggcccttgcagccgatcaggacggtgtcgaggacactgtctgtgacaaatacggcatcagcaaggaaaagtgggcccagttttgccagactcgcagagacccttcttgggaggatgtgcgcatgaaggcacaggccatccagaagcacaatactgccccccacgttttgtctcgtgggggttatgattatttggagcagaagctcctggctgagaagaccaagaagaagatgcaagaagccacacagtcaggaagcgttgatggcgtcatcgaccctccatccccggtcagacgccacgtgaagtggaagatggcctgcacgaagaagacaggggagatgacgactgaggccgcaaaggaaatcgctgagaagatt

SEQ ID NO: 25889 - DNA, 255 bp, Glycine max
  Peptide Sequence Number=SeqID_117574
atgtcctcaccttcaaagggctacatgcccccgccttcagaggactacatgtccttaccttcagaggactacacgtcctcgccttcaaaggactacacgtcctccacttctagagtagcaggcaacaggcgcaccgctaccacctctagagttcacctcagctcatccacaaaaagtaggacacacctagttgctcatgatcctaggaatttaaataaaacaagcacaagctcggaaggtagcaagataccttag

SEQ ID NO: 25890 - DNA, 320 bp, Glycine max
  Peptide Sequence Number=SeqID_117575
gaaagaccaaggtcaaggcatcttaggggtgacaccttctaagccaaaagatgataatggaaagacaatagaaaagcaaccccttaaggctagtatgcaagagaagactagctccataaatagccaagatgaggctactacttcaccttcctctagtgaaagtgatgaagcaaaagagaaagaatctagtgaagaaatctacccccaaggagaaggacaacctttaatggttaaggaggagtgtgaggagacacttgttagcattgccacacctcttgggcttgaggttattcctgaagtaaaggagttattggatgagg

SEQ ID NO: 25891 - DNA, 507 bp, Glycine max
  Peptide Sequence Number=SeqID_117576
atggggacaaggggttgcatcatttacaatcccgttcttgctataagacagcttggctaccctatgagaggggcaccactagaggaagagctcacacctattattgcacgaggtttcaataacaccaacgtggaggcgcttcagaaggtccgcaaggcatgggagatggtgcaaaagaaggacaaggaactcataggtagtaacaatgggcctatcggcggctaccgtaggtggttgaaagcccacatgcaaggtctagattggctcccgagtttgagaaccactaaaggggtggaagttgaagcaccggaggaagacgaagaggtgcaggcccatagggtagaactcgagaaagcccaaacagtcaaagaaaagttcaaatcagcagctcttaagatccgaaaggagaatgccaaactgagagacgtaaatatagctaccaccaaggccttggaacaagagaccaaaagggttcgtagggaagaacatggctggaacaaattctga

SEQ ID NO: 25892 - DNA, 498 bp, Glycine max
  Peptide Sequence Number=SeqID_117577
atgaaagctaaaagcgaggactttgagttctacgaatggattattgatggagaggcattgtttaagtctgcctttgatcatgggcccttcaagtgcttcatgattgattgcctctttctaaaagacgtgataactcatgagacctcatcgtatctttttgcaaatctcttcagggactccctcaaagtgtatggaccattgtttgatggctgtcataccctaatttcgtctggggaccattgtttgatggcctgcaacctttgcttgaccgcttcgaggtacttaacacccatcattaggcaatctgtgaagttctgcaacaagccggaagtcgaaaggaagcattgttgcgcaatccgtaaagttctgcaacatcccggaagtcaaaaagggattattgcgcaatccgtaagtttcgaagcagggttgcttattgaggaagcaacccagctcgcttgggcaagctgggtggcaacctcatccccccttttcctataa

SEQ ID NO: 25893 - DNA, 606 bp, Glycine max
  Peptide Sequence Number=SeqID_117578
atgtgtgcagttaagaaggtgatatggaccttccggcttcccgtgacaaaagacaagaccaacatacaacgcgtgtgtgacgacatgatgttgatgcgcaaaaagcataacatggggatgtacccagtatggcaatatctacaagtggtcatatctcttttgatggtttctagaggtatcatccccttcgacaagcatattgcggcagtagggactactagcaacaatatgttatcaaagagaaaaactctagatgagggttcagtgttatcaagcaaatcgaagacccggcatgagcacagattcacctccactccttatgttcccctggacccggcatcaaagagttatatacaagaccgtaagagaaataaaaggaaatcgacaaaagaggaagtcatgatattgcacgagattagaaggcctaactctctaaaaacagtccccagtggagtcgccaactgtcgcaacctacccttcggtgggagggcgacgcgagggctcacgggtgcatcttccatgggaggaaaatgcgcagagtcgccaccaacgtttattcgaggaaaatgtcagaaaaaccggaaaggtgtggtctacgaactttaa

SEQ ID NO: 25894 - DNA, 291 bp, Glycine max
  Peptide Sequence Number=SeqID_117579
atgtggaagaggataaggagggtggaattggtgttgtggatgcgctggtggctccggagcgatgagctcttgaagccgaagcggaggtggatgaacccttacatttcaatcggtgaaatcaaaagaaaaatgaaaaagaagaagattgcaagttacgggagtcgatttgatgaagaaatgagtaagataggaaggtttggaggtttgggaatggaggaacgtcgcaagggagaagaggctgcgcaggggtttttgaaaaacgtgatatttatagaccaggatgcattgtaa

SEQ ID NO: 25895 - DNA, 526 bp, Glycine max
  Peptide Sequence Number=SeqID_117580
atggggacaaatcaaaacggcaaaaggttttatcaagtcaaggttaagggtctagatgtcaccagcctcaaggaattgggacggttgatgggacctctccaaaggcaagccttccgcaaagtgtacggaaagatactagatttgaccgcagcggaggtatttacggaagctgtcgtatccctcgcccaatactataatcagccgttgaggtgcttcacgtttggggacttccaaatggtaccgactgttgaagagtttgaggagatattagggtgccctcttgggggaagaaaaccgtacctattctccaggtttcttccctccttgagtaaggttgcagttgtggtcggagattcggcaaaagagttggatcgcatgaagcaaactcggaacgacgtagtgggcctgccgcggaaatacttggaaggcaaggcaagggatatggtgagccaagagaagtggggcccatttgcggatacactggctttgctaatttttggggttgtcctctttccgaacgtggacg

SEQ ID NO: 25896 - DNA, 417 bp, Glycine max
  Peptide Sequence Number=SeqID_117581
atggcgcctactaggcaccctttagacccagataagtccaacagggccctgggatttccctcgctgatcacaggactctaccagtcgttcggagtccccgttgcacctaccaaggtaatttggccgcccatcacccgggcttttattgagaatatttacggcatttggttcgccagcaggcggccaaccaccggggcacatgtgcagacccatgattgtctgtacccatatgagccttcagcatgcagagccagggcttcgcttctttttcatgccctactccagaccatttcaagggcagaggttgcatgggcccggggatttggcccgaggcccaagcaggagaggcaccctcggaaattcccggtgaaggagaggagcccacgaaggacgaggagatgggccgattttgcttga

SEQ ID NO: 25897 - DNA, 285 bp, Glycine max
  Peptide Sequence Number=SeqID_117582
atggtgacccttaaatggagcaatttccaccctagtggatggggaggatatgccctcaagcaaaaattgaagttcattaaagcttgcattcgacagtggagctcatccaatggagttattaatgctaagaaaattcaggttttaaagaaggagctgaatgctttggaggctggtatctctgacagaattctgaatcaatttgaagtggagctcaagaagtctcttcaggagcaattgtggcatgctgctaatgcctatgaatctaccttcccttggtcaaagtga

SEQ ID NO: 25898 - DNA, 642 bp, Glycine max
  Peptide Sequence Number=SeqID_117583
atggctggacgaattccacgtgtatttatcaatgatttacttgcccgcacggacatcgtggatcttatcgatgcccgcgttaagctgaaaaagcagggtaagaactatcacgcgtgctgtcctttccataacgaaaaaaccccctctttcaccgtaagcggtgaaaagcagttctactactgctttggctgtggtgccaaaggcaacgccatcgacttcctgatgaatcacgatcgtctggatttcgtcgagagcgttgaggaacttgccacgcagcacggcttagaagtgccgtacgaagcgggcaatggtccgagcccgatggagcgccatcagcgccagagcctgtatcagctgctggaaggtttagacagcttttatcagcagagcctgcgcaatccgcaggcaaaatcagcacaacagtatcttgccacacgcgggctgagccagcaggtgatcgatcactttgccattggctatgcgccagccggctgggacaacgtgctgaagcgtttcggtcagcagaaagaagatcgtgaatcgctgatggaagctggcatgctggtcagcaatgacagcggccgcacctacgatcgtttccgcgatcgcgtgatgtttccgattcgcgacaagcgcggacgc

SEQ ID NO: 25899 - DNA, 502 bp, Glycine max
  Peptide Sequence Number=SeqID_117584
cttgcaagaaactccaccaaatgtagtcaaagagttgaaggaatatatggctaccaaaaaaagtgggaccacttacagtacttctggcagtggtaatatggaaaatataagagattttgaatttggtgaaccaattggatttgatggaagtgaagaagatgagtttgcggactcttgtaatgttactgcaagtgcaaagacaaagtgtggaactaaaaaaggaccaatggacaaattttgtaagaattcagaaaatgcaatcaatcggagaaaaatggagatgttgagacaaatgaacataagagagtcaatggataagaatgaagtattgaaggtgcatcaacatattgctcgcttttggtaccaagcagccattggtcaatatgggccatatttgccaattcctagctatcatgacatcagagttccactcctaaagaaggaagttgaatatactgaaaatttgatgaaaggccatagggagcaatgggtcaagtatggt

SEQ ID NO: 25900 - DNA, 90 bp, Glycine max
  Peptide Sequence Number=SeqID_117585
atgggtaagagcttgaaggtaggagaaaatgaggggagggagagggagagaggggaacaaaattttgagggagagaagatggagaatgag

SEQ ID NO: 25901 - DNA, 691 bp, Glycine max
  Peptide Sequence Number=SeqID_117586
atgctccatcagcttccaggcgcgtttgccctgacgacgggacatgcgcagctgaagctgccagatgtcgcgcaccagggtggtaatccgtttcggaatggcgagcgtgcggcagccttcgtccagcacgtcattggcggccagcgcgaacgcatcgtaataggcgagcccgctctcctgggtaatacgctgtgccgtttccagcagcggataccagaacatcgcggcaaagaggaacgccgggttcacgcgcatgtcgttgcgaatgcgggtatcggtatttttcagcacctgcgcaatcatccgctccattgggctgtcaccgttttcggtaaagtagcgggtaatggtcgggaacagcggctggaacaggttgtattcgcgcagaagtttgtaggtttcaaaaccgtggccggcctgcagcagcttcagcgcctcttcaaacaggcgagcaggcggcacgtcgttaatcagcgtcgccagacgcgggattggctctgccgtttccgggctgatgcgcatattcagcttggcggcgaaacgcacggcgcgcagcatacgcacgggatcttcacggtagcgcgtttccggcgtgccgatcaggcggatcagaccttctttcaggtcctgcatgccgccgacgtaatcgcgcacggtgaaatccgccacgctgtaataaaggctgttgatg

SEQ ID NO: 25902 - DNA, 267 bp, Glycine max
  Peptide Sequence Number=SeqID_117587
atgaaattccaactcggccagagaatcaaagggcagatgactatcttgcttggatcaccgctacctcactccctatctgattcttctcctcaggatattctattggcttattctccgacaatagatattcagagtatcccctatgagtggatattagttacaaaggaactagtcttaggacacttgaagaggcagaataacaagcagaagcaggcaaaaggctcaaagccaggctttaggaaagattcactacactatgaatattca

SEQ ID NO: 25903 - DNA, 60 bp, Glycine max
  Peptide Sequence Number=SeqID_117588
atggcacagagcgtgtttgctctatgcccctatttgggaacctataggatagtatctagg

SEQ ID NO: 25904 - DNA, 240 bp, Glycine max
  Peptide Sequence Number=SeqID_117589
atggattcatcaagtgattcagaaaatgaaatcataaatctaagcctcattgacaaagactatgaaagcgaagaagaggactccttgaagcaaaattggtacattgatagtggttgctccaaacacatgatgggagatgcatcaaagtttactcatatttctcccaagaatagtggacatgtgacctacggaaacaaaaaaaaaaagataaaaccccaaatcatgctcaatgctttctaa

SEQ ID NO: 25905 - DNA, 517 bp, Glycine max
  Peptide Sequence Number=SeqID_117590
atggcatccttcagccacatgcagccccagcttcagtcgcagatgcaatctcagggacttgcagtgtctcctgagcctctagttggtccctccggtcctcgagtgagcacaaaggggagttgtgttgatccctcaggaaacgatcctgagacgggtgactctgacaagtgcggcttgtacatagaagcagatcctgcccgcctggatgtgcgcatcaaggcacatgccatccaaaagcagaatactgccccccacgttttgtctcgtgggggttatgattatttggagcagaagctcctggctgagaagaccaagaagaagatgcaggaagttgcacagtcaggaagcgttgatggcgtcatcgaccctccatccccggtcagacgccacgtgaagtggaagatggcccacacgaagaagacaggggagatgacgactgaggccgcaaaggaaatcgctgagaagattgattcgtttgagagcaggtcacacagggatcgttcgtccccccatggac

SEQ ID NO: 25906 - DNA, 882 bp, Glycine max
  Peptide Sequence Number=SeqID_117591
atgctgaaatcggaaaaactggatcaggaactcaccatgctgaaagcccagatcaatccgcattttctgttcaatacgcttaataacatctacggaatggcactgaaaaaggccgatgagaccccagacgtcattctccagctttccaaaatcatgcgttataatatctatgaagcagctgaacgacacatttccattgcaaaagatattgagaacattaaagattttattgaaattcagaaaattcgtcaccgtcggctttttgttaattttaaagaagacatcgataatccgtcgcaggaaatttcaccgttgatactgattcagtttattgaaaatgcatttaaacatggcgtatccgaaagtctgggcaattcatttatacatatagatattcgcctgaaaaacggcatcctccattattctgtagaaaactccaaagaacagatagccgcatctaaaaaatacaactgcattatcgtggaagatgagcctattgcagctgaaattctggaaaattttgtaatccggaacgaagaactcaaccttgttggaaaatgtgccgatgctgtacacgcaagcagccttttaaacattcatgatgtagatctcatgtttctggatctcaaccttcccgttataaaaggatttgattttctgaaaaaattaaagaatcctccctttgtcattgtaaccacagcttatcatcaatatgcagtagaagggtatgaactcgatgtcgtggattacctgatgaaacccattccttatgataggtttcttactgccatcagtaaattcagacacattatggaatccgaagaagctttactggaaattgccgaccgtgattacattttcattaacagcggaaaaaaacag

SEQ ID NO: 25907 - DNA, 144 bp, Glycine max
  Peptide Sequence Number=SeqID_117592
atggacagctcatccttcttccagattcttcctcgcgctcaaccaaggagggttgcgcttagcagatggctagctaagccaacagattggcttagcgagaaggtgtatgcaacaaaagttactgattgcatgagaagagaatga

SEQ ID NO: 25908 - DNA, 214 bp, Glycine max
  Peptide Sequence Number=SeqID_117593
cagtaacgagctcaagattagaagggccgacagggatgaatcaaggatggaaagcatggcgttagaggataagttaaaagcttgtcagaggttgaagagaagtttggtagaacaattgagcaaaatagaagagaatatgttgataatcattgatcaatataaggagaaggtgaacctggctgctagtcatgggcagatgttggaagatgaatag

SEQ ID NO: 25909 - DNA, 171 bp, Glycine max
  Peptide Sequence Number=SeqID_117594
atgggacaccttagtgatcaaggggttcccgcggaccctaagagaataaaggtcattccaaagtggcccactccaccaagtataagggaaatttggggcttccatgacacaaacttttacaaaagggtattgagggaagaagccctgagtttcaagaacctttggatttga

SEQ ID NO: 25910 - DNA, 429 bp, Glycine max
  Peptide Sequence Number=SeqID_117595
atggcggcgcagctaatccctgatcgagtggagatggagttcctagagggagcttgggagaccctcgaaggcaacacgaggtgccgatttcggggcactattcgattcacggctacttctttggtgcatccagatgagcctgcacggacgcttcagcgcacggtggagtggatactacccacgcctacaccatatcgtctagtggagcccgtccaagtgatcgaggtaacgtcatccgaggaagacccagaggaggatctcgaggagctacctcctgagcctactgtggatgcgcttgactttctagagggtgatgaggacccacttcctgaggtggatctcccgaggaagtcatgtcggcatctgaaagactctacggaggatagtggccctagagagatggcgaccagtggaggctcttcatcatag

SEQ ID NO: 25911 - DNA, 243 bp, Glycine max
  Peptide Sequence Number=SeqID_117596
atgccaagtatcccaaagcggtcgatcaaaggttgcatatcatcaagtaataatcctcggacgaaattagggtatgacaacgtcttttccggttttccgacgtttcctcaaataaacgttggtggcgactccgcgcgtatcctttcatggaacacgcatcccgcgagtctcgcgtcgccctcccgccgaagggtaggttgcgacagttggcgactccgctggggactgtttttagagagttag

SEQ ID NO: 25912 - DNA, 144 bp, Glycine max
  Peptide Sequence Number=SeqID_117597
atgtgtaatagtaaatcacttactgctcccttctggttagtcaggcttcatgatgatggaggtcgggcaactgaggaagcagtagcagctgcagcaacacgagcgtttttagccattgttgatcctgtggtcattgctatttga

SEQ ID NO: 25913 - DNA, 330 bp, Glycine max
  Peptide Sequence Number=SeqID_117598
atgggtaggccatggtgcccaggcttcctatgcggaggtgacatcggctacataattagcatcaatctcggcatcagcagcaccaacattagcttcattagcctctgcatctggtccggagcatcaggagcctcaccctcccctccaacaagggaagtttggactccgggtcaggccacccgctccaagaaagccttaagggtcatgaccggctactattgggatagagtggaggagaaagaaaatgatgatggcctagtaggtgggggagcaattgggggtgcctctgttggagccctagctctagccttgcgggtccctgaaaagtga

SEQ ID NO: 25914 - DNA, 108 bp, Glycine max
  Peptide Sequence Number=SeqID_117599
atggaaggttcaagctatttgagagtgaatgacaatgagaaaaatctcatagaaatggtggtaattagaggcaatggtgtggttactgttgaggtgcttcaaattcaa

SEQ ID NO: 25915 - DNA, 717 bp, Glycine max
  Peptide Sequence Number=SeqID_117600
caaggggtaaaataaagttgaagacccctgaagaggcaactgagctaattaagaatatgtcagccaatgatcatgccattctacgcgacagagttgatcaatccataaagaaaagcttgttagaactatcatcacatgacgctttattggcacagaataatttgctttctaagcaacttgagatcttaacagaaacacttggttgcaggttgcaagttgtaccatctatggtgaggctcatgaaacaggccaatgtattcccagtgaagaacacactcaagaagttcactatatgggaaatcaacagagacaaggatatactcaaggaggattttcaggcttccagcagggtccttataaccaacaaggacagtggagatcacaccctggcaatcaattcaacaaagaccaggaggactactaagttggaagagactttgactcagtttatggaggtaacaatgtcaaatcataaaagcacccagtcagcactgaaaaaccttgaggtccaggtgggacaactggccaagcagatagctgacaagtcatccaacagttttgtggtgaatacagaaaaggatcccaaggaggaatgcaaagttgtgatgagaaggagtaataagtttgtggaggtggaggataaggatagtgttgtcgtgcccaagaagaaagctgttgaaaagaaaggtactgatgataagaaagatgatgtgagag

SEQ ID NO: 25916 - DNA, 399 bp, Glycine max
  Peptide Sequence Number=SeqID_117601
atggagtacccagagggtgtttgggagaccctcgaaggcaatgagaggtgccgattctgtggcacaattcgactcactgctacttcattagtacatccgaaggaacccgcacgcatacttcagcagcctgtggagtggatactacctacacctactccatatcgactagtggagccagttcaagtgatagaggtgtcatcctctgaagaggatcttgaagaggacctagaggagttgcctcctgaacctgttgtggattctcttgacttcctagaggatgatgaggacccactctttgatgttgattctccaaaggatgttgtgccagcatctgaggcagactctacagaggagagcggccctggagggacagcgaatagtgatgactcttcatcgtag

SEQ ID NO: 25917 - DNA, 454 bp, Glycine max
  Peptide Sequence Number=SeqID_117602
atggaaaatcaggatatcaacgaagaaaacatcaataagcaacaagaagacaacattcagaacgaaaatgcttctgaacaaaatgtgacaaatactccgactgcggaagaacttttggcagaagagaaagaccgttatattcgcctttatgctgagttcgaaaattataaaaagagaacttccaaagaaaagatggagttcttccaatatgctaatcaggacatgatggtttctatgcttggagtactggatgattttgaaagagcattaaaagaaatcgctaaaaacggaaatccggcggatctgcagggtgtagaacttatctaccagaaattcaaaaataaacttacagagaaggggttgaaatcaatggaagtaaaagccggagattcttttaatgtggaccttcacgaggcaattactcagattcctgctccatctgatgatttaaaag

SEQ ID NO: 25918 - DNA, 195 bp, Glycine max
  Peptide Sequence Number=SeqID_117603
atgatactcaaatttcacgacgatccaacggtgaacgggttcgaaatcgtcatttttatgagactgctccaaccatatgggatcaacataggcttaaaggagcattcaaactgggtgacccccaaggcctacactacgaaaagtccgtcagggcctctccctcctgattcaggtccaacccagaaaacattttag

SEQ ID NO: 25919 - DNA, 2237 bp, Glycine max
  Peptide Sequence Number=SeqID_117604
atgaacatcgatctgagccagatgatcaccgagggccgcaacccggcgagccagaacattgacgagctgaacacggaagcgatgctgcgcgtcattaacgatgaagataaaaaggtggcgctgacggtggaagctatcgtgccgcagattgctgaggtggtggatgccatcacggcggcgttcagccagggcggacgtctgatttattgcggtgccgggacctctggccggctcggtattctcgatgccagcgaatgcccgcccacgttcggcacgccgcgcagtcaggtggtcgggctgatcgccggcggccataccgccattttacaggcggtggaaaacgccgaggacaaccgcgaacagggcgcgcaggatttaaaagatatcgacttttcggcgcgcgatgtgctggtcggcattgctgccagcggccgcacgccttatgtgctcggcgcgctggcctgggcgaagcagcagggcgccttcaccgccgcgctgacctgtaatcccaacagcgccatgtcgcaggcggcggacgtcgccctgacgccggtggtaggcccggaagtggtcaccggctcgtcacgcatgaaagccggcaccgcgcagaagctggtgctcaatatgctgaccaccggcgccatgatccgcagcggcaaagtgtacggcaacctgatggtcgacgtagaagccaccaatcagaagctggtgcagcggcaaatcaacatcgttaagcaggccaccgaatgtgacgatgcccgcgcgcagcaggcgctggcagcgtgcggcggccactgtaaaaccgccattgcggtcggcggcgcaggcaatgtcgtgcactgcggtaactgcatgacgcgtctgcgtctgacgctggccgatgccgcgcgggtcgacagcgcccggctgaaaacgctgcccggcgtgctgggcgtgattgacagcgatgcccagctgcagattgtgctcggccctggcaaagcgcaaaccgcagcggaaaaaatgcaggcgatgctgaacagcgccacgccagaggcgccgggcgatctgcacagcattgccagcgcgcagaagcagcagatgaaagcgaagcaaaccagcgcgctgcaccgttttctctcctgctttgccaccatttttaccccgctgatcccgggctttatcggtgccggattgctgctggggtttgccacgctgattgagcaggtgtgccatctcaatcagcccggggaacacgcccgctggctgctggataccgtggcttatatgaaggtgttcggtaaagggttgttcaccttcctcagtatcttaatcggctataacgcgcagaaagcgtttggcggcaccggcgtgaacggcgcgatcatcgcctcgctgtttgtgctggggtatgtgccgaacgcgaccgtcggctattacagcggcatgcaggatttctttggcctgactatcgatccgcgcggcaatattattggcgtgctgctggcagcgatatttggtgcctggctggagaaacagctgcgcaaaattatcccggataatctcgatatgatcctcacctcgctgctgacgctagtaattaccggcgcggtgacgtttctggtgatcatgccgattggcggcgagctgtttaaaggcatgtcgtggctgtttatccacctgaacaataacccgttcggctgtgccattctggccggcttattcctgattgcggtgatgttcggcattcatcagggctttattccggtctattttgcgctgatggaaacccagggtttcaattcactgttcccgatactcgccatggccggagccggtcaggtcggcgcttcgctggcgctgtggttcaaagccgataagcactcgctgctgcgcagccagattaaaggcgccatcgtgccaggcctgctgggcgtcggtgagccgcttatctatggcgtgacgctgccgcgtcttaaaccgtttatcaccgcctgcttcggcggtgcgctgggcggcttctttatcgggctggtggcgtggctcggtctgccggtgggcatgaacacggtgtttggcccgtcaggactggtgacgctgccgctgatgacctcttcgcagggcatctttgccggtatggcggtctatctggtggggctgattgtggcgtggatcggcggcttcgtctttacctggtggggtggcaccgaaaacgtcgatttaagttcgaaaagcctgcgccagcagaccgtcaagag

SEQ ID NO: 25920 - DNA, 456 bp, Glycine max
  Peptide Sequence Number=SeqID_117605
atgtataatactacgatgacctatattagtctccacggcaatgcacactggcaaatggtggtcattttgcttaaggaaaatcttgttgtatggttttgttccttgcataataggctagacaattacctaaaaggaatcattaacatgccagtgttgttttccaatacatttgcattaacattagtcagcaacatcaatattttaatgttccttgtattcaacagtgctttgaaaggattggacgatacttcacaacctaaattcaaggctggtgctaggtggattgttgttaaatgtaatagacaaaaaggaagcacaaagtgtggctattacgtgatacactggatgtccactataatcttgggaagtttcaggaataattgggaaacggccattggaagcagagagattgaaggcgcttcgcatccagtggacacagtattatctcaaagttag

SEQ ID NO: 25921 - DNA, 641 bp, Glycine max
  Peptide Sequence Number=SeqID_117606
atgccgctgcacctggtgcaggagtacggcagctggaccaaccgtaaagtggtcgatttctttgtgcgtttcgcggaagtggtttttgagcgctacaaaaacaaggtcaaatactggatgaccttcaacgaaatcaacaaccagcgtaactggcgtgcaccgctgttcggctattgctgctccggtgtggtttataccgatcacgacaacccggaagagaccatgtaccaggtgctgcatcaccagtttgtggccagcgccctggcggtaaaagccgcgcgccgtatcaacccggagatgaaagtcggctgcatgctggccatggtggcgctctatcccttctcctgcaaaccggaagacgtaatgttcgcccaggaatcgatgcgcgagcgctatgtctttaccgacgtccagcttcgcggttactacccgtcttacgtgctgaatgagtgggagcgtcgtggcttctccatcaggatggagccaggtgacgagcagatcctgcgtgaaggtacctgcgactacttaggcttcagctactacatgaccaacgcggtcaaagcggaaggcggcaccggagatgcgatttcgggctttgaaggcagcgtgccaaacccgcacgtcaaggcctccgactgggg

SEQ ID NO: 25922 - DNA, 174 bp, Glycine max
  Peptide Sequence Number=SeqID_117607
atggcctggagattggctgaggcccgggcaggagaggcaccaacagaggctcccgacgaggcagatgaggcccacgaggacaaggagatgaccgatttacttgatttcttaggaggaatgtttgttgaaattcctggaccgtgtagagtttttcatttaggaacgtcgttctaa

SEQ ID NO: 25923 - DNA, 222 bp, Glycine max
  Peptide Sequence Number=SeqID_117608
atgaaaaatgaaagaatgatatgtccatcacgatgccatgaagagatgcacaatgtgatcaaggaacaagccaagatgaggcttcactgtcatcaagcgagtcggagacccagcatgaccacagatcgacctccactccttatggctcacatagtcccgggtatagggcctaatatctcaacgtgtgtgcgaggtgtaggtgcctatgtgtgcatagaaaaa

SEQ ID NO: 25924 - DNA, 564 bp, Glycine max
  Peptide Sequence Number=SeqID_117609
ggtggacccttgggtactagtaccctcaccttcggaggactacacgtcctcaccttcagaggactacacgtccttatcttcagaggactacacgtcctcggcgccagaggactatatgtcctcactttcagaggactacgcatcctcaccttcagaggactacacgtcctcaccttcagaggactacacgtcctcaccttcagaggactacacatccttgccgttagaggactacacgtcctcacctttagaggactagatgtcctcgccgtcagaggactaggcgtcctcgccgtcagaggactacacgtcctcgccttcagaggacttcacgccctcgtcttcagaggactacacgtcctcaccttcaagacgacgattggtacctcaaagccttcatggggcaatacaggggccctgcatgaaccttcaagcgaacctacatgcctcgcctttagagagctgattctcaccttcaataggttgcatcctgctactttaagggtcatgacgatagacaatgattggtacctcacttcagaggccctacatctgtgggcctaa

SEQ ID NO: 25925 - DNA, 255 bp, Glycine max
  Peptide Sequence Number=SeqID_117610
atggtcattctgcaccctttgtcgttcaggagcagtgagtcgagtggtgggtggagacaaattatggtcattccgcacaccttttcgccatccagaggcgatcgtgtccgatggcacgcagagacaaattatggtcattctgcaccttgtcatccaggctcgatcgtgtttgatggcacgcagagacaaattatggtcattctgcgccttgtgtcaaccaagaggaacgaactcggcagtatcaggatgatgttg

SEQ ID NO: 25926 - DNA, 142 bp, Glycine max
  Peptide Sequence Number=SeqID_117611
atggctgatgagcaacctagacgagtaacccttgaagactactcaatcagaattgctggagtgccagaagatgtagttaggatcaacttattttcattttcactatctggagaagccaagaggtggctacattcattcaaag

SEQ ID NO: 25927 - DNA, 243 bp, Glycine max
  Peptide Sequence Number=SeqID_117612
atgggagcatatcagagttcagattttgtggatctatggaagctcaaaatccctgccaaatcactggtgtttgcatggagactaattagggatagactcccgacaaagatgaatcttagcaggcgccaagtgatggtcaacgatctgatgtgtccattctgtggaggtgtcatggaggaggctgcccatttactcttcagctgtagcaaaatcctgcctctattgtgggagtctctatcttag

SEQ ID NO: 25928 - DNA, 780 bp, Glycine max
  Peptide Sequence Number=SeqID_117613
atggaagaaagggccaacaagggggaaggcgggccccagaacgcctcctgcgagtaccgaggtgttcgacagcgaacttggggcaaatgggttgctgagataagagagccaaagaagagaaccaggctctgccttggttcttttgccacagctgaagaagctgccatggcttatgatgaggctgcaaggagactctatggtccagatgcataccttaatctcccccacctgcaacccatgtccacttcaactatcatgtcaggaaagttcaaatggttcccttccaagaacttcatttcaatgtttccttcctgtggattactcaataggctacaagagcttaagcgaaattcagttatgagtcaatcctcatctagttcatccaatgatccaaaggcagaaattcagaatgtagacagcaaaaatcacggagaagatgaaaatcctccaaaagatgttcaaacatcattagaggaggtgcttggagatcttcaggagaaaccccagatagacctccatgagtttcttcaacagatgggaatacttaaagaagaaagacagtcaaaaagaactgatagctcaggaagttcaacagtgtgtgaagctgtgttgacagatgattgtgataatttgggagtgttttctgacaagagtgtaaactgggaggcattgattgagatggatggacttgcaggtattcaggaatcagaagtcactcagcttgaagcatatgagccaaatgatgatctaactttctcaacttccatttggaacttttaa

SEQ ID NO: 25929 - DNA, 390 bp, Glycine max
  Peptide Sequence Number=SeqID_117614
atgatacatgatgacaacaaagatgatgacaaggtgatgacaaaagctcaaaagatcaaagaacactcaagtgaatcaaagaacatctcaagtgaatcaagaacaggtcaagagttcaagaatcaaggagaattcaagactcaagaagaaagcctagaatcaagaatcaagaatcaagaatcaagactcaagatctcaagaatcaagatcaagattcaagactcaagatgtgaagaaggaatgaacgagaagactcaatcttttctttcaagaatatgtacagtggatatgcacttcaatgaaatggagtcaagaatcacaaaggtgaagaagatgttttacattcgttcaagctttgatcttccaccactgccgccaccatcatcttag

SEQ ID NO: 25930 - DNA, 58 bp, Glycine max
  Peptide Sequence Number=SeqID_117615
agcttcagttttcaatttcgagcgtctcgatattcttcgggacacaatcggacatcct

SEQ ID NO: 25931 - DNA, 312 bp, Glycine max
  Peptide Sequence Number=SeqID_117616
atggcttccatgatggaggccatgttaggaatgaggcaactcatggagaaaaatgtggccaccgctgccgctgttagttcggctgccgaagcagacccaactctcctagctaccgcgcaccatcctcccccaaacgcggtaggacgagaaaggaacacactggggcacaacaacaacccccatttgggattcaaccaggtggcttacccttatggattaccgcctaattacacgccgccagtcatccatgatgacgcgggtcacgtcccttcccccatccttgaaggggagcctcctcgactgcccgacgag

SEQ ID NO: 25932 - DNA, 802 bp, Glycine max
  Peptide Sequence Number=SeqID_117617
gctgcccacagattacagagagattgaggctgccttatgcataccaggccgagggttcatcttgaacgctgagggccatcctaggaagattcttaggaaggatttgactactctagctcaggtgtggagtattctctcatactccaacctggcctccacatcacatacctctgatatgatagtggacagagctaggctgatctttgacctagtctctcacatggacatgaacgtggtagctcttatttctagccagatcacctctatagcccagtctaactcttctagacttgggtttcctgctctgatcaccgccctttgtagggcaagaggggttgtttctgacagcctagtttttgagcgcctgagctcgatcattaacttggcctacatcaggaagaactgttggaatcctgatgatctgacagttactatccgaggggctaggagggcgaggccagctgagcttccttccacatatgtagttcctactccagcatccagttcagcagctacttctgtcccagctcatacagattctcagcgctttgaagccatgcttcagagcattcatcagggacaaatcattttattgcagagtttacaggtggtggcacctccaggatccattccttcagttgagcagtttcgggagatggtagcctggcctgggactcagccttctcttcacagggaagatgaaggtcccacagcccaggtaccacagcatgtggaggatgagtcatctgaggccaccattccagagccattcattataggggaggaggcaggtgagacatag

SEQ ID NO: 25933 - DNA, 327 bp, Glycine max
  Peptide Sequence Number=SeqID_117618
atggggagcaccacggttaaagaccgaagaaaacgaagaacgaacgatgaatgtcgaagaatggttgaaaatcttcgcataattacccacggaaacgttacggaatcgcctcaacttggattttcttcacggaaacaattttcctcagcaaatttaagagaatacgaagtgccaagaaggctgaaccctttcctgttcactcctccccctatttatagcaaaataggggaggagcttgccacccagctcgcccaggcgagcaaggttgcttcctccagaagcaatcgccttctggaggaagaatctggaaggcccaagtgggcctga

SEQ ID NO: 25934 - DNA, 192 bp, Glycine max
  Peptide Sequence Number=SeqID_117619
atgggtgaatacaaccaactatcattaagaatctcatccttagaccaaaaacaggcaaaaggtggaataccgcaaagagaaagcgtacccactaaaaaagaagtttttgtaattgctggagaatatccgacagagcttccattgatgatatggatccagatcctaaaaacaacaatgcttttgatagcatga

SEQ ID NO: 25935 - DNA, 291 bp, Glycine max
  Peptide Sequence Number=SeqID_117620
atgcagctcccggagaccggtcaccagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggatcccccatcaaaagaaagggaagaagcaatggagaagaacatcgtgctgaagcttgaa

SEQ ID NO: 25936 - DNA, 213 bp, Glycine max
  Peptide Sequence Number=SeqID_117621
atgggtattttaagaaatcaagatgcaaattcaaaaacaaagggggagaatatgcagaatttagttgcaatcataaaaaaaggggagattatggaagcaatgccttccaaggttattttgatgatgccaaagaatcaagagtcaagcaaattccaaagattcaagaatcaagttttcaagaatcaagtttcaataatcaagattcaagaataa

SEQ ID NO: 25937 - DNA, 99 bp, Glycine max
  Peptide Sequence Number=SeqID_117622
atgtcatcagttagagctgatccatctggacaaaatttattcatggtggttgttcgatttttggagacttttgtagggtcaatgtctgcagggggatga

SEQ ID NO: 25938 - DNA, 480 bp, Glycine max
  Peptide Sequence Number=SeqID_117623
atgaaaacgtttcagtttgctcatggaaaacggtgtaacaagggtgaacactatcccatatcaccagctcaccgtctttcattgccatacgaaattccggatgagcattcatcaggcgggcaagaatctgaacggtctggttataggtacattgagcaactgactgaaatgcctcaaaatgttctttacgatgccattgggatatatcaacggtgttggaacctcttacgtgccgatcaacgtctcattttcgccaaaagttggcccagggcttcccggtatcaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 25939 - DNA, 552 bp, Glycine max
  Peptide Sequence Number=SeqID_117624
atgggtgatcaagaggagacgcaggaacagatgaaagccgacatgtcggctctgaaagaacaaatggcctccatgatggaggccatgttaagtatgaagcagctcatagagaagaacgcggccaccgccgccgctgccagttcggctggcgaagcatacccgactctcttggcaacgacgcaccatcctccctcaaacatagtaggacggggaagggacacactggggcacgatggcagccctcacctgggatacaaccgagcggcttacccttatggattgccgcccaactattcaccacccgtcttgcaagaagatgcgggccacattgcttctcccgtccatgaaagagagcctcctcagcagcccgacgaagtccacaaagaccctcaagattatgctcggagggatgtcgagttctatcccccgatccccgaagggccggcaccaggcacgttgcctcaacccaacatcgcagtaccaccaatagttctgtccacggaagggccgcccccagcaactgaagaatggaaggaagctcgatctccttga

SEQ ID NO: 25940 - DNA, 507 bp, Glycine max
  Peptide Sequence Number=SeqID_117625
atggtggcccgggtgatgttggggaatggttatgagcccgaaatgggtttaggcaagaacaacggcggcagaaccagcctgataagcaccagaggaaatcgtgggaagtttgggaagagcagaagccaaggctcgcaactgggacgaaaagtcgaagggggcccgccctgccacatcagtaggagctttataagcgcgggtctaggacacgaaggccaagtcgttgtgatatgcgaagatgattctccaagtgggtcggattttgtacgaccatgccctcctggtttccgactaggaaatcagcgagtggaggagcgcccggacatttacgcgacaagcataatatccaaccacgagtccctccaaggtactaatacctgggacccgaccatcgatttcaaggaagaaatggatcagacagagagtgaagaggacgaagatgtgggacttcccccagagttggagaagatagtcgcccatgaggaccaagagatggggcctcattaa

SEQ ID NO: 25941 - DNA, 165 bp, Glycine max
  Peptide Sequence Number=SeqID_117626
atgaaggttgaacaactctttgcttgccatcatattagtgaagagagaaaagttccattggctacccttagctttcaaggagtgctcttgggaagaggcacattccctcctactatgaaagggagcttatggacaagctatagaggcttagacaaaggagtatga

SEQ ID NO: 25942 - DNA, 372 bp, Glycine max
  Peptide Sequence Number=SeqID_117627
atggcatcatcaaacatcaaagccaaagtctttgcttctacaaggtcaagtagagggtacatctacttgggtgttcaaagagaacaagggagggtacatcccttgtggatctttgcttgtaaaggtttttacaaggttgaaaagaaatctcaaggaccgtggactgatgctactaaggacgttctctacctaacaatgttcttgtgttctatgttgtctcctggactactaaaccccgatgtctcgcacatgtttagcctaatcctaatcaagcgtcgtcctcagatgtctcttgttggactaaacttaaccagaaccgcagtaagacataacataccaaaaactaagttatcataccccgatgtctcgtga

SEQ ID NO: 25943 - DNA, 759 bp, Glycine max
  Peptide Sequence Number=SeqID_117628
atggtcattgaccaatccgttttccattacttaacccaattgtccagtgacggtgtaccatttgaaggtacactgaatgacgatgggaaatttgatttctctgcatatgatgcccgccagttggtttgcaccaaccatgcggatatgactggacgccttcttgccggttcattggcttttgaaagccgcatccttcattatctcattgtgcgtattttgcttccacgatcttccaaccttgcccaggtttctgaggaagatcttgttatcatgtgggcctttcataccgggcgtcaacttgactgggcacacttagtcaaatatcgcatgcataaggcattgcgattaaatgctccattgccatatccacaccttgtcactctctttcttcgccattttcaaattcctcttcattctgaaccttatgttccaatcaagagatcctttttaattggtgctgctgtgattgcctcctttggttaccgcaaagagcatgatggctcttgggtcaaaaagggtgctcaacccgctgatgatgaaggcaacctaccagttgaagataattcctctcttcttcgaaggcttttggacaagttcgatggtcttcagacttttgttggtgacaagtttgatgccatggaattgcaagtcgacatgcggttcgatgccatggattcaaggatcaccaaggttgaagaagatgtctccttcatccgtacttgctttgatccaccaccaccgcctccatcatcatcttag

SEQ ID NO: 25944 - DNA, 204 bp, Glycine max
  Peptide Sequence Number=SeqID_117629
atgcttccttttgatttccgcacctcacaaggaccaaagaatggtcgcatgtcatcgagcaaaggttcccggacgaaattagggtatgacaatggggctccgaaaaaaagtggagaatggagaattggcgaacagcgctacgcaataacttcgcggggttccagactcgttggtggaggacgctccaacagcgctaggcaataa

SEQ ID NO: 25945 - DNA, 812 bp, Glycine max
  Peptide Sequence Number=SeqID_117630
atggataagtctgaggacgtggctactaatgagagggtcaatgttgaggcctcacacaatgataagttgaacctgttactcagaggaaacgactttagtctctttcacctccgttgttgtcgtaatgatgcctgcatgaaaccaaattgggttttcttagctaaggagaaaccccaaccgagtggagagaggccaagcactaggaatacatttgaggttgtcctaccgatggtggggtttattttgtactactttaggaatcggccgacgaacaaggcttggtcattatctttgattcaccaccaagagaggccattaattaggtcgttcaccacttcatacaagaatttcaaagtgggtttctccaaggtggagattattcccggtcttggtgacaacttttttatgactctttgggttagcatcacttctgctaacatcattgttgttacccctgatattcgtagtcctcctcctcatcctagccctcaagttgttgtgctgcctgggaacaagaacaagaagaaaaaggctaggcgagagttgttaggagaaaagtttttccactcttcttaccatccccaaagtttgatgtcaactagtgttgtgtctgactacaacaaagacattttgcagggtgctgatgcgacttcaaattgggccatgtacttagagctgcagtctaagtcaaccatcatcactaaacatatgatcttactcaactctttggtcgatcaagaagtattaaaattgaagaaggcccttgaggctatcgagaaggaaaaggatcatgccattgaggcaaatatcaa

SEQ ID NO: 25946 - DNA, 405 bp, Glycine max
  Peptide Sequence Number=SeqID_117631
atgtaccctctcttgttctctgttacaacgacccaagtagatgtaccctctacttgtaccataaaagatgtaccctccaatttgttaagacaaagttctcaggcggttactcctttgaaagtttgtgaaggggaaacaaaagatatctcaagcgggagacacaaaagaattcaggcggttagtcctttgttcttttggaaaagggacaagagagacacaaaaagaattcagacgattagtccttgtcgaattctttttggcaaaagggagaagagaatgaaaaagatgaatagcacacttttgttttctgtgaaagaacaaggtttggaaaccaaaaaacttagaaagcttttggcaaaagaagaagaagaagaagttcaagaagatgttcaaaaacttgtgtaa

SEQ ID NO: 25947 - DNA, 192 bp, Glycine max
  Peptide Sequence Number=SeqID_117632
atgtcaaatcacaaaagcactgagtcagcattgaagaaccttgagatccaagtgggccaactagacaaacaattagctgaaaagtcatccaatagcttcaaggcaaacacagaaaagaatctcaaagaggaatgtaatgctgtgatgacaagaaacaagaagcgtttggtagttgaggataaggatagggtg

SEQ ID NO: 25948 - DNA, 219 bp, Glycine max
  Peptide Sequence Number=SeqID_117633
atgaattgcattttcgttcaggtgtcctccgtcttcaccttcgagtttggagccatgcttagtgattgcttagtgcaattctccattctcaaccctttttcggagccccatgaattggttttcgttcatatttcctccaccttcgagtttggagccatgcgtagtgattgcttagtacaattcttcattctcaaccctttttcggagccccatgaatag

SEQ ID NO: 25949 - DNA, 278 bp, Glycine max
  Peptide Sequence Number=SeqID_117634
tcttcctgtggggaccgtcggccttcccggtagcaggatcaacatgcaccactggtctctcaacaccaggtggtctagtggacaacgatcgtagacgtgaggctttgcgtgtccgcttcacggcagacgtcgaagccgatgcgtccgaagtaggaggaggaggaggaggagaaggagaagaaggaggaggaggaggaggaggaggagaaggaggagtggaggcagaaaagaaagaggggaacgagcaacaatttgaaggttgtacattcaggaactaa

SEQ ID NO: 25950 - DNA, 236 bp, Glycine max
  Peptide Sequence Number=SeqID_117635
atggaggtatcattgaagggaatcatattcttcgtgaggcggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 25951 - DNA, 811 bp, Glycine max
  Peptide Sequence Number=SeqID_117636
atggctaaatttgacccggagatagtcatagaattttatgccaatgcctggcctactgaggagggggttcgggacatgcgctcacgggtgaggggtcactgggtcccctttgatgcagatgcagacgatttcgatgaggaagccatcgcccaactgctgtgcataccaggacaggatttcgcccggaccgctgcagggaggcaggtatggatcatgcgcaccaacatgactaccttgacccagatatggatgacactgctgcatagcaatgtcttgcctagcgaccacaactctgacctccctctgcctaagtgtcagttggtgcatgccatcctgacacagatgagcgttcacatggcccaagtgattgctgatgccatttatttgtttgctggaatggcgcctactaggcaccctctggacctagagaagtccaacagggccttggggttgccggctctgatcacgggcctctgccagtcctacggagttcctatcacccccagcaaggtaatccgaccactgatcacccgagccttcatcgagaagtactgcacgcctaggcaggcgcagggcaacgcacatcaggacgcgggcgcaccgcccccacctcggcaggccgattcggttgggccactgcacgtggagcggtatatatatcatttggttcaccagcaggcggccaaacaccatggacaggtgcagatacatgagtgtctctaccggttcagcctcagtcagcagggccaggtttccaccccttttgtatgccgtaccccagagcagtttggggctgaggtcgcatggcctg

SEQ ID NO: 25952 - DNA, 305 bp, Glycine max
  Peptide Sequence Number=SeqID_117637
ggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgcttgtggaacttagaccattggctatgctcgtcgtggggatcctctag

SEQ ID NO: 25953 - DNA, 565 bp, Glycine max
  Peptide Sequence Number=SeqID_117638
atggtcaaaagaaaagtgattcacacaaggagacctaatcaattagcattgttatgcttacttggcagtttctattacctaaccaatacagaacatgcctacactaatccgttaaagaatttgagaatagctagacatgggaaatttggagaaaattctgctaggtcatcagtacttgcatgggtatacagaccaactaaaccaaggccaaatgattttggtaggaaacccatagaattggtacaacctagccggccaaattcaattcaggcaagattgattccactagtgcagccgaattcagtcaattcaaccgaattcgggtcagttatttcagctgaaggcagttcagctaatacagccgaattcagtgcaagcaggaccttcttggatggttcagccaatatgattcaagcaagtgaggctttgcaagtccaaccaaatttcactcaacatgtaccgtatagccattcttggcccaatcaggttcatccgccactaccaatcaattgcttgcttgaatcgctgtttgggaggtttgggagagcgagaacacctgttcacg

SEQ ID NO: 25954 - DNA, 454 bp, Glycine max
  Peptide Sequence Number=SeqID_117639
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctgaacttattatcatttgttgtggatcttccagatggaagtggtgaacctgccagcaagagattggggatcctctag

SEQ ID NO: 25955 - DNA, 213 bp, Glycine max
  Peptide Sequence Number=SeqID_117640
atgacaaaatctcatgagaacaacgaggaagaatctgtaaggaagaagtggtacatcaacagtggatgttccaagcatatgacaggagatgtatccaagtttacaaccatttctcccaagaaaagtggtcatgttacatacagtgacaacaacaaaggaaaaatcattggagtcggcaaaataggtgcaggggtgctcgcccaggcgagctaa

SEQ ID NO: 25956 - DNA, 114 bp, Glycine max
  Peptide Sequence Number=SeqID_117641
atggtgcaatcctaccccctaaggacattggatagaagactccaagaagattgggccagagatgcaagagaaggccctaggattctcatgaaccttaggggctccataatgtag

SEQ ID NO: 25957 - DNA, 303 bp, Glycine max
  Peptide Sequence Number=SeqID_117642
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtgtaaacgacgccagtgccagctgcatgctgca

SEQ ID NO: 25958 - DNA, 88 bp, Glycine max
  Peptide Sequence Number=SeqID_117643
ggcggttgatggaacctctctgtcataccctaatttcgtccggggacctttgcttgatgacatgcgacctttctttggtccttgtgag

SEQ ID NO: 25959 - DNA, 676 bp, Glycine max
  Peptide Sequence Number=SeqID_117644
gaactccgttgccaatcatactaccggccctgatcggcgctgttgttggcgctggaataacgttattcttcaatctttggaaattccatcgtgacgagagagccgcgaggtgcgatgaactatgcaaggcaattcaggaggccgccacactagcgctcggttattggacaaccgctttttctgaacctgaagagcagattgtcgcggagacgaaattgcgagcagcacaagatttcgtggaactgcttttcgaagactttataatcttcatcagcgtttcaaacgaagaggcgcttgctgagatgttgtccgattttacaagtaagataaccggcgggcaatatacggaactcggccgcccaactgatctcgagcgagccaaaatgacgggacctcttgcaaatcgtctatctgccatccgcgaaggagactttaagcgccttgccacctatcccgatcacagacaggctgcctatcccgataagcccctccgcttcacatcgcgcaagtcttcgataagccgatgcaacaaggcccggctttgggtcaccttatcttcggagcgccgcgctcctttttcgatgcgctggatggatgtatttacggctttcacaagactgccaaaggtctacggattagagatcgcaacgaaaagcgttgagtcgatatctgcaat

SEQ ID NO: 25960 - DNA, 935 bp, Glycine max
  Peptide Sequence Number=SeqID_117645
ggagtggcaaaggactggctgtattaccttgctccaaggtccatcacgagctgggatgaccttaagagagtattcttagaaaaagttttccctgcttccaggaccacaaccatcaggaaggatatctcaggactcagtaatatggagagaagtatgaaagatgctgccagtggtggagcccttggagacatgactcctgctgaagccagaaatttaattgagaagatggcctccaaatcccagcagtttagcgccagaaatgatgccatagtcattagaggagtgcatgaggtagctacaaacccatctgcatcatctgaaactaagaagcttgaaggaaaactggatgcgttggtcaacttggttacccagctggccttgaatcagaaatctgtacctgtcgcaaggacctcctcaacctcagcagcaaatcaaccacagcagagcaattatgacctttccagcacagatacaccctggatggaggatcaccctaacctcagatggtccagccctcagcaacaacaacagcagcctgctccttccttccaaaatgctgctggcccaagcagaccatacattcctccaccaatccaacaacagcaacaaccccagaaacaaccaacagttgaggcccctccacaaccttccctcgaagaacttgtgaggcaaatgactatgcagaacatgcagtttcagcaagagaccagagcctccattcagagcttaaccaatcagatgggacaattagctacccaattgaatcaacaacagtcccagaattctgacaagctgccttctcaagctgtccaaaatcccaaaaatgtcagtgccattttattgaggtcgggaaagcagtgtcaaggacctcaacccgtagcaccttcctcatctgcaaatgaacctgccaaacttcactctattccagaaaaaag

SEQ ID NO: 25961 - DNA, 369 bp, Glycine max
  Peptide Sequence Number=SeqID_117646
atgtctgggttatctcaggggtttgctatcagtggagccgattcccggacagcggttaatgattcagtgggtgggaaaagccagctggtttccatcgtcgcagccttactcatcggtatcgtggtggtgtttttcactcagccattacaatttattccggggatcggccttgcggtgttgcttggcctgttacagttcctgcgtacggtgtttcgtccctctgagcacttactgggaaccgacgaagatggaatgattcactcgttagggaatacaaccgatattaaaatgcagtacagcctaaatgggtggtcattgatgccgttgcatgcttcacctattcagatatcagcgttctggcaaccataa

SEQ ID NO: 25962 - DNA, 305 bp, Glycine max
  Peptide Sequence Number=SeqID_117647
ctttattcgaggttgcactagcacgatcaccaccaatctgtgcttcttcctcgtctatcagtgtagttttcaaaagcaaaggtgaaaggaaagatattgagctggtagaggaggaacaggcacggattggtgctgatccttctagtggggcctccaataaatctgagatttataaggaggaagcatggaagaaaacacagaagcataaaccaaagagggtggagagtggcaatgctgatgcggaagcctttggtgatgactcgaaaattctgattgctctatgcattgtgaagctgaagcagtag

SEQ ID NO: 25963 - DNA, 270 bp, Glycine max
  Peptide Sequence Number=SeqID_117648
atgtctcctaaagtagtcatgactcttgcaagagttgaagtgaagaacttagcgactattatagagggcgccatagttcacgtactaaacatcattcccaaagaagaaaaaaggatagaaggcctcaagaggttgaagaactctttgcttgccatcatattagcaaatagagaaaagttccattggctacccttagctttcaaggatatgccctctattggtggacttcccttgtttgggaatgaaggattcatagggatcctccagtag

SEQ ID NO: 25964 - DNA, 282 bp, Glycine max
  Peptide Sequence Number=SeqID_117649
atgactgcgccatcgacggatcctcctcgagatgcatatgcgacgcaaccctgtcatatccctcatgaggcagcaccagcatcgacacatgcggatcctgatgcggacgagtgcagacatgcagtggaggcttgccatgcgatcgcggaggcgttggagcagcatctaaatgcgtcaggcacatccacacatgaagaggtcatccaaaaatgcctcaggattgccaggggtgtcacagaagacgtgaggtctcgacataggcgccgcacggatcaacaatag

SEQ ID NO: 25965 - DNA, 75 bp, Glycine max
  Peptide Sequence Number=SeqID_117650
atgagggaaagtggcgttctggctatggtaggtgaagaagtaaatgctggagtaattgatgttttgatgaggtga

SEQ ID NO: 25966 - DNA, 192 bp, Glycine max
  Peptide Sequence Number=SeqID_117651
atggaagagattgaacccacttcagtgcacgacaacaacaacagacgaaaaagtattaaggctaaacctcctttatatgaaaatgttgactcaaatgtcaacaatttaattcaagaggatcatgcgcttctcaagtttaattcaagacaagaatccaagaaattcaagatatatgatcaagataatctctag

SEQ ID NO: 25967 - DNA, 228 bp, Glycine max
  Peptide Sequence Number=SeqID_117652
atgttccctcatggtgaagatgcccaggaaatgggtgttgaggaaagaaccccagagtttcaagaacctctagatttgaggtcaaatccttttcaagggggagagcatgatgcaatcctacccccaagggcattggatagaagagtccaagaagattgggccagagatgctaaagaaggccctaggattctcatgagccttagggtagattttaggtccatgggctaa

SEQ ID NO: 25968 - DNA, 477 bp, Glycine max
  Peptide Sequence Number=SeqID_117653
atggttaagactagaggattaggccgtgtgttacgtaaggttggtgccaaaggtttggggagaggaggggatggtgatgatactgacggtgctccccagcgccaaaggccgatcgcatcggcacgtaggcgacgggtaccagtcattcttgacgatgatgtgcctgtggtaacctgcggactcgcctgcgacatggttgctaggacaggattaagtcctttgatcgcgtgttcgatagacgccggcgatcggggacttatatcctcctttgtggataggtggcatcgggagatttctagtttccatcttcatgtggaggaggtgtcgatcacgctggacgacgtcatgtctcttctccatttgcctatcgttggcgcattcgatgacttccagcctctgcgcaccgacaaggcggtggtgctattggttgagttattgatggtctcagcagaggtggccatggccgagacaggctaa

SEQ ID NO: 25969 - DNA, 213 bp, Glycine max
  Peptide Sequence Number=SeqID_117654
atggtgaaagaaactacggatgcaagcatcaccatcaccatcaaaaacaatgcggaagggagaaggaagagagagaggagatgccacttcaaggagaagatgagtctaaaagaaactcaccaccataggaggccattgataagagcttggaggaagaaggagatgaatgaagggagaggaagagaagagcacgaaattttgtgctctaaatga

SEQ ID NO: 25970 - DNA, 233 bp, Glycine max
  Peptide Sequence Number=SeqID_117655
ggtacatcctttgtggtacaagtagagcgtacatctacttgggttgtaatactgagaacaagagatggtacatctcttgtggatcagttcaagtggagggtacatccacttggttgttcaaagagaacaagggagggtacatcccttgtggatctttgcttgtaaaggatttgacaaaatctcaagaaccggtggttgcttggggactggacgtaggcacgggttgtggctga

SEQ ID NO: 25971 - DNA, 1239 bp, Glycine max
  Peptide Sequence Number=SeqID_117656
atggagacatatggattgccttatgttcatatcatggctgcgttgatgcgtcttaacattgatgagttgcctagttgcttggtgttggagagatggactatagctgtgaaagaccgttttgttggcatgataatagatgatgctagtttttggaactctcatgtcattgctagatatgtatggatgctaaatgcatgcagggagttttgtactttggcctgtcaaagtgccaatgattttgtcgagggtagaaacaaaagtagaaaagaaatacaaaatttgaaatacaagaatggaatagaggttggcactggttgggtggaaagatgtgtaggtggtttgcaagatcctacatatgtaagaaccaaaggtagtggttgtaaaaaatcacgtgtttcaaagttgagaataaagaggatagtcaagtgcagtgcctgcaagctacctgggcacaataagttggcttgcacaacagtgaataagccagatgcaatagatgacaatgttttagcaagttgttcttttgatggagaggacaatgcttctccaatggcaggggatttcaatgttgatgttataggaagtccgacgacgagtctcaggaggacgaagagtaagaagaagacgacgacgaagaaaacgtgccctttccctccagcgctctcgttgtcaccgttgtcgtccccgattcctccatctccaacagcggcagcgacgctccaatttcaaagcccaccaccaccatcgtcctcaccgactcatccgatccgaagcggcgacgagatcgagctcttgcaagggttcctctactacacatcgcagcaaggatcatcgcaccacagcgacactgctttgttctacgaccaaatcaagtcgaagctccaactcgatttcaacaagaatcagctcgtggagaagatccgaaggctgaagaagaagtaccggaacgtccttaacaacattttctctggcaaggaattctccttcaagagcgctcacgatcaagccaccttcgaaatctcgcgcaagatctggagcaacgtgactccagtcggcgacaattcattggacgacgacgaaatcaaccctaatcgtagccccaaccctaaccttaattttagccctgtaattcttaagaatgaaatgattttcaggaattccacggagaagaaaacaccgaaacgctctcgacctcgatcggcaatgaaaatcgagccaaatgaattgagtgcaaaatga

SEQ ID NO: 25972 - DNA, 678 bp, Glycine max
  Peptide Sequence Number=SeqID_117657
atgaagggttacaaattacggtggtgcgacttttcaccgacgacgctcgttgtgcaagcagctaagtaccacgacgctcttgtgcgagcagcttctattcgctggacggatggtggttctacgattaaatatggtgctgcgaaagacattgctgacaataacttcgtaccttccaaaatccccaagggatgtgttccgatccatttgaatctcgtggcgaggcatggaactcgatctcctacaaagaaaaggataaaggagttagataatttgtcagagcgtctggaagttcttgtaagggatgcaaaagagagaaatttgcctttggagagagttccttcttggctaaatgaatggaaatctccctggcagggaaggcgtaagggcggcgaattagttatcaaaggagaggaagagttatatgatattggaatcaggattagggaaaggtttccaaatttgtttgatgaggaataccatccagacatatatcctattaaggcaactcaggttccccgggcatctgctagtgctgttgcatttggaatggggcttttcagtggcaatggaagtcttggacttgggcatcaccgagcctttgctgttactagtgaaagtcgtgctagcgacattgtgctgagatttcatgattgttgtcataattacaagctgttgtag

SEQ ID NO: 25973 - DNA, 219 bp, Glycine max
  Peptide Sequence Number=SeqID_117658
atggataagagcttgaaggtaggagaagatgagtggagggagaaggagaagatgagctataagcactttattattattattcttgatacaatcctcccaaggaggggacccatcaccagagccatggcaaggagactccaaggagattgggccagagatgcagcagaaggccctagggttctcatgagctttaggatagattttggacctatgagctaa

SEQ ID NO: 25974 - DNA, 556 bp, Glycine max
  Peptide Sequence Number=SeqID_117659
atggaggcaactccctttgacttcccccaagttctcttcaattactttgctactcaagtgatgaaggacaaaagcattgagaaggacatctatcacaaggttgtcctgaccaaagttcttggggctcgtggagtgataaggaagttcttgtacaagactcctgaagaaagttttggttgtagaagagactggagagaattgagcttgaagaggaagctattttgcagagcattggacgagattcagagtgattgcgaggtttctagaggtggaggagacatccccactacctgcaacctagttcctctgcccccggaaatcgaagccaccttaagaaggaacaaagccgagaggagaaggaaattgttgaaagatagaatagtagcttccattctagaagaagaagctcaatcttctgactctacatcatttgattcactatcatcaagggaatcagctatatacttaccagaagcctctatcatggctgatgaagaccaccacaggattacccttgaggattattctagtagctcagtgctgcaattctttacaa

SEQ ID NO: 25975 - DNA, 324 bp, Glycine max
  Peptide Sequence Number=SeqID_117660
atgcgggttaggctaattaaggaagagaaatccataactgggagagaaacgcgagaaactggaaccagagaaacagcacgcaaatcgaggcaggattttagcgtttcaaagccaaaagaaagaagttcagaagccttttctctccctctctcacgtagctttctctcttcttcatccaccattgaagctccacacaaagcttcaacctttggtgcccatttccgctccaaatcgcaaaaggagggcatttccggagtcgtgaagtgcgtggctacgagtgggactttgaaacttcaggtttgggtggacttctttctcctttga

SEQ ID NO: 25976 - DNA, 237 bp, Glycine max
  Peptide Sequence Number=SeqID_117661
atggcaagcagtcaggaatgcaagggatggaaaattagtgttaatgtcttgagaggggactgttttagaggggtaatttctcgagccttagctcaggctatgaggaatcaaaataggggaaaagttgctggagttgttgagtatcaagggttagattgcttccaacgaaacaatccatctgctttcaatgaagggtacaaccctaatggtgctcataattggataacaggagattga

SEQ ID NO: 25977 - DNA, 456 bp, Glycine max
  Peptide Sequence Number=SeqID_117662
atgccaaaggataccgaagaaaggggcaaaaaggtcattttatggattttcctagatcccagctcgcccaggctagcatctggctcgcctgggccatcaaataacttcatgggttcagaagttaagagaattaagagaagagagaaagaagaggaagaaagaaaaagaaacgaagtcgaggcgctaccgaatcacaaccgtggagacgaacgtgcttttctttatatgctttcgttgtcccgtcgtgaggccaaaaggcaacctggtgtaggaaaatgtgccaaatggacaggtgaatatggtcttgtgctggtcctccgatgcaatgtgaatctgcattctcctatagtcaatgcaaagtgtccagttgttggtcactctagtcgaaatcaactcattgtcttggtttttcataacagtgatgtcagacttcttaggaaccacttggatgggtga

SEQ ID NO: 25978 - DNA, 90 bp, Glycine max
  Peptide Sequence Number=SeqID_117663
atggaagctacagagcccaagaatgagaaaacttccccctccccctttttaaccaccttcgtgcaggggttgctcgcccaggcgagctaa

SEQ ID NO: 25979 - DNA, 180 bp, Glycine max
  Peptide Sequence Number=SeqID_117664
atgacgtcgttgccggggatacaattcattatgtgccaacctagatttgcatctgtacatttaaagaaaaacacacatgatgcaatcctccctaggaagggactactcaccagagccatgagcaagaagctccaagaggattgggctggagctgctgaagaagccctagggttctcatga

SEQ ID NO: 25980 - DNA, 411 bp, Glycine max
  Peptide Sequence Number=SeqID_117665
atggcttccagaaagagaaagagcaatggtacaaggcccacatctcagtatgacacaaggagattctcttcattagatgcttggaccagatacacagataatgttctggggagaaacattttacctgagaggaaggtagagctctatcacactgagctagatgactttaaggctgaattggagagaggtcatttggtgaagattgatgctaacagtcttaagacatttttagagacacatgtggtattatctgagggggagaccttacccgcttactccaaatactgcaggttgcccacagactatagagagatagagactgccttatgcatacctggccgagggttcatcttgaactctgaggaccatcctgggaagattctcaggaaggatctgactacacaagcttag

SEQ ID NO: 25981 - DNA, 552 bp, Glycine max
  Peptide Sequence Number=SeqID_117666
atgcacacaggtcgttctatcagcttgcaggatcatgccattcgcttgtcagaggagcttggtcgatttgtatatgtagatgaggtctttcaacaaactcatttacgaaaggatactgaagaatttgaggctagactatctcaagctaggtctgatgctgcatcaagtattggtgaatcccaactcactcccttagaccctgctgaagaacaaagacttaggagtcggtgttgggttgcagcggcaagaccaaagtgtaagggacgcctttatggtattggagaccttgctcatacttacaaatgcggaagtgacaggttcatgcaacatacacaaggatcttttggtcacgctgaagatgctgcagagattaaccgcctgagggaggagctgcgtcaatcaaaagaggagatgcatgtttttcagtcagtagtccttcagttcctacctccagaggtgtggaacattattaatcaacaacaacaaactcaccaacaacatcaggaccatcaccaggaccaggcagatgaccagcagacagatgatcagtag

SEQ ID NO: 25982 - DNA, 138 bp, Glycine max
  Peptide Sequence Number=SeqID_117667
atggctctactcataatctacatgcggatttttctacttggtttcagcaaaaaagatatgacaacaggtggcgttgaccctcctcgacccccgtcacatgactccaatgggaaagggacaacagtgatgaaaaaatga

SEQ ID NO: 25983 - DNA, 123 bp, Glycine max
  Peptide Sequence Number=SeqID_117668
atggaggggagaaaggagaagaactcgattgcggtagttgtagcttcaatcgcggtagagatgaactcgtttgcggcagttgcaacttcaacgacaatgctagcttcaatggcaacagcgtag

SEQ ID NO: 25984 - DNA, 282 bp, Glycine max
  Peptide Sequence Number=SeqID_117669
atgtcttccggaagtactcacagagaacttccggaagaacgtcatccggaatgtttccggaagaagcttcttccggaagaattccattgtcttccggaagaagcttcttccggaagctgtgttttactgcgctttctttgtttcttcttccgtttgctttgtttgtttcttccgtttgctgttgtttcggtggtggtcccttcagcagtctgttggtggtcccgtgaagtgaagtatttgaagatttggtggtcccgtgttccgtatttgaagttttattag

SEQ ID NO: 25985 - DNA, 385 bp, Glycine max
  Peptide Sequence Number=SeqID_117670
ggggagaagcatttcaactgaaaagtttctatcaaaagaggagagcaggatccaagcaccaacaaagccctataaggaacgacataagattcaaacgcctacaaagaagactaatgctaatggaactgtggaggaaccagaaaagtgtagtaagctaagaacttccattggaaagaaatcaactgaagtttctaacagtggactccctggaaacttggaagtaatgaaacacagagatgcagcacagatagcagcaattgaggctatgcaagagcctgctgctactgagagtttactgcaatgtctaagtcgcaaagaagaagaagcaaagaagaagaagaagcaaagaacagagcgcgaggaaagtgtaaggctcgggttctga

SEQ ID NO: 25986 - DNA, 306 bp, Glycine max
  Peptide Sequence Number=SeqID_117671
atgtttttgcaaatccaaacggtcgagttttaccgagacaactctgggtttctacgggaaaggaaaagactacaatgcgaagggtatttctctcatctcagacatgatatcaaaattcccaacggtaagaatgctcggaattgggtttcaaacctgatgcttaaatttcacgacgatccaacggtgaataagtccgagatcgtcatttttatgagacaagtttggtggtctgcgagaaaaagagagggttttgagatgagaaaagagaaaaacgaaaatgaggtgaagaagaagcacctgacttaa

SEQ ID NO: 25987 - DNA, 1971 bp, Glycine max
  Peptide Sequence Number=SeqID_117672
atggaggaagcgaaggaaaagtgttggaggatggaagtggaggagaagctgaagaggctgcaatctcttctcttcggcgcagagcgcgctctcgagaacaacgacttctcctcggcttacatcctcgcgcttcgtctcctcggattcctcgacgtgaattcccactccaacgtcgacgaagccttcgtccaaccgattcgccgcgacgctctcgccaaactccacttcgctcgccaatccctcactcctcaatctgatcgccaagcttttgaacaagcaaagaaatctccaggacgcatttttggcacaacaggagatattgacattgagaagattcggaattcaaagtacttccaagctcttgtcaagcaatctaaagaaaaggatgagaatcaattggttgatcacctggggaaacaggacaaagcgggcagcaaagcctcaaagcaaatggtgcaaactaagttaccatccatgtatgggaaaagaagcttgaggactagcaatggttccaagagtatttttaacatgaaaaataatagctctgaggactgcatgagtcttgataggcctcaatctcatgccagccatacaaagggtccaggtttctcttctatcttgcaagttgaaggagaagaaagagcttttggaaacacattctccacaaaacgtgtacacatggaaaacaatagccccagagttggatttgtgaagtcaccttcaagtaaggaggatgttaaccctgatgcttgtggtaacgggtttgttactgctagagcaaagctggaaatggaagcaaagcagaagcgaggagtaggcggttcacccagtgcctctgtctcaccacaatgtgataacaattctgccaacaggctgtatggtggaagatcatacggtgttccacgacgtggcgtccgtggtaattttgttcccccgattaaatccaatgggaacaatgctggaaatacaagcacacgcattgctggaaaatgtgatgattctttagatgactctacaaagaaatgtctggaaatcctatgtggtcctgatggtgagcttcctgagaaattgaggaatttggatcctcgcctcattgaacatgttagtaacgagattatggacagagatcccaatgtccggtgggatgatatagctggattggagcatgccaagaaatgtgtcaatgagatggtcgtatatcctctgcaacgtcctgacatattcatgggctgtcgttcccctgggaggggtctgcttctgtttggtcccccaggaactggtaaaacaatgataggtaaagccatagcaggggaggcgaaggcaaccttcttttacatatccgcaagttctttgactagcaagtggattggtgaaggtgaaaagcttgtaagagccctttttggagttgccagttgtcgtcagccagcagtaatttttgttgatgaaatagattcgctcctgtctcagcgtaaatcagacggtgagcatgaatcaagtagacggctaaagacacagtttctcattgaaatggaaggctttgacagtggtagcgagcaaattttgcttataggggcaacaaatcgtccccaagagcttgatgaagcagcacgaaggagacttactaaacgactttatattcccctaccttgctcagaggcaagagcttggattatacgtaaccttctagagaaagatggattattcaagctatcatgcgacgaaatggatatcatatgcaaatttacggaaggatcagacatgaaaaacttagtgaaggatgcttctatgggacccctaagagaggctttaagtcaaggtatagaaattacaaagttgaaaaaggaggatatgcgacctgtaactcttcaggatttcaagaattccctccaagaggtgaggccttctgtttccacaaatgaacttggcacttatgaacaatggaacaagcaatttggaagcctatcactgtag

SEQ ID NO: 25988 - DNA, 597 bp, Glycine max
  Peptide Sequence Number=SeqID_117673
atgactgaagacatcgtcgtctttgaaatgtatgtaggtcattgtcgccttttaaaggcatgtaatgacggaagacatggtcgtcttcgaaatgtagatgaaggtcattgttgccttttgaaggcatgcaatgacggaagacatggtgttcttcaaaatgcaaatgataatatgaccttttttgtctccacatgctatctgactcgcttgtcttgggatagcagggaaaacttcagtggcctcagtcgacagacattgagtcttcgacaaaggaaacaaccgactgtggtgcagatgaccatattggtctctgcgtgtcaatgggctcgcttgcctctggttgacaaaggagagactaaagtagcctcggtcgatagacatcgagtcttcaacaaaagggtgcagatgaccatatttgttgtagctctatgtggagcttgtaggccttggatcttcttcatcaatggagtcctttgcttcttgaagtttgatggcaacggaatggagaagaagaaagatgattggagacgccacttcaagaagaagatgagtctagaggaagctcaccaccataggaagccatggataagagcttga

SEQ ID NO: 25989 - DNA, 825 bp, Glycine max
  Peptide Sequence Number=SeqID_117674
atggaggactttgagtcctatgaaggcgaggactttgagtcctctaaaggtgaggaccttaagtcctctaaaggcgaggaccttgagtcctttgaaggtgaggactttgagccctctgaaggcaaggaccttgagccctctaaaggcaaggaccttgagccctctaaaggcgaggaccttgagtcctctaaaggcgaggaccttgagtcctctaaaggtgaggactttgagtccgctgaaggcgaggactttgagtcctctaagggcaaggactttgagtcctatgaaggtgaggaccttgagtcctctgaaggcgaggacttcatctttgagtcctctgagacaagccaatcaatgggcactatcttggaggtcgaaactcaggagcacatgtcgcttgagcaaacaaaccatcagcttacactcacattccagtggaacccgtatcatttagactttgcaccttatgcttcaaggtcatacaatgctcaatggaatgtcccagaactcctccatgatatgcacatgttgcgtttgagtcgtatcctcagaaaaatggaggtcgaggaaccttggctggggttatggctaccattgcattatcaagtagatatgggagcaaggtggtgtttggcattggatgtgtggcaggaggggcttgttgctgatttaggggtgacctttgtggttgattgggtggtggataatgagaagggccgatattggctgagtaatgacattgttgggctggtggaaaacttggccatgatgatcaaatttgcctctcttcagacctacttcgatactttcgtcggtgaagactaa

SEQ ID NO: 25990 - DNA, 801 bp, Glycine max
  Peptide Sequence Number=SeqID_117675
atgggggttaagtacctcgaggcagtcaagcgaaggttgcatgccactaaacaatggtccccggacgaaattagggcaatcaattcatgggactccggactcaatgatggaggatgcacgaacaacgctaggcaatcaattcgtggggctccggacttgatggcaatcaattcgtggggctccggactcaatgatggaggatgcatgaacagcgctaggcaatcaattcgtggggctctggacttgatgatggaggatgcaatcaattcatggggcttcggacttgatgatggaggatgcacgaacagtgctaggcaatcaattcgtggggctccggacttgatggcaatcaattcatcgggttccggacttgattgtctctggatagtgaaaaaaagatgcgggaccaaatggttccctcgcatgtcatcgggcccgccgcctctggatgacaaaggtgcaaatgaccataatttgtctctgcgtgtcaacgggctcgcttgcctctggttgacaaaagaggttgtctgcgcggaagatgacgtaaatctccgtgtgtcaacgggcttgttggccgcgattgacaaaggggtgcagaagacgacgttagtctctgcatgctatcatgcgttgagtcttagagatagcaaaagaaagtttgcgggttaccgtcaggtgtctccgcatgccaccggactcttgggtcatggtaacaaaggtggggtggtcgacaaaagcagggcttttgctcctacgtatcctcaatttgtgatgaggaactcagacctacgtagttcttga

SEQ ID NO: 25991 - DNA, 231 bp, Glycine max
  Peptide Sequence Number=SeqID_117676
atgttaggattcacaagcgattctcctcaaattttagccagcccgcatcaattagactttgcaccttatgcttcagggccatacaatgctcaatggaatgccccggaactcctccatgataagcacatgttgtgttcgagtcgtatcctcggaaaaatggaggtgggttttgttgttgatttagggatggcctttgtggataattgggtggtgggtaatgagaagggctga

SEQ ID NO: 25992 - DNA, 340 bp, Glycine max
  Peptide Sequence Number=SeqID_117677
atggctcacaaattctgttttgaagcacttgatcgaagtctaagagatgctattaaggtgaaatcaagttctgataaaatctttggtggcaaagttatgctatttggtggagatttccggcagattctgccagtcattcctagaggtagccgctctgatattgttaattcaaatattaattcaacttgtctatggaatcattgccatgttttggcactgtcgaaaaacatgcgtttagaagccaatacagatgcaatagacaaagaagaaactgcagcttttgcaaagtggatccttaatattggcgatggaattgctggccagcaaaatgatggctatg

SEQ ID NO: 25993 - DNA, 387 bp, Glycine max
  Peptide Sequence Number=SeqID_117678
atggtgttgcagaatgacgaaactgaactcttaaggatatggccacatgaaagaaagctggattcaagaacaattaactgttattttgttggctatgttgaatgctctcggggctataagttttatgattccactttaagatcaatatttgaaacgggaaatgcaagatttcttgaggaatttgagtttgggaaggaaaagaacataaggaaagttgtctttgaggaagaacctgttattgacagtgctcaagtcctcatacctattgttgttcaagaaacaactccaataatagaaaacaatgttcaagaacctgttattgacagtgctcaagtcctcatacctattgttgttcgagaacaagacaatgatggggttcttccttaa

SEQ ID NO: 25994 - DNA, 498 bp, Glycine max
  Peptide Sequence Number=SeqID_117679
atggcacgtattgctgacaagataaaaaccatcgatggatctaaagaaactctgaaacttgctgtaaggataaccgagctctggtttgttgggacaccgggcaggtctgaacaagctgagatgatcattgttgactctaacggtgatcagatccacgtggtctgtaagcaagaccagttaaaggcatggaaaatggatttgaaggaaggttgtacttatgtgatgcacaattttagagtcaccaagaatgatgaacagtacagagtttgtgatcatccatataaattgacatttattggagttatggttgtcagacagtgtgacttagatggccttcctttaaaaaagtatagatttatagatttttcagatatcattgttggccaattacagtttgacctattagtagacatcattggtgttgttgacgaggttgtctttcgtcatatttcacccaaaagtaagaaagttgtttttaagcttatgaatttgaggtaa

SEQ ID NO: 25995 - DNA, 180 bp, Glycine max
  Peptide Sequence Number=SeqID_117680
atggttgtgaagcgatcgcagaaggatggttgtgaaggttgcgaagcgatcacagaaaggttgaagcgtgtgctcaacctaaggatggtcactgaaggcataaacttacatcagatcatggaagattgccttaggatcactaggggtgacacctcagatggaaatgttagggcgcgatga

SEQ ID NO: 25996 - DNA, 423 bp, Glycine max
  Peptide Sequence Number=SeqID_117681
atggtggggttgccagccagaaaggtagccggaaaagtgatgatggccagcggtggttggaaagtcattggagaaggagaaagagtcgttggaagaagggcaacgagcaaaagggctcaccggaatgcagaaacaggtcactggaagaaggacaacaagcggaaaggatcaggtagcatatttgagaccttgcggctgggcaaacctttagttgtggttgtaaatcaagatttgatggataatcatcagagtgagctggctgaagagcttgctgatagaaaacatctgtattgtgctagtcctcaaacactccatcaaactatagcggacatggatttaagttctctccttccttactccccaggtgatgctacaccagtggccaagcatataaacagattccttggttttcctgatgattga

SEQ ID NO: 25997 - DNA, 591 bp, Glycine max
  Peptide Sequence Number=SeqID_117682
atgagcattcacgtggctcagttgattgctgatgccatttatctatttgcaggtatcgcgctaaccaggcaccctttggacccggataagtccaacagggccctgggatttcccgtattgatcacaggactttgtcaatcgttcggagtccccgtcgcacctagcaaggtgattcggccacccatcacctgggcttttattgagaagtattgcacgcagaggccggcccaggatgatgcaccacaagccgcagacacgccgccacctcatcaggctggcccagctgggtcatttgattcggagcagtatttacggcatttggttcgccagcaggctgccaaccaccgggcgcatgtacagactcatgactgtctttaccagctaagccttagcttgcagagccagggttttacttcttttccatgctctacttcggatcggttcagggcagaggtcgcatggcccggagattggcctgaggcccaggcaggaaaggcacccgcagaggctcccggcgaggcagatgaggcccgcgaggacgaggagatgaccgatttgcttgatttcttgggagggagcagagccacatga

SEQ ID NO: 25998 - DNA, 249 bp, Glycine max
  Peptide Sequence Number=SeqID_117683
atgagtggtgccgttagggctgcattgaaatccaccactagtgtttgtgcacttgtgcagagaagccatggcctcctcccaatgaggtgcttctccactgaggcagaacagccacctctgaattcaacgccccgccctcctccgttctttgagactgaccattcagagatcatatgtatcctctacggaacaatcttgcatgagtcaggtgagactatgggtggcaaagctcactcttcaaatatttaa

SEQ ID NO: 25999 - DNA, 600 bp, Glycine max
  Peptide Sequence Number=SeqID_117684
atgactgcagacgtacatggtgctgaggggtcacatgctgatgatgctgagggatttccaggtgggccacgtgacccatcagtgctgacatcatttgcggaccatgttgcacatgccatttggagtggacaggaacgtcctgagttgaagttggtgtcgcacgggaggaaggtgacattaattgggagaccagtgtctgagattgaaggattggttggtgccacaagattaagtccattgatcgggtgttcagttgtaaccggcaatcctggacttatatccgcatttgtggagaggtggcacagcgagatcaactccttccaccttccagtagtagagttgacgatcacactggatgatgtgtcgccactcctccatttgtctatcagtggcgcgttctatagctttcatgctctttctgtggacgaggcgatatttttgttgaccgagttgcttaaggtgtctgttgaggaggctagagccgagacagcacgatcacgtggggcatacgtacggctgggatgggttcgagacatctatgagatgagatgtgaggcccggtggtggattgtggcagctcgtgcttatctgctgcacttg

SEQ ID NO: 26000 - DNA, 314 bp, Glycine max
  Peptide Sequence Number=SeqID_117685
aaataatgagtcgaaactgccaagaaatgtaagcaatttagatgatgatgatgattatcttgtgtctaattcatacgttgaaaagtctttagatgaacatgatagtgttgatggtatatctgatacagatgataaaatcacccacatgattgaaccaggtgtagaaggaattcaaaatccattttggaatgatgttttgcattataacaatatcaattggagtcatcctgatgaggaggacatttgcgcgacaattcctccttctgatgactcatggacacttattcttgatccaagtataattcgtgcgaaag

SEQ ID NO: 26001 - DNA, 642 bp, Glycine max
  Peptide Sequence Number=SeqID_117686
atggacttgaaggaaaattgtacttatgtcatgcacaattttgaagtgctaaaaaacaacgatcagtacagagtctatgatcaccaatttaaattggtgtttattggggtcattgttgtaaggcagtgtgttctagacgacctcccttttagaaaatacagcaagtttgaacctgggctattggttgatgttaatggtgttgtggaggaggttgtctttcaccatgtttcaggaaaaggtagaagggtagtctttaaaccaaaggacttgagccagcaattgctatcttgcactttgtgggatgattattgcttgcagtttttaaaggatatacccaattataaagttctattgacccatggtagaataaaggaagctcagggatcttatccgccatcggtcagcaattctttcaaggcttcaaagttagttattaaccaaccggtgatggagattcaagaattcattgaaaggcttgcagagttgggcattgaggcccggtcagtttttaaatcccatggtgaaggaagtacacagctttcaggttctatccaattatcatcaaaggaatcattctttggaaaggctgaggcaaagactattgctgagattaacaccatctctgaagtaatcatcttatag

SEQ ID NO: 26002 - DNA, 204 bp, Glycine max
  Peptide Sequence Number=SeqID_117687
atggctatatcaaccaccatcgatgcacccaaagaccaccttcaatgctccacactgcaccaaatgcaccaccacaagtttgtgccccacccccactcaccaccaccacatgtttggtggatcacaatggtggacgttgatcatggaatgcggcggtggtgttgggtagaggttaagtgtgatggtcatgaaaatgaagtgtga

SEQ ID NO: 26003 - DNA, 441 bp, Glycine max
  Peptide Sequence Number=SeqID_117688
atgaagaataagaaggttgttatggctggtgtctcgttaagtgaggcttgtccgcttagcgagaatcatccgctaagcgaggccctcagcctgcttagcaagttgggagaatctggaggagaatatgccaagcatttggacgttcaacgcatcatcagctcgctcattaaaggcaatagaggaaggaaggagttggtgttgaatgaaggggattggaggattaacaacaatgcttataggctagacctcctagaggagtatggagttaggaacacctttaacattattgatttggttccttttgtaggtgtagctaattcagatgatgagtggtctgcagatttgaggacaaatcctcttcaaaagggaggggatgatgcaatcctcccaaggaggggacccgtcaccgaagtcatggctaggagactccaggaagattag

SEQ ID NO: 26004 - DNA, 456 bp, Glycine max
  Peptide Sequence Number=SeqID_117689
atgctgagttctaggagagggcagaaaaaggacttcgttatcattgtgatgggaaatttggccctagtcatacatgccctaataaacaattccaagtccttattttgggagaaggacaagatgaagaagacgaaatggaagtgggggcaatacatgagaaataactgcaaaagattacttggtgaagataagtttaaatggacttcaaagctaatggggtttgattttgatatagtgtacaagccaagatgtgagaataaggaacctgatgctttgtcaagaagaatgacatattcagccatttctatgatcagattttttgatgaggaagaacgggattctgaagttttggctgacctaaaactgaagaaaattatgcaagatttattggtaaatggatctgcacatccagatactccttacaggataaaaaattatggtataaaggcaagttag

SEQ ID NO: 26005 - DNA, 309 bp, Glycine max
  Peptide Sequence Number=SeqID_117690
atggcaaggatctatggacattttcctactattgggcagagggaggacatatgtaatagggttgttgaacacttgcaggacgaggtggtagaagagtttagggtagttggggaggatgaagacggactagcaagaagcaagttacaaggcattttgaagaagtcaaaagtggagctgattatcccaattcgacacagcgaatggagtattcgccacagtgaatcatcaagtctgggacatggagccccagccaaattcgccacagtgaatgtatatatcatcaaggccaaaaagcgttcaaagacatga

SEQ ID NO: 26006 - DNA, 531 bp, Glycine max
  Peptide Sequence Number=SeqID_117691
atggcttcgtctggcccagtactttcattttctggaactcccactatcacaacagcaaagctcaattggaaaaattacttatcctggtctgcttcagtagaactgtggttccttgggcaagggcatcatgaccatcttgaaaacgatgctgaggcagttccagatgatagaagacctgagtgggaaaatttagattatcatctctgtgttgtcttatggcagtcagttgaggtagatgttttggagattctcagatcgttcaaaacatgctgctccttttggaaaaaggcccgggaaatatttactaatgatattcagagtttgtttgatgcaaccatgaaggtcacagctctcaaacaaaccagccacgatatgattgcacacataggtaaagctcggacagtagtggaagaattgaagaggttccttgtggctgaatcgttggaggaagtgaatagaaagctatataagttctatatggttctcatcttgagaagtttacattcagactttgatcacgttcatgatcaa

SEQ ID NO: 26007 - DNA, 747 bp, Glycine max
  Peptide Sequence Number=SeqID_117692
atggttgctaggacaagattaagtcatttgattgcgtgttcagtagacaccagcgatcggggacttatatccttgtttgtcgagaggtggcaccgggagatttctagtttccatcttcctgtgggagaggttttgatcacgctagacgacatcgcgtctcttcttcatttgctgatcattggcgacctccatgtcttccagcctctgcacatcgacgtggcagtgctgatgttggttgagttattaatggtctcaccagaggtagccatggctgagacaggacattatgccctgcgtgacctcactcagactaggaggtatgcatggagagctgctagcctcgtgcatatgtacgatcaccttaatgatgccagtaacagcaccagccgacatgttactggttacatcacgttgttacagtgttggatatatgagcacttttcgtcagttgcggagtgcaacgctgatccagactacgacgaggtgtcaccacgacagcttcgttggggggccgttgctattagatacagatcggagagggttatgcgccaattcggatacgtccagggtattcctgcacaccctgacgattcatgggtatcatttgatgacgtagacgataggtggacacactactcagaccatcttgcaccaacaggtgacatatgtgttgtgccaggtcagtgtgcgcccgactacatagattggttctttgttatatcgcatccattcatgactgcaccatag

SEQ ID NO: 26008 - DNA, 1003 bp, Glycine max
  Peptide Sequence Number=SeqID_117693
atgggtagcttctaccagaacaattggagatgggatttgaaatggaggagacacttattcgagcatgaggagggagtagttgtggctttcatggaagagatcagtgcttatcctattgagtgtcatctgaaagataacttactgtggaaagctgatcctactgggatgtactctactagatcagcttatagacttctgtcaaatctaaatagttttgccccagatgggaggaactttcagcttatttggaaattaaaaatccccccaaaggctgccattttcacttggaggcttataaaggataggctccttactagagctaatcttcatagaagaaatgctggcagcatagctactgttgtaaaaatgcacttaagtacctctggtactattgctcttattaataatactatatattttctgccttccaaaaaaaaatttgaaggattggagaatctgccacctccagatactcctgctgtgtatgtttcaaatcatcagagttttctagacatatatactcttcttactttaggaagaagctttaagttcataagcaagactgggatattcctctttccaataattgggtgggcgatgtttcttttgggcatcattcctttgaagcgcatggacagccgaagtcagctggactaccttaaacgatgcatggatcttatcaagaaaggagcctctgtttttttctttcctgagggaacacgcagtaaagatggaagactaggcacattcaagggctgtaagcatttcaaaaaaagattcttggcaatatggaaggaagaaagattctcaaagcagaacccttgcagaccaaccctggatgggattcagttttcttctcttggccaagggcagaaggaaagccttgttgctagattctctgaagtggaaatcaagtctgcagtttgggcttgtggtggagataaaagccctggcctggatgggctcaagatcaactatgctaaaagtcaatttgggtgcttgg

SEQ ID NO: 26009 - DNA, 819 bp, Glycine max
  Peptide Sequence Number=SeqID_117694
atgctgaagatgggaaattcaactaaagttgtgataaaacaagacatgaagggaaaaaggcataaatatgggtttaacaacaacaaatgtgagaaggcacagaagaaaagggtggtggatgatgaaactggcgacaaacatcagctggatgaagttatagagagaggaagcgaacaacgaacctcgacttcgagcttagcgattaagtggacagaggggggacctgtagtggcacacgagttcgagggaggccccggcgatgccgtcgaggagggcgccgccacaggagtcagcggcggccttgggcggctggtcctcctggaggcggacggtgtagacttcgaggacgttggcggcagtgacgacgaggttggggagggagccaacgtggtggcaggggcaggagggccactcgacgtcgatgtcgtcgagctggagagggacgaagtcagagcgggagtgggtgaggaacccgacggcgcaattgtcgatgtcgatggggcactgcatcatcttcgtagttcagtctcagcgacgaaagagaagagagagtatgagagtgtgagagtgagagggtcagctgagtggaggccagcagggagaaaggttcaagaacttgggttcgcgaaaggaagttgtttagaagtgaacaaagaccctttaatcgattacttagagcatctaatcgattacattgttcttgagttatttccagatgttgggaagaacactttaatcgattacttagataatctaatcgattacttcgttgaatcaatcaattaccttgtagatttaatcgattataagcggttataa

SEQ ID NO: 26010 - DNA, 225 bp, Glycine max
  Peptide Sequence Number=SeqID_117695
atgtacttaaaagatgtcataaggcaatggagtaaagattatgggttcattaatgacaaaggaattcaaaaaatccaacagaagctaaatgaagtggaagatctagcatccaatacaagtctatccgaggaagacatcaaggctaagagagatttacagcaacaattgtgggaggtctcaaatgcctatgaatcccttttaagacagaaatctagagcaaagtga

SEQ ID NO: 26011 - DNA, 87 bp, Glycine max
  Peptide Sequence Number=SeqID_117696
atggagttgcctttggagagagtgaggttgaggataagaaaagaaagagagatggagaggtttggagaagatgaaaggatgtggtag

SEQ ID NO: 26012 - DNA, 342 bp, Glycine max
  Peptide Sequence Number=SeqID_117697
atgggggtgcaaatagcaaccaagcccacttgggccttcttgaatacggttgcttctggaggaagcaacttagctcgcctgggcgagctgggtgacaagcttctcccctattttcctataaatagggggagaagtgaagggaaaaaatgtttagccctcctgattttcaaccgttcttcgacgttcttcgttcattcttcgtcgttcttcggtcttcaaccggataaaaacaacttaaccaaacactttgttcacaaagaaatacgtaggtttgatttccttatcgcaattaaggaatacgtaggagcaagggaaacaccctcgtcaaccgcaaaaagataa

SEQ ID NO: 26013 - DNA, 315 bp, Glycine max
  Peptide Sequence Number=SeqID_117698
atggagggtggtgtagatgttggtgatggtggtgtagtttcagcaatagtaatagacattatactcagtgctggacccaacaacaacaacaacaacaacaacaacaacaacaagaatatacagacatttcagaaaatgtatcaacagaaaaatcatcacaatttcaaagcatgctgttgcaacctaccctacaacgagaatgagggcgaaaagccaaaggagcatcttttagaaaggaaaacgcgtgggagtcaccaccaacatttatttgaggaaaatgtgagaaaaaccaaaaaggaggtatacgaattttga

SEQ ID NO: 26014 - DNA, 288 bp, Glycine max
  Peptide Sequence Number=SeqID_117699
atgtcctactcctacgcaccccctcactcctcccacacaaccatagcattacctactaaggaagacgttgatcttgttgtcgctaccgccaaagctgccctctcccgcaacaagggcgtcgattgggcctccgcttccggctccgtttgggctcgctacctccgcgccatcgctgccaaggacgatgttgccggttgctttcagttctacgctgaccttgctgaaaaatcgaacgcacagaaaaaggctcatgtgtctgatgtgccatcattttcttctattttctaa

SEQ ID NO: 26015 - DNA, 739 bp, Glycine max
  Peptide Sequence Number=SeqID_117700
tgttctaactccatactacagtgaagagactgcctattcgaagaatgaccttgagcttgaaaatgaagatggtgcgtcaatcatatattacctgcaaaagatctaccctgatgagtggactaacttcatggaacgacttgattgtaagaaagatagtgagatatggaagaaagatgaacacatattgcagctacgacactgggcctcgttacgaggagtaactcttagcaggatagtaaggggaatgatgtactaccggcgggctattaagcttcaggcttttcttgatatggcaaatgaacaggagatacttgatggctataaagcagttattgttccatctgaggaagataaaaagagccatagatccttatatgtcaaatcaagaaacaagctttgtcataattggtcaaagagttcttgcaagatcactgaagattttgtgtttgtgatttttgctgcggtggagacccttttggttttgggttgtgctttgggttttcaggatggtggggtttctgtaagttcaactacatcaaaacttgccaatcccaatattcgattaccaggaacaacttcagcaaattccagagcttcttcagctgcacttggtcaaaagaaattgtatgcagaatcccagacaggaaagtccacttttcaaaagcttttggagccaatgcttcctcaacttcctggaatttctccttatagaattgtcctggggaatgttaaggataag

SEQ ID NO: 26016 - DNA, 237 bp, Glycine max
  Peptide Sequence Number=SeqID_117701
atgtgtacattcagagaggcttcaaagaagttagcagttgagaatgctacaaaagaaactaatcaacttaaggaagaaactaaaggtatatttggtgcaacctgtgtttgctttatgatagcaaagaaagaggaaattgatctatctgacaattttgctgcaaaaattgctacaaaatctaaacagaaactcagaaaaggaattgaggctcttgaagcatacaatgcacacaagtaa

SEQ ID NO: 26017 - DNA, 213 bp, Glycine max
  Peptide Sequence Number=SeqID_117702
atggggaacacgctacttgaaacttttgaaggtgctcagggaactcctgttccgaaggacaatctaccaggcctcgaaaccgttccaatgcccatacaagattgttcacgcgctcaccctccagatatgcaaaacccagcagagaaagtcatcccggttggtgtcacctccacaaagtcaagcaatgggagcctgtacctatttgttttgtag

SEQ ID NO: 26018 - DNA, 433 bp, Glycine max
  Peptide Sequence Number=SeqID_117703
cggaagacagcttcttccatggagtctcgcggaagatgtcttccacgagactccacagaagaagcagtcttccgcaattgtaatgtccacagcggaagacagcttcttccgtggaatctcgtggaagacgtctttcgtgagcactcacggaagaagctgtcttccgatgtgcagcggaaaaaagcttcttccgtggaatttcgcggaagatgtcttccgcgagatcccacggaagaagatttcatccgctgttgacattacaactgcggaagactgcttcttccgtggaatctcgcggaagatcggggtgggagtagcgacagtgctggtggtggtggtgttggtggaatggtggtgtggaggtgacgataatggtaggggtggaatagtggcgacaacgatggtggcagtagtggtggaatggtcatggtga

SEQ ID NO: 26019 - DNA, 177 bp, Glycine max
  Peptide Sequence Number=SeqID_117704
atgcaatcctacccccaagggtatttgatagaagactccaagaggattgagttagagttgctaaagaaggccctagctagggttctcatgaacctcaagctaagctctaacttctcaagtaagtttctcaaagaagattctcaagaaaacttctcaaagaagctacctaggctataa

SEQ ID NO: 26020 - DNA, 377 bp, Glycine max
  Peptide Sequence Number=SeqID_117705
atggcacaatattgcagagagttggctacaagggttgcacttgcttttctcaaaatagttggctacaaggatcaggaaacccatagctccccaacctgttgcaacaacaatgggattagggaaagaatgctgagaaatggtactattgttgctcatgtaaatagaggagagaaacctgaggaaaagttaaggtttgttgatgagtattttggcatgcaagtgaagcttgagtttgaggaagaagttggagcactagagttgatgatggaggatatagctgaatcaactaatccatgtgaactcaatgagggagattggagcatggaagctgtagcagaagttgtgcaggccattgcagtggctgacataggaagagg

SEQ ID NO: 26021 - DNA, 243 bp, Glycine max
  Peptide Sequence Number=SeqID_117706
atgctccaaccatatgggatcagcataggcttaaaggagcactcaaacccggtgactcccaaggcctacactctgaagagtccgtcagggcctctccctcctgattcagccagcgatagcagcatctctagcggttccctgagattcctccaatttttatcctctaactgctccgatagagttcccaaacgtcaacgagacagagaagggattgaagcctccacttgtactgtcatcatgtga

SEQ ID NO: 26022 - DNA, 360 bp, Glycine max
  Peptide Sequence Number=SeqID_117707
atgtgttctgaacgccagttacagtgcaaatcaaggaaccattcaatgtttcaatcaggaatgcaaaaaataccaaaaaagagggccaaaagggtattttcattgagtttcctggaccctagctcgcccaggctagcctctggctcgccagggcccccaaattacttcagggtgaaggaaacaactcgcctaggtgagccagttacttcaagagtaaccatcaactcgcttgggcgagctgccattgccccaagtgcccattttcctataaataggcgtgctagggaggttgaggagaggttccaaggtttagtacttgagggagttgagagaattaagagagaagaagaagaaagatga

SEQ ID NO: 26023 - DNA, 267 bp, Glycine max
  Peptide Sequence Number=SeqID_117708
atggagagggatatgataacaatgatagtagacacgttaccggtgttctactatgataagatggtgggttacatgccttcaagctttgctgatttagttttcgctgacgaaaggatcaaagtgggtctaagaagagaaaaatttgattatcctgctttgatgaataggaagcctggggctaatggagagaataagaaggagggagaaacccatgttgtggctgctgttcctacatggccaaattttccattagcccaacaatattaa

SEQ ID NO: 26024 - DNA, 261 bp, Glycine max
  Peptide Sequence Number=SeqID_117709
atgagtggttattgggaaaaacctttcaagctgtatgctcctgtatctggaagtgtgactgcagctaaagccgggacacttacttttatgcctagaggtaatcctatctgccataacagctctctttgtagagggaattcaaaagcttggacagtcggatctgataaggagtttattgctgtgttttattcactcctctgttgtctaccaaaaacatggatgtgtagctttacccgtggtaacggggaagggaatacttaa

SEQ ID NO: 26025 - DNA, 219 bp, Glycine max
  Peptide Sequence Number=SeqID_117710
atgtcggaaaccctcccaaaccgacgcccatccaacaaaagtcctcgctcaaccacaaaggagtcccccacaaaactcctttgccgcacaaactcgtcccgccggcaactccaaccaagtttggtagagttcacagagaatcgtggaaggttcggactgggatatgaacctatgcgcgccgatctttcgaaatgttacgaaaactcacggattgcgtaa

SEQ ID NO: 26026 - DNA, 222 bp, Glycine max
  Peptide Sequence Number=SeqID_117711
atggctcggatgcaagagataacttggctctcgaagctaaagatttcaagtgaggaagaggttgaaatccctgaggagagcaaagaggtgcaagccttgaaagcggagcttgaaagagcacgactagtcaaggaaaagttcaagacgacaaccatcagggttaggaaagggtgcgatgggctgagggatgtcaacgtggccacaaccgccgcattagaatga

SEQ ID NO: 26027 - DNA, 216 bp, Glycine max
  Peptide Sequence Number=SeqID_117712
atggaagtaagagacaagattgaactccttccatatacggacctagatgaggtagttcaacattgtataagggtagaacaacaattaaaaagaaaaccatcttctaaaaactctacctcttactcttatagaaaggaggaccgaactctaagtttgttaggagtaccaccttctaagccaaaggatgataaagggaaaagatggagaattttctga

SEQ ID NO: 26028 - DNA, 513 bp, Glycine max
  Peptide Sequence Number=SeqID_117713
atgaccggaaggctgcttgccggttcattggctcttgaaagccgcatccttcactatcttattgtgcatattttacttccaagatctttaaaccttgcacaggtttctgaagaagatcttattgtcatgtgggcttttcataccggccgacaaattgattgggcacacttagtccgatatcgcatgcataaggcattgcgattaaatgctccttcaccatatccacatctagtcactcttttccttcaacactttaacatccctcttgattctgaaccttatgttccaatcaagagatccttcttaatcggtgctgctgtgattgcatcttttggttaccgcaaagagcgtgatggctcttggataaaaaagggtgctcaacccaatgatgatgaaggacacttaccaggttgtcataatcaaaaagggggagattatagaagcaagcttcatgatgatgattcaagtatgaatcaagtagttttgatgatgacaaaaagcccaaaagaatga

SEQ ID NO: 26029 - DNA, 303 bp, Glycine max
  Peptide Sequence Number=SeqID_117714
atgactgcgccatcgacggatcctcctcgagatgcatatgcgacgcaaccctgtcatatccctcatgaggcagcaccagcatcgacacatgcggatcctgatgcggacgagtgcagacatgcagtggaggcttgccatgcgatcgcggaggcgttggagcagcatctaaatgcgtcaggcacatccacacatgaagaggtcatccaaaaatgcctcaggattgccaggggtgtcacagaagacgtgagtgatgctaggtgcaccaacaataatgctggtgcacctagtaacacccttgtttga

SEQ ID NO: 26030 - DNA, 1266 bp, Glycine max
  Peptide Sequence Number=SeqID_117715
atgggatcaaatcaaacacctctaattaagaaaaggttctatcaagtcaaaatcaaaagcttaaaggtcgccagtttgcgagaattggggcaattgatgggtcagctccaacgtcaagccttctgcaagacctatgggaagatttgggacctagctatggtagaagtctccatggaagcaattgcatcccttactcagtattatgatcaacccctaaggtgcttcacgtttggggacttccagctagtaccgactgtggaagaatttaaagagatcctgggatgtccattgggaggaagaaagccttatctcttttcggggttctacccttccatggtaagagtagccaaggtagttaaaatctcggtacaagagttggaccatgtgaagcaaaataggaacagggtagtcggaataccaaggaagcatttggaggaaaaggtgaaggcattggcagatcagggggaatgggcttcatttattgacatcttggcactgttgatatttggtgtcatcctctttccaaatatggagggattagtggtcctagcagcaattgatgccttccttgcgtatcaccatagcaaggaaagcccggtcattgctattttggtcgatgtctatgacacgcccacttatccactgcaaggtcatcgcttatgcgccaagaaaggaaagaaaaactgggagcaactctgggctagtgtggagcgccgtcggaggaaagcatcacgcctttcatcgcccagggttttagtgaccctaatgcaagagtacttcaaggagtccgcaaggcatgagcttaaagctacaagagaggaaaaggctgaaactccaaaggagagtgaggaagtgcaaaccctaaaggcggaacttgaaagagcccaagtagtgaaagagaagttcaagtcaacagccatcaaagtctggaaagagtacgatgaactaagggatatcaatatggccactgtcgaagccttggaacgagaaaccaagagggcccgaaaggaagaacacgaccgaaacaatgagcttgagcttcgaagagccgaaagggatcaatcgtgggtcaaagacatgatcttgaaagatgagttaaaggcttgccaaaggtcgaaaagaagcttgtctgagcagttaagcaagaccaaagaaaatatgtgggccatcatcgaccagtacaaggaaaagctaagcctagcagtggctcatgagcaaaggctagaggaagagtacgccaaggtatcagtcttgcaagcggagtag

SEQ ID NO: 26031 - DNA, 282 bp, Glycine max
  Peptide Sequence Number=SeqID_117716
atgggaacgttaaggccttctcttgcatctatggcccaatcttcttggagtcttttgatgcaatcctctaggaagggaccagtcactagagccataagcaagaggctccaagaggattgtgctagagcagctgaagaaggccctagggttctcatgaacctcaggagcacaaaatttcgtgctcttctcttcctctcccttcattcatctcctccttcctccaaggtcttatccatggcctcctatggtggtgagcttcttctagactcatcttctccttga

SEQ ID NO: 26032 - DNA, 405 bp, Glycine max
  Peptide Sequence Number=SeqID_117717
atgccacatcaaggagaagatgagtcaagaacaagctcaccaccattggaagccatggataagagcttgaaggtaggagaagatgagtggagggagatggagagaaggagcacgaaattttgtgcctcaaatgagctatggttcaacccactaatccaagatcaagttcaagattctccactaagtgtgcttaggtgtcatgcggcatcccataagcctgaaatctaccctatagctcatgagaaccctagggctttctcttgcatctctggcccaatcttcttggagtcttctatccaatgcccttggggggtagggttgcatcattccctcccccttgaaaaggatttgacctcaaatccagaggttattgaaactcttggcttcttccctcaacatctgtaa

SEQ ID NO: 26033 - DNA, 222 bp, Glycine max
  Peptide Sequence Number=SeqID_117718
atggtagaatctttgaagaaacgaaagggatcctcctccaccaccaccgctacaggccaccgccgccatggaacatctggtgacccactagcaccaattcctccttccttttcatctcccaggtccactaatcttgcccaggcctctaaggaggatttaatgttgttgtgggctcttcaaattggtcgtcaaattgactgggcccatcttgttcagtactga

SEQ ID NO: 26034 - DNA, 411 bp, Glycine max
  Peptide Sequence Number=SeqID_117719
atgtcatgttctttttatatgcctagagatatattagtcattcatgtgtctattgtgtcatctaagttcatattcaacataggagctcaagaacttgatccattccaaagctcattgtgtcccactacggttgaagctttgatttgtgcccaaaattggcttaaatttgataagcaaaatgtcaatgatttgcaagttgaattagatgaaacaaaaaatagtgaatcagctcaaagatcaatcaagaacaattcaagagttcaagataagaatcaagaagaattcaagactcaagaagaaagtctagagacaagaatcaagattcaaggttcaagatctcaagaatcaagatcaagattcaaggctcaagattcaagaatgaagagaagactcaatcaagataagtattaa

SEQ ID NO: 26035 - DNA, 303 bp, Glycine max
  Peptide Sequence Number=SeqID_117720
atgaggcaccgaatccctatgataggtggtatgatgaatgtgttgagtggtgcaaccctcttttgtaaaatcactcatgcacccaacatcttcatgatttgggtacatagggactcattaggtaggaataatcaacatgaaaataaaggaaaaggtggccaaagatcaattaactatgaagataagagggatgaggaagaaaaactagaaaaacaaaagaaaaagaaggatagtaaggccttgtcttcaaaggccaaggggaaaggaaaaggagaaaaaagattcctccaagaagattgttaa

SEQ ID NO: 26036 - DNA, 564 bp, Glycine max
  Peptide Sequence Number=SeqID_117721
atgtccaaatcttgtggatttgggatgaccggccctctcgatgagtcgatctcttgctttctcatgagggtggacccttgggtactagttaccctcaccttcagaggactgcatgtcctcaccttcgtagggctacacgccctcacctttagaggactacacgtcctcgccaacagaggcctgcacgccctcaccttgagaggactacacgtcctcaccttgagaggactacacgtcctcaccatcagagggctgcacgtcctcacctccagaggactacacgtcctcgccttgggtactagttaccctcacattcagaggactacacgtcctcaccttcagagggctacgcgccctcgccatcagaggactgcatgtcctcaccttcgtagggctacacgccctcgccttgagaggactacacgtcctcaccatcagagggctgcacgccctcaccttgagaggagtacacgtcctcgccttgagaggactacacgtcctcaccatcagagggctgcacgccctcacctccagaggactacacgtcctcgccttgggtactag

SEQ ID NO: 26037 - DNA, 438 bp, Glycine max
  Peptide Sequence Number=SeqID_117722
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatccccgtgaagaaggagctcgagaaaacaaccgagaacgtttcttctaatcacgcgggtaatagtagtagttgtaacaacaacaacaagttgtcgaatcagaagttaattgacgtgttggagatggacgtgaagatacttggggtaccgagctcgaattcgtaa

SEQ ID NO: 26038 - DNA, 501 bp, Glycine max
  Peptide Sequence Number=SeqID_117723
atggaaacgtgtttgggagtagaggaattgttacaacggatgatagatcaaggtcgactagaagttggcggtgaaggaagagaagagcagcatatatgcatgcagtccacggatgggagcggcgttgcgaggcccaaacccttggtgatatacttcaccaagggcacagcttcacaaaagcccggacaccccttagcagctagacctgttcctttcccataccaaaatagccacgcagtaccatggagatatacaccttcgagggagaaggaagaagaagccaccgacgtcagctcgttgtcggctaaagtaacaaatatcacgggactgagtggtgtgacccgtagcggtcgtgtgttcgcgcctccggacctacaagtccagcccgcgaacgtcaagggaaaaggaaaagtgggggaggaacaagatggtgaagcaccccacgctacgaataaagatattccgacaagaggccttccggagaaaaaggatggtaaatag

SEQ ID NO: 26039 - DNA, 267 bp, Glycine max
  Peptide Sequence Number=SeqID_117724
atgcatagatctcctacagctactttaagaaggaatagagccaagaggagaaggaaattgttgcaagataggacagtagcttccattctagaagaagaagctcaatcttctgactctacttcatctgattcatcgtcatcaagggaatccgctacagatctaccagaagcctttgtcatggctgaagaacatcaacacagggttactcttgaagattattccagtagttcagtaccgcaattctttataagtattgcgaggccaaaa

SEQ ID NO: 26040 - DNA, 177 bp, Glycine max
  Peptide Sequence Number=SeqID_117725
atgagaaagcgcacgctcccgaagggagaaaggcggacaggggggcggagcctatggaaaaacgccagcaacgcggcctttttacggttcctggccttttgctggccttttgctcacatgttctttcctgcgttatcccctgattctgtggataaccgtattaccgcctttgagtga

SEQ ID NO: 26041 - DNA, 910 bp, Glycine max
  Peptide Sequence Number=SeqID_117726
cacttttagaggactgcatgtcctcaccttcagagggctacacgccctcgccatcagagggctacacgccctcacctttagaggaccacacgtcctcaccttcagagggctacacgccctcgccatcagaggactgcatgtcctcaccttcgtagggctacacgccctcacctttagaggactacacgtccttgccaacagagggctacacgccctcacctttagaggactacacgtcctcgccaacagagggctgcacgccctcaccttgagaggactacacgccctcacctccagaggactatacatcctcgccttgagagggttgcacgccctcacctttagagggctatgtgtcctcattttcaggaccagtagtttccttttaacggttcctgggccaccccctgatattggaggagggccaactgtgcgagcacaaccagagagggaggctatcacacagctactatgcataccggggcaagatttcacccgtgccgctgcaaagagacgacgaccgcaatgccaatctccccctgcaaaagtatcagttgggatcgcacccacaaagacacccagtggacctgaagaagtccaacagggccctggggtttccagctctggttacggcctctatcggccctacagggcgcctgtttcccccagcaagttcatgtcgtcgtggcatagggattgtgcccgcaagacacctagtggacccgaagaaggccaacagggtcttggagttaccagctctaaatacgggtctctgtcagttctagggagtgcctgtcgcccccagcaaggtcatcaggccccccctaccaatcgagctttcatcaagaagtactgcgcccccaggcaggcgcagggcgaaacaccacatcagcattgggatggccggtag

SEQ ID NO: 26042 - DNA, 812 bp, Glycine max
  Peptide Sequence Number=SeqID_117727
atggctccaaaaaagatttccacgaagaggtctcgaagagacgccgcggcggaagggttcagtgccacccccgagtttgatagtcaccatttccggagcgccgagcaccagcagcgcttcgaggccatcaaaggatggtcattccacagagagagccacgtccagctcagggaggatgagtatacatacgttcaggaggagatagctcacagacattggacgtcgctggtgactcccacggctaagtttgaccctgagattgtcctggagttctatgccaatgcttggcccacggaggagaaggccagcaatgtgagttcagccagaggaggaacagggccgatgggtttgacgaggaggccattgcctagttgttatgcacactggggcaggatttcacctggaccgctgcagggaggcgggcaccctctggacccggataagtctcacagggccatggggtttccatcattgatcacaggcctctgccagtcattcggggttcccgtcacccccagtaaggtgatccgaccaccgatcacccgggccttcatcgagaagtactgcacgcctaggcaggcgcagggtgaggcacatcaagccgcagacacaccgccaccacctcggcaggtcgatcctgttggatcactaggcatagagcagcagtttggggctgaggtcgcatggcccggagactggcccgaggcccaggcaggggaggatcccgcaggatcccccggtgaggcagatgagtcccatatggatgaggagatgactgacctgctcggtttcttgggaggaagcggagccat

SEQ ID NO: 26043 - DNA, 1000 bp, Glycine max
  Peptide Sequence Number=SeqID_117728
ggacacgctttacgacgcccttaccgaactcgtgctagagctagagtaatgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaaggtgaacccgacgtccccatctggcctcaagcaaatgaatcatccaacctcaaatatggtaggcaaagatttgggaagtacggatgaccccatgatgtgcaaattcaaaacaagcacgccttcccgccatatggtttgcctcccaaactatacaccacccaatgtggtgtacattcccaatgaggatgtcaataactccactcccatactcattaagagccaacaacctcaatctgatcatgcacatgtctctcgacccatggaggagacacatgaaattccccaccacgatctagccagacttcgagccttggctcggatatgctgcactgaagggcaagcagttggtggtataccctttgaaaacactttgcagggccctcagtttcgcccacaaccacaaccattgcattttgcggtgggaagagcccctcttgctatggccgaaaagggaaagttggatcatctaaaggaaaggctcagggccattgaaggagtgctggactttgacaagtacaaggggactacttgtctcaagaaccatctaaagatgtattgtcagaagatgggggaatacgcaaaagatgaggaattgctgatacattccatccaagaaagtcttactggggtagctgttacctgtatcaatacaattttgatatggttctggataggatacaactacagaacatttgcaaaaaagggggacggatcttccaaagaccatgcccaaaaggtggagggatctggcggcccaggtggtacccccaatgatggaaagggagacgatgatcgtgatg

SEQ ID NO: 26044 - DNA, 525 bp, Glycine max
  Peptide Sequence Number=SeqID_117729
atgggatcaagtcaaatgcttcacttaaaagagttctatcagatcaaggtcaagagcctagggaccaccagtctaaaggagttagggcagttaatggatcagcttcagcggcaagcttttcgcaaagcttacggtaaaatctgggacttagccatggtagaagtctccacaggggccattgcctccctcgcccagtattatgatcagccgatgaggaaaccatacctcttctcagggttctatccctctttagctagaatttctaagatagtccaaatctcggcacaggaattagaccatggaaagcaagttgaaaatggggtggttggaataccgagaaaatatttattcttggaggcaaaagcaagacatcttgacacacggaaggtgaaaggcgatagccccgatctagacgcttttctcgctatcataaccacaagggaagccctagttgtcgctatgctagccgacctatatgacaccttcgagaagagtgaaatacctcagacaatacaagaagattga

SEQ ID NO: 26045 - DNA, 207 bp, Glycine max
  Peptide Sequence Number=SeqID_117730
atggctcaggaggagggtacctccacagatcagatacctgagccatcctctgcacctgttcctgaggagacccagccatctacaccagtcacggagctagagcatcctatccaggattcatcagcagctccaggattggaatgccacttagccaaaaagctgaccatgtgcttgaatgaattatcccttgtacccaggttgagttga

SEQ ID NO: 26046 - DNA, 399 bp, Glycine max
  Peptide Sequence Number=SeqID_117731
atgccgggagcagacaagcccgtcaggcgcgtcagcgggtgttggcgggtgtcggggctggctaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccccatagagcctgacataaggacttgtcaattgtttctttcttag

SEQ ID NO: 26047 - DNA, 1065 bp, Glycine max
  Peptide Sequence Number=SeqID_117732
atgggcaaaatttgcaaaaagtcgccgaacccctacttggcagaaaaaaaactattggaggaaaaaaggaagacacgagaacaacaagcagaatttactgaaaattcttcattgagtctcgacccaccatcattggtttcaagacatgtgaagtggaagatggcccgcacaaggcgatataggcagatgacctctacagcgacacaagaaatatcagacaaaattggactagtgtcacaattagccagtactttggacagacatctcgtggctcaaatagttcttgtagaggaagaaaataaaaacttacaggaagcatggaggaggacggtagaagaggaacaattgagaaaagaagtagaggaagaaaataaaaacttacaagaaacgtggaggatgacggtagaagaggaaaacaaacgcagtttggaattaattaaacaacagttgaagcaagcaataaaattagagttatcccaaattgcatcacagcactcaccgccacttgagccacctgatatacaagtggtagttgcaggtgtgagcaccaaggggagctgtgctgaagcttacacaattccattagctaaaaagccttctgatctgcacatcgacattatgggcttgtacgtagttcatgaccagtgtactaaactagttgcattaggaaaagtgtatgacagtgcgtttaccatacacaatatcccttatgcagatgatgtggttagggtgagtgttgtcaaagtttaccacggtgacgcttatgggtccccattgcagttactttttgtgcatttatatctcaaggaaatttcaatgggggtttatcggaaagcacaccagatcgtcaagtatttaaaattaaaacggatgaatccgagtatcgaacacagagaactaatgttagccaaaattaagttcagaattgaagcattgttgatagaacatcctaaattactaaaccctcgatccctcgtcaggctgaatatccaagcttcgtccacagatccctcatgtaagactacacccgatttagatagccctcttaggtttagactaacttaa

SEQ ID NO: 26048 - DNA, 1399 bp, Glycine max
  Peptide Sequence Number=SeqID_117733
atgggtcaaggaatcacaacgacaagtgtacctaggagcttatctgaatcagacaatattgttgtctggctatgttctctgcgtaagaagcctaatgttaacatcaagggtgcaattaacagtgcaatgaagacattaaccagtagtttggaaggaaagggagatcaagctggacctcagtggattgaaccaaaggtcgacggatcttttatcattctatttcttaaagagaatactaaatttcaaaagaaattacagaacaatgagcagatgtcaggtctgaagcatctaatagatagagcaaagcaacatcacaatgtgaagtattgtcttacatccttaaagacaatattggagaacaatgagcagatgtcaggtctgaagcatctagtagatggagcaaagcagcatcacaatgtgaagtatgctggttattggggtggagtgaagccagcaacaatcagcatggaacattatgacattgccttggcagagccagtgcaatcaccaggagtgctaggaaaccaaccagacattgtcatggatagcttggctatacatggccttggcctactgcacccaaaaaaggttttcaatttctactacgagctccatgcttacttagcttcgtgtgggacatgtgccaagcggactgctattgtgagagcttttgatgatttttaccctcgtgatcctacttcccacaccatccatatttcttcggttgcatacaactcattattccttggagaattcatgcaacctgactgggacattttacacccagcagaagattatgatgttgtagctcgtgcaattggtggatgtcctatttatgttagtgacaagccaggcaatgacaattttgatcttctagtaagtaatgttgagataagacttaagtggtttgcagatggaaactggaggtttcagaattctagtgctgaccagttagtattgtattttcgattaggtgacggtcattcagattttgatgcttatgctccaaaggatttgcttattgtgacaacgggatctcaagcagagccacgtgctgccttaaatcttgcatattctagaagtagtcattctttcaagttgacaaaggaagatattgttttgtattcaggtaaggttatccctggtaacgagtctcgtgttatggaactgctaaaccgcatatcagagattggatcaactatagttatggggaagaatgaatgtctgcacacgtctggtcataggtatcgtggagagttagaaaatcctgcagctgttcttgctaatgagataaacacaaagttgtctcgaaaattaaatgtggatgggatgttgacattgagaaaagtggtggatggacatgagaaagaaaatcagagaaccaaaatgcaaataagag

SEQ ID NO: 26049 - DNA, 390 bp, Glycine max
  Peptide Sequence Number=SeqID_117734
atgaatttgttgcctagcgttgttcatgtgtcctccaccatcgagtctggagccccgcgaattcattgcctagcgatgttcgccaattctccattctccacttttattcggagacccatgaattcattgcctagcgctgttcatgtgtcctccaccatcgagtctgaagccccgcgaattgattgcctagcgttgtttgccaattctccattctccaatcttgttcggagacccatgaattcattgcctagcgctgttcatgtgtcctccgttatcaagcgtggagcctctgaaaaaaaaagaaggagtagagacgagagtcgtcatcacgaaaagggcaggacggacgaaatcagtgtcttatctttgctttcctcttatctccgatga

SEQ ID NO: 26050 - DNA, 385 bp, Glycine max
  Peptide Sequence Number=SeqID_117735
aacattctataaaaaggttgaatatgtgcttgaagattgtattgaggttctcgtcaaaatcaacaaatttttcatcaacaaggaaggcttagtatgtgtggaaacgttgtgtatgcctgttactaaaccagaaagatttgagtttgatgcttttgagttagatgaacctgaagatgctggcaggatgccaccatactttacttattgcacactgtgtacagaggcagagagatctcccattacttactgtgcactatgttgccttgaaattgtggaaactccaaggatgttagatgtacctgaatctcaggattttgacattccaatttttattgagataaaatccttttggaatctcccgaaacaaatgaagtgcctcatttga

SEQ ID NO: 26051 - DNA, 390 bp, Glycine max
  Peptide Sequence Number=SeqID_117736
atgtccttgccatcagaggactacacgtcctcgccttcagagggccgcacgccctcgccttcagaggactacacgtcttcaacttcagaggactacacgtcctcgtcgtcaaagggtcatgactacacgtcctcgccatcagaggactacatgtcccccattttcaaagggcgacacgccctcacctttagaggactgcacgtcctcgccatcatagagctacactccctcgccttcaaaaggcggcacgtcctgaacttcagagggctgcacgcccttgcctttagaaggctacgcgtcctcatattcagtgtgctccatatccacaccttagagaatataaggtccgttgcccttagatgcttaaccgagacttgcgctcccggttaa

SEQ ID NO: 26052 - DNA, 747 bp, Glycine max
  Peptide Sequence Number=SeqID_117737
atgagtcatcattcatctagtgttaatggcgagggtactagtcataaagaccctttatctagaatcttagatgagttgagttccctcaagttatggaaagaaaaacaagagagaaaagaaaaaggaaaaaaaagagtggaagaagtaagtcaagatgaaagaaagaaagtaagagaggaagaaagaagaaaaataatgaaagaaatgaaagagaaaaacatgcctcctatagtagtcataactctgcaaagcctaagtgaagaacttcacgactattacgaaggaaggcataggtcacatcttagacctcactcccataggagagaaaaggaaagaaatcctcaagaggctaacattaacctcccatacttccatgggaaggacaatgcagaggctaacttcgattgggaaataagggtagagcaacaacttaaaaagaagtctacttcaaaatcttatggctctcactcttatccaaagaaagaccaaggtcaaggcatcttaggggtgacaccttctaagcccaaagatgataaggggaagagaatagaaaagacacattacttctcaatgccccatcacaaaaaccatgattctgaggggcaagaaatttatagtagccaagatgaggctactacttcaccttcctctagtgaaagtgaagaagcaaaaggggaaaaatctagtgaagaaatctacgcccaagaaaaaggacaaccatcagtggttaaacagaagtgtaaggag

SEQ ID NO: 26053 - DNA, 237 bp, Glycine max
  Peptide Sequence Number=SeqID_117738
atgacgctcgaaattgaacaacggaagctctcaagaaattcaaatggtcataacatttcacttggaagtccgattccggcgcataatatatcgagacgctcaaaattgaacagcggaagctctcaggaaattcaaatggtcattactttacactcggatttccgagtaaggggcatgacatatcgagacgctcaaaattcaacaacggaagttctcgcaaaattcaaatggtcataa

SEQ ID NO: 26054 - DNA, 168 bp, Glycine max
  Peptide Sequence Number=SeqID_117739
atggttttcggggcttccataaaattttcgaaaaccttggaaaatccaagccgaggtgcttccgtaacgcttccgagatgtttccgtaagcaaatccgtgaaggttttccgtcgttcttcaccgttcttcatccgttcttcatttgttcttcgttcttcaacgggtaa

SEQ ID NO: 26055 - DNA, 426 bp, Glycine max
  Peptide Sequence Number=SeqID_117740
ggtggacctttaggtactagtaccctcgcctttagaggactacatgtcctcgccttcagaggaatacacgccctcgcctttagagggctacacgccctcgccttcagaggactacacgtcctccccttcagagggctacacgtcctcaccttcagagggctacatgccctaacctttagaggactacacgtcctcgtcttcagagggctacacgccatcgccttcagagggccacacgccctcgcgttcagagggctacacgtcctcgccttcagagggctacattccggggttctcacgaaccataagagaataaaggttattcctgagtggccaactccaccaacaccactcattgagttggtgaggaaccatgttcaagggagagggaacgatgcaatcctatcccccaagggcattggatag

SEQ ID NO: 26056 - DNA, 567 bp, Glycine max
  Peptide Sequence Number=SeqID_117741
atgacgacgacgaagaacaagtacgaagagagatatgcaatgccaccaattataaaactaaatcaatcggaggtatgtgcatcttactacaaatgtgggcatgggaacgatgtccaaccttggctccaaagaggactctcccaagtagaaaatacaccactggggcataggtggcagcgacgtggaaaccaacatatcggcaatgatgattttgtgtgggagccgtacccatcaaccgttatatcattgttgcctcccgtttgtttagtcggaagtctcgcatggtacgcggtggtgccactaatttgtttccaagttattgagtggcaccaaccggacagagtattgagacaatttgggatgcagcaaccaattccagagtctccttcacaacccttaaacattcatggcataacattaaaagggaaacatgacgaaaattgggggcaattgttcgccccaatgattgatcagtggaataatcgccatgcatttagggtcgacgcttatccccgacaagaaggcctattgagctttaactcggactacatggcctggtataggtga

SEQ ID NO: 26057 - DNA, 309 bp, Glycine max
  Peptide Sequence Number=SeqID_117742
atgattttcattgaagccatagatttaaacatttgggaagcaatagaaataggaccttacatacatactgtagtagatgtaagcactagcaccacaacacaaaaacctagagataagtggactaaagaagatagaagaaaaatccagtatgatcttaaagccaaaaacattattacttcagccctaggaatagatgagtattttagagtgtcaaattgcacaaatgccaaggagatgtgggatactctccaacttacacatgaaggcaccactaatgtgaaagatctagagtcacacccttacacatga

SEQ ID NO: 26058 - DNA, 633 bp, Glycine max
  Peptide Sequence Number=SeqID_117743
atggccacaatgatggaggccatgatgagcgtgaagaagataatggaagccaatgcggttgcaattgccgctaccagcgttgttgctaaggtgaacctgatgtccccatccggcatcaaccaaatgaatcatccaacctcagatatggtaggcaaagatttgggaagtacgggcagcccccataatgtacaaattcaaaacgagcacgccttcccgccatatggcttgcctctcaactatacgccacccaaagtggcgtacactcccaataagaatgtcaataactccactcctatacccattgagagccaacaaccccaaactgatcatgcacataagggcaagcagttggtggtatacccctacaaaaccctttggaaggccctcagtatcacccacaactacactctgcattccacgacaagtaaaaaccctcatgctatggcagaaatgggaaagttggatcatctagaggaaaggctcagggccattgaaggagaacccaatatcatcacccctcccaagttcaaggtgctggaccttgacaagtacaaggggactacttgtcccaagaaccatctaaagatgtattgtcggaagataagggcatacgcaaagatgaggaactgctaa

SEQ ID NO: 26059 - DNA, 340 bp, Glycine max
  Peptide Sequence Number=SeqID_117744
atggcgaggacccgccacggcggcggccatgctgctgggagcgttgttggccggatgcatgtccgcgcccgggccgggccagggttcgcccaagggcgaaggcatgtcggccgaccaactggtccagaccgacttcaaccgcaccgtcaccctggaggtgcgcgacaacctggccagcctctacagcctgctggacaagctctaccgacgcaacccgcgcgaatggcgcaagaccggcgcgcccgaccacgcgaccgcggtgtcgcgggtcaagcatgcgatcgaggtgcggatcccgccggccgacctggccggcctgcacgacatccagatcctggcg

SEQ ID NO: 26060 - DNA, 711 bp, Glycine max
  Peptide Sequence Number=SeqID_117745
atggctgcgtggcgaaccaacgctgcttcgccatttacgcctttcgctgatgtagtggaagagtaccagcaataccgcgaaagcgaagcctggcagcgtgatgcggcattctgggcagaacagcgtcgtcaactgccgccgcccgcgtcactttctccggcacctttaccggggcgcagcgcctcggcagatattctgcgcctgaaactggaatttaccgacggggaattccgccagctggctacgcaactttcaggtgtgcagcgtaccgatttagcccttgcgctggcagccttgtggctggggcgattgtgcaatcgtatggactacgccgccggatttatctttatgcgtcgactgggctcggcggcgctgacggctaccggacccgtgctcaacgttttgccgttgggtattcacattgcggcgcaagaaacgctgccggaactggcaacccgactggcagcacaactgaaaaaaatgcgtcgtcatcaacgttacgatgccgaacaaattgtccgtgacagcgggcgagcggcaggtgatgaaccgctgtttggtccggtactcaatatcaaggtatttgattaccaactggatattcctgatgttcaggcgcaaacccataccctggcaaccggtccggttaatgaccttgaactggccctgttcccggatgtacacggtgatttgagtattgagatcctctag

SEQ ID NO: 26061 - DNA, 387 bp, Glycine max
  Peptide Sequence Number=SeqID_117746
atgtggtcatctgcgccctttccggagatgtcagcatcttccggtggagactttttcaagtctcacaagttatctagaactacgagcaagagcattgcttttgtcggccgccccacaagatctgtcatattgaccatgaggtcatgtgacatgcggagacaaaatttggtcattctgcatccctttgccattcagacacagtcgtgtccgatggcgcgcagagacaaaatttggtcattctgcacccttgtgtcatccagaggcggcgggcccgatgacacgcggagataccttacggttatccgcacccttttgtcatccagaggcggcgggcccgatgacacgcagagacaaaatttggtcattctgcacccttgtgtcatctag

SEQ ID NO: 26062 - DNA, 693 bp, Glycine max
  Peptide Sequence Number=SeqID_117747
atggctacacagtcaaactctcctccgcctcctcctccttctactggtgtagcatcgcattcgtcgtcaccaccattgaagcggactagaaaggcctcacgcctaagattattggcgactagaccagttggggcagagagaccccttgtccatgtggatcctgttactggcaaagcagacggtccccacagcaagaaatttagaacatatttagggatcgttgctcgtgataaggtggatgtcacatacgaaaattgggaagcatgtccctattactcagaaggatttgatatgggaggatattcagcatctgatttaaggacaaaaaagaaaatacttcagactgtgggggagcggtggagacagtttaagtctgatttgacgtcgaaatgggcacttgcagctgacaaggatagtgtcgatgacactaatgtgcgaaaaaaagcacaagccgtccaaaaacaaaacactgcccctcatgtgatgtctcgtgggggttatgaatatttagaaaaaaagttgatggatgagaagagaaataaaaaattagaggaagctactcaatccggaagcactgacaccgtcattgatcctccatctcccatcaaacgacacatgaagtggaagctagcctgcaccaagaaaactggtgacatgacatctgaagcagcaaaggaaattgctgacaagatt

SEQ ID NO: 26063 - DNA, 345 bp, Glycine max
  Peptide Sequence Number=SeqID_117748
atgaacccgggtatagggcccaggcgagcagggttgcttcctccagaagcaacagccttctggaggaatcttctggagggcccaagtgggcctgaaccttgtggattacataatcatcccctttttgacttacggaacgttacggaacctcacttatttgtgcaacgatgcttccatttgatttccggtgtgtcacggaaccttacggattgtgcatcaatattttcttttgtttttcggcatgtcccggaattccacaaattgcctaatgatgggtgccaagcacctcacaaggaccaaagaaaggtcacatgtcatcaagcaaaggtccccggacgaaattag

SEQ ID NO: 26064 - DNA, 402 bp, Glycine max
  Peptide Sequence Number=SeqID_117749
atggtgtcaccacaagggaggaacacatggacagttgaatatctcatgccttatgtggagaagataacgattttatccgaagagcaagagagaatcactgagcttgtggcacatggtccaacatcagagcgtcgatttccaccacaagattttcacatgcttctgtcaagtgttgaaactcggggttttgacagacgaagagaggctgttgaggcgcaagaattttcccaacaaattgagaagcgtggccatggaatgtattacacgccaccaacattttctcagtatccttcacagatgtatcagtatccgttcgaaggtcatcacactgatatgtctacaagcaaacattcgtcggtggtgttgcggaaacacatcctcatttttcatggccgactatga

SEQ ID NO: 26065 - DNA, 213 bp, Glycine max
  Peptide Sequence Number=SeqID_117750
atgaattccaaggaaaggtcctcccgcggtcgtgatggtatcggcaaaggactgagtaaacctgctggcttgtgggacaattcatgcttcaactcctgtaaaaaggtgacggttggcataaacaagactaacaattttctagcgtcggcaagggattctggaatatgggatagtgtatccgcgaccacatttgattgcccagaaagatactaa

SEQ ID NO: 26066 - DNA, 213 bp, Glycine max
  Peptide Sequence Number=SeqID_117751
gaacaggggcttgaccaggaatcatctgtatgggttggatatggaattcaggttgttcctggattgatggcgctttggtggatgatggggatgatggtacagagggtgaaccaggagctgaagtttcttttggtgagtccagcagcctttgtgaaaggccatgatctgcatcagatttcagttcctttccaaggcaagtctgatccagtgtga

SEQ ID NO: 26067 - DNA, 345 bp, Glycine max
  Peptide Sequence Number=SeqID_117752
atgaccggccctctcgatgagtcgatctcttgctttctcataaaggtggacccttgggtactagtacctatcacctttagaggactgtatgtcctcgccatcagaggactgcacatcctcgcctgcagagggctgcacgccctcgcctttagaaggctacgcgtcctcgttttcagtgtgcttcatatccacaccttaagagaatataagggatcgcgcccacaagacgcccagtggacccgaagaattccaacagggccacggggtttccagctcttgtggcgggcctctgtcagtcctacagggtgcccgttcccccagcgaggtcatgccatcgtgacatag

SEQ ID NO: 26068 - DNA, 471 bp, Glycine max
  Peptide Sequence Number=SeqID_117753
gtcctcaccttccgaggactacatgtccacaccttaagaggactacacgtcctcgccttcagaggacaacacgccctcgccttcagaggactacacatcctcccctttagagggctgcatgccctcgtcttcagaagactgcacgccctcgcctttacagggcttcacgtgctcatctttagaggactacacatcctcgccttcagagggctgcacaccctcgctttaaaagggctacacgccctcgccatgagaggattacacgtccttgcctttagagaactacacgtcctcaccttcagaggactaaacgtccttgccttcagaggattacacgtcctcgccttcaaagggttgcacaacctcgccttcaaacggctacatgccctcgccatgagaggattacaggtcgttgccttcagaggactacacgtcctcactttcagaggattacacctcctcgccttttga

SEQ ID NO: 26069 - DNA, 956 bp, Glycine max
  Peptide Sequence Number=SeqID_117754
tcgattgggaccaacatttggtggagatagggggcagcgcaatcaattggtttcctcgttggaaggaaggcaaggaagaagttcttttctcgtgtggggactaccctaatgttccattgatagggactagggggtgtattaattataatcccgcgctcgccataagacagctagggtaccccatgaggggagtgccaacggaagggagtctctcacctttccttgtgaaagatttaggcgcgcaaggtctcaaggttatacaaagaatccacaaggcgtggaggagtccgttgaggaaagacaaggagcttaggggcatccgtaatggcgtcatcggaggttatcatggatggctaagaattcacacgcgagggttagattggctctccaagttgaaagttatcgatgaggagaacttcgaagctccggaggaagatgaagaagtccgagctctaaaattggagctagagaaggaaaagactcgccaaggagaagaaaacgcggccactgcaagagcccttgaacaagaaaccaaaagggcccgcaaggaggaatatggccgagagaaattccgaggagcattgtggggtagcaacaatgagctcaagctccgaagagaggaaagagatcggtcacgggtgcatggcatgatcttgaaagaagagttagttgcttgcgcgaggtccaaaaggagtttggctcaacacttggaagccacggagcaaagcatgctagctatcatagggcaatacaaggaagagttaaaccagtctgtggcccataaacaaaagctagtggaggattttgcacaagtgtacgccgaaaaagaagcaagagggagggtgattgatgcattgcatcaagaagcgactatgtggatggataggttcgccttgaccttgaatggaagtcaagacctcccgcgtctattagccaaagcaaaagccatggccaaa

SEQ ID NO: 26070 - DNA, 528 bp, Glycine max
  Peptide Sequence Number=SeqID_117755
atgggaagcaaatcaaaccggcaagaggttctaccgaagtcaaggtcaaagctctcagtaccacagcatcaaggaattagggcggttgaaaccccttccaaatgcaagccttccgcaagcacacttacggaaagcttagagttgaccatagagggatgtcctctcgggggaagaaaaccatatctttcctccgggtgtctctcctctttgagcagaattgcaactgtggtcaaggattcagcaagaggtttggaccgcataaaacagactcggaacggcatagcgggcctaccacggaagtacctagaagacaaggcaaggggtatggccaatcaaggagactgggtcccgtttatggatgtgttagctttgctaattttcggggttgtcctctttccaaatgtggatggtttggtagacctagcagcaatcgacgctttccttgcctaccaccatagcaaggaaagtccagtggtagctgtcttggcagatctgtttgacacatttgaccgaggtgcgaaagagtag

SEQ ID NO: 26071 - DNA, 135 bp, Glycine max
  Peptide Sequence Number=SeqID_117756
atgactggagcacgtcaaaaagggggtacgaaaagggaggagcttgccacccagctcgcccaggcgagcaaggttgcttcctccagaagcaacagccttctgcaggaagaatctggaaggcccaagtgggtctga

SEQ ID NO: 26072 - DNA, 273 bp, Glycine max
  Peptide Sequence Number=SeqID_117757
atgtttacttctgatgaatggaccttgaacaagctatctaaggagcttaagggaaaagaagctgcaaaggtagtgctcatgccttttttttggaatagtgtggtttacactcttaaagtcatggctccacttgtgaaagtgcttcatcttgtggatggtgaaaggaaactagccatgggctatatttatgaagtcaccaatgatttgtttgagtgcattaagaagtttgatttagaggtcagcaacttgggacagactagaatgctgacctag

SEQ ID NO: 26073 - DNA, 198 bp, Glycine max
  Peptide Sequence Number=SeqID_117758
atgggtaggaggaagttggagttgggtttagaagatcagaaaattgactttgatttatttgttgaagacaagcctgcttcagaacaaaatgtttgcttacaggtaatggaaggaggtcaagaggttatgacaccacgagtctcaagcgctcagcgcctaatgttcgattctggcaagtgcactggatcgcacaagtag

SEQ ID NO: 26074 - DNA, 267 bp, Glycine max
  Peptide Sequence Number=SeqID_117759
atgttacgaaaccttacggattacgtaatcatcccttttttgccttccggaacattacagaactttacggattgcgcattaacacttccttttaatttccggcatgtcacggaacttcacggattgtgctacgacgcttttcttttggcttccggcatgtctcggaacttcacaaattgcctaacgatgggtgccaaatacctcgaagtggtcgaacccgggtcgtatcccaaaaacggatggtccccagacgaaattagggtatga

SEQ ID NO: 26075 - DNA, 294 bp, Glycine max
  Peptide Sequence Number=SeqID_117760
atggtagtaggtgggaagcttctggctctagcttactctgctacaactactgtgacttccactgccgctacttgctttgctactttaggtagtgcagctgctctactacctttgctgctagaggatttggaactaggccttatgctgctggtggaggtagtggtggggaagctggttctagatctacttttgctgaatcgacagaatctactgctcggtcgactgactcaaccatgtctttcttcattgactgctttcatcaacagaatcgccggaatcaaccggctctactga

SEQ ID NO: 26076 - DNA, 402 bp, Glycine max
  Peptide Sequence Number=SeqID_117761
atgaaggccaacatggaggccattaaagagaaaatggccacaatgatggaggccatgatgagcgtgaagaagataatggaagccaatgcggttgcaattgccgctaccagcgttgttgctaaggtgaacccgacgtccccatccggcctcaagcaaatgaatcatccaacctcaaatatgactcatgaaattccccatcacaatctagccgacttcgagccttggctcggatataccactgaagggcaagcagttggtggtatacccctacaaaaccctttggagggccctcagtatcacccacaactgcacctcttgcattccacagcggttaaaaaccctcatgactatggcaggaatgggaaagttggatcatctagaggaaaggctcagggccattga

SEQ ID NO: 26077 - DNA, 651 bp, Glycine max
  Peptide Sequence Number=SeqID_117762
atggaaccaattgcctccctcgcccagtattatgatcagccgttgaggtgcttcatctttggggacttccagctatcaccaatggtggaagaatttgaggagatcctaggatgtcctctagggggaaggaaaccatacctcttctcagggttctacccctcattggccagaatttctaaaaaagtccaaatctcggcgcaggaattagaccgccaaaggcaagtcgaaaatgcggtgctcggaataccgagaaaatatttggagggagtcctctttccaaatgtggatgggttggtggacctagcagcgatcgacgtttttctcgcctatcataaccacaaggaaagtccggttgtcgctatgctagccgacctatatggcaccttcgaccgaagatgtgaagaaagcaatgcaaggattgtttgctgtactccagctctctatgtggggctggtttcacacctttttctccaagaaggtaggcccgtctatccgctacaaggttaccgctcgtgcgtcgaaaaaggaaaggcgaattgggaccaactcttggctagcatggaggggcgtccgttaatttgttccctcgctagaaggaaggaagaatcaggattctatcttcatgcgaaggatgtccaaatgttcccttga

SEQ ID NO: 26078 - DNA, 528 bp, Glycine max
  Peptide Sequence Number=SeqID_117763
atggcgccgaccaggcaccctttggacccggataagtccaatagggccctgggatttcccgcattgatcacaggactttgtcagtcattcggagtcctcgtcgcacctagcaaggtgattcgcccacccatcacccgggcttttattgagaagtattgcacgcagaggccggcccagggtgatgcaccacaggccgcagacgcgccgccacctcatcaggctggcccagctgagtcatttgattcggagcagtatttacggcatttggttcgccagcaggcggccaaccaccgggtgcacgtacagacccatgactgtctttaccagccgagccttagcctgcagagccagggttttacttcttttccatgccctactccggatcagttcagggcagaggtcgcatggcccggagattggcctgaggcccaagcaggggaggcacccgtagaggctcccgatgaggcccgcgaggacgaggagatgaccgatttgcttgatttcttgggagggagcggagccacatga

SEQ ID NO: 26079 - DNA, 216 bp, Glycine max
  Peptide Sequence Number=SeqID_117764
atggcaggagctggtgacaatggtgaacgactagagcaccaaatgaatccaaatgctgggagaccttatggtggcaacaaaagtgatgcaagctccattggagcttgtaggcctaggatcttcttcatcaatggattcctttgcttcttggaagataaatggcagcggaatggagaaggaagagagagaggagacgccacttcaaggagaagatga

SEQ ID NO: 26080 - DNA, 453 bp, Glycine max
  Peptide Sequence Number=SeqID_117765
atggaaggagaaggaggaagcgcaaccagaaagagagggaaagatggtgagactgagacgacgacacgttacaaaggaatcagaatgagaaagtggggcaagtgggtcgctgagattcgagaacccaacaagcgttccaggatttggctcggttcttactccacgcccgtcgcggcggcgcgtgcttatgacaccgccgttttctatctccgggggccctccgcgcgcctcaacttcccggagcttctcgccgcggagggccccgccgcctccgacgccgtcatgtccgcggcctccatccggaagaaggccaccgaggttggcgcccgagtcgacgcacttcaccgccaggacccccacgcgccgcctgccggagaattcgccgaccgagtcgaccttaataagatacccgaacccgagaattccgattgtgactactggggcggggattag

SEQ ID NO: 26081 - DNA, 189 bp, Glycine max
  Peptide Sequence Number=SeqID_117766
atgaagtcgcaccaagaagaaatgaaaatcgtaaacttgggtgttagcaaggaaaggaaaaagctaagaaggatgaagcatgagatgtccttgaagatcaaagaagaggtgaaaaagaagtttgatgctggcttttttggcagtggctcgataccccgaatggatggccaatattgtgctggcccctaa

SEQ ID NO: 26082 - DNA, 618 bp, Glycine max
  Peptide Sequence Number=SeqID_117767
atggaaaaacggctttgccgcggccctctcacttccctgttaagtatcttccgggcatcttccaggaaatttccgccccgttggaaagccatttccgctcggcgcagtcgaacgaccgagagtagcgagtcagtgagcgaggaagcggaatatatcctgtatcacatattttcagacgcaccggtgcagccttttttctcttgccacatgaagcacttcactgacaccctcatcagtgccaacataaattcctgcagcccgggggatccactagttctagagaggccgccaccgcggtggagctccaattcgccctatagtgagtcgtattacaattcactggccgtcgttttacaacgtcatgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 26083 - DNA, 654 bp, Glycine max
  Peptide Sequence Number=SeqID_117768
gaagaagacccaaatgttaaaaccaacccgctagctagtcatggaggggctagcgtgaacgccgtcaaagaggatgggccatcgcgggcaaagagattaggagacgtagctacttctagatgcttcatctatcaatcactgcaagcggcgtgcatggtctcccatggcggaggcgaaagggacgaatgtttatttcaccttggggagtcgcacgacatggaaacctgtcccgcggtagaagaattgcttcagcaactcatggattgcgggaagcttgaagtgtccataggagggagggaagaatcacaaatttgcatgcagtcggaagagaagaaggttcctctaacccccaaggccttagtgatatgttttactaggaaatggaccggctccacacccatatacccccggacggtgcccgagcccatgccatttgcatatcaaagtaataaggccgttccgtggaagtatacccctcccgcgtccagcgaaaagagttgcaacccgaagttgactcccctatcagctaaggtaaccaacatcaccggccctcagtggcgtaaccccgcagtggtcgggtgttcgcttcccctcacccgacggattttccctctaaagggaaggcgcccatggtccaagagcccgcagacatag

SEQ ID NO: 26084 - DNA, 414 bp, Glycine max
  Peptide Sequence Number=SeqID_117769
atgatgcaatcctaccccgcaagggcattggctagaagactccaagtagattgggctagagatccaaggaaaggccctagggttctcatgagccttagggtatgtgtagctaaggctagtatgcaagatgataaggggaaggcaatagaaaagcaagcccctaaggctagtatgcaagagaaaactagctctataaagtgctttaaatgtcttggaagaggacacattacttctcaatgccccaccacaaaaaccatgattatgaggggccaagacatttatagtagccaagatgaggctactacttcaccttcctctagtgaaagtgaagaagcaaaaggggaagaatctagtgaagaaatctacccccaagaagatggacaaccattagtggttaaagagaagtgtaaggag

SEQ ID NO: 26085 - DNA, 504 bp, Glycine max
  Peptide Sequence Number=SeqID_117770
atgtggaaaagacaacattattatatttacacagctaaaaaaatgcacacacaaagtttcacaattccacactttcctaaaataggcctaactcacaaaaacagtccccagtggagtcgccaactctcgcaacctaccctttttcaggcgagcgaggcgaggctcacgggtgagtcttccaaaggaggaaaatgcgcagagtcgccaccaacgtttatttgtggaaaacgtcggaaaaaccgaaggaaaccggtcatgaagaatattccaaattcgggagttgtatttacatttgaggaaggtattagcatctctcacgtcgacaaaagcggggctcttgctcctacgtaccctccctcgaagaagaaatcagacctacgtagttctttcttaaagagcgaatcgagcgattctttttacttggaaggaggtccttttaaggtgttggaccttaaaatgacccatttttacttggtgagaaaaactgaggtatttgaatcttaa

SEQ ID NO: 26086 - DNA, 666 bp, Glycine max
  Peptide Sequence Number=SeqID_117771
atgtcagttctagaattgtacatagaaaaggatgtggctggtggttcaatgtttcagtctacaaattcgcttacatcatgtggaaattatttatctaatgatgagacacaaccgccaacaaatatgagcaatttacatcttgacgaagatgatgatcataatgatgatgattatcttgtttctaactcatacgttgaagagtctttagacgaagatgacagtgttgacgatatatctgatacagacaatgaagtccccgacatgattccactagtaagaattgttcacccaacagaaggtgtacaaggaattcagaattcattttggaatgatgctttgcattataataatatcaactcgagtcatcctgatgagaaggacatttgtggtttcgagatgccatccagttttaatgttggccaagaattatatgttggcatggaatttgatagtaaagatgcggtcaagaatgcagtcaagcaatatgttatgaaggtgcatcaaagtttcaaagtggttgaaagcaaatgggacaagtatgtggtttgttgcttgaataaaaatgcagattgtccttgccctttctatatgagggcaattctatctaaaaaaactgattcatggaaagtcactcaatgggtggagcacacacatgtctcaatatga

SEQ ID NO: 26087 - DNA, 504 bp, Glycine max
  Peptide Sequence Number=SeqID_117772
atggcgcctactagacaccctctgaacccagagaagtccaacagggccctggggttttcggctctgatcacgggcctctgccagtcctacggagttcctgtcacccccagcaagataatccgaccgccgatcacccgagccttcatcgagaagtactgcacgcctaggcaggcgcagggtgacgcacatcaggccgcgggggctccgccaccacctcggcaggccgatccgactgggccactgggtgcggccaaccaccatgggcaggtacagatacatgagtgtctctaccggttcagcctcagtcagcaggggcaggtttctgccccttttgtatgccctaccccagagcagtttggggctgaggtcgcatggcctggagactggcccgatgcccaggtaggggaggagcgtacaggatccctcgatgaggcggatgagtcccatatggatgaagatatgatggacctgctcggtttcttgggagggagcggagccacatga

SEQ ID NO: 26088 - DNA, 303 bp, Glycine max
  Peptide Sequence Number=SeqID_117773
atgatgaatgttttgagtggtgcaaccctcttttgtaaaatcactcatacaccttacatcttcatgatgtgtttacatagggacccattaggtagtgatcaaggggttcccacagaccctaagagaataaaggtcattcctgaatggcctactccaccaagtataagggaaatatggggctgccatgacttaacaaacttttacaaaaggagcccagagtatgtagaacctcgggatttgaggtcaaatcctttccaaggtggaggggatgatgcaatcctaccccccaagggtattggataa

SEQ ID NO: 26089 - DNA, 756 bp, Glycine max
  Peptide Sequence Number=SeqID_117774
atgggtcaacttcaacggcaagccttccgcaaagcctatggtaaggtttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaaggccttggcaaatcaaggcgactgggcttcttttattgacatcttggcgctcttgatctttggagttgtcctctttccgaatatggaagggttagtggacctagcagcgattgacgctttcctcgcctttcatcatggcaaggaaagcccggtcgatgccattttggccatgtatgacacattcgaccggggaggtgaaaagagtggcgcaagaattgtttgttgtacactggctctctatgtgtggctggtttcacacctttttctccaagaaggaagggagaatcgggattctatcttcatacgaaggatgtccaaaggttcccttgatggaacaaggggttgtattaattataatcccgtcctcgccataagacagcttggctacctcatgagaggagtgccatcagacgaaagcatcacgcctttcatcgcacggggtttcagtgaccacaacgcgagggtactccaaggagttcgcaaggcatgggatgcggcgtga

SEQ ID NO: 26090 - DNA, 285 bp, Glycine max
  Peptide Sequence Number=SeqID_117775
atgaaaaccttcgaatactcggaaacattcgggagatttacgtttgacggaagcacctcttatttgtcttcaaggaaacaacctatttttcctagaaattcgaaagagagagaagtgcctaagaaaatgggggcacttgcccagcgagctaggtgcttcctccaaaaggaacagcaccttctcttaagtggaggcaagttatttcttcttgagggccaagggccggttgctattttaaggtgttggaccttaaaaattatccatttacttgataaggaaaactga

SEQ ID NO: 26091 - DNA, 304 bp, Glycine max
  Peptide Sequence Number=SeqID_117776
atggcgcgcgaagcgcatgcgaaacgggcacggagaaaaatcagtgtggaggataagcagccgagctcattcccttcgcttcctgggcccaaagcaagctcctgtccagtccttggcagagttaagggggcttccatccttattccctatcccctcgcccaggctaacggggccttattcaggggggagagtggagccccgagaagcactgttgagaggaagatccttggcccctcctcattctctacaggagggatggagaaagtggacaaaacagactcgcatttcccagtcgaaaagatgg

SEQ ID NO: 26092 - DNA, 1038 bp, Glycine max
  Peptide Sequence Number=SeqID_117777
atgagatcaagtcaaacgcctttgctaaaagaggttctatcaagtcaaggtcagagcctaggaatcactagtctaaaggagctagggcagttgatgggtcagctccagcggcaagcttttcacaaagcttacggtaaaatctgggacctagccatggcagaagtctccacagaggccattgcctccctcgcccagtgttatgatcagccgttgagatgcttcacctttggggacttccagctatcacccatggtggaagaatttgaagagatcctaggatgtcctctagggggaaggagaccatacctcttctcagggttctatccctcattagctagaatttctaagatagtccaaatctcggctcaggaattagaccacaaaaagcaagtcgaaaatggggtggttggaataccgagaaaatgtttggaggcaaaagcaagaatcttggcaagtagaggcgaatgggccccgttcatagacattctcgcactattgatcttcggaggagtcctctttccaaatgtggatgggttggtggacctagcaacgatcgacgcttttctcgcctatcatgaccacaaggaaagcccggttgtcgctatgctagccgacctatatgacacctttgaccgaagatgtgagaagaccagtacgaggattgtttgctgtactccggctctttatgtatggttggtttcacacctttttcgccaagaggtgaggcatgcttgcctgctagaaagccactgttcatgcatagagaaaggaggggcagattgggaccgactcttagcaaacaaagaaggagcgtctgtcaactggttccctcgatggaaagaaggaagaaccagggttcttatttcgtgtgaaggatttccgaatgttcccttgatagggacaaggggttgcatcagttacaatcccgttcttgctataaggcagcttggctaccctatgagaggggtaacactagaggaagagctcgcgcctatcatttcacgaggtttcaataagaccaacgtggagacactttag

SEQ ID NO: 26093 - DNA, 726 bp, Glycine max
  Peptide Sequence Number=SeqID_117778
atgagcttcttcagtaccagcaatattctggtgcacattccgcttggcgcgggcggttacgatctgtcgtggatcgaagccatcggcacgctgttcgggttgctgtgcatctggtacgccagcaaggaaaaaatcatcaactacctgttcggcctgatcaacgtcacgctgttcgcggtgattttcttccagatccagctgtacgccagcctgctgctgcagctgttctttttcggcgccaatatttacggttggtatgcctggagccgccagacccaggataatcaggctgagctgcagatccgctggctgccgctgccgaaagcgttggcctgggcggcggtctgcgtcatcggcatcggcctgatgaccttcaatatcgaccgcgtgttcgcctggctgacgcagatcgcggtggcagtgatgcaagggctggggctgaacgtgcagatgcctgagctgcagccggacgcgttcccgttctgggattcggcgatgatggtgctctccatcgcggcgatgattctgatgacgcgcaagtacgtggaaaactggctgctgtgggtggttatcgatgtcatcagcgtggcgatcttcgcctaccagggggtgtacgcgatggcgctggagtatgtcattctgacgctgattgccctgaacggctcctggctatggatcaagagcgccgggcgcaatggttccaacccgctctcttccgcaccttaa

SEQ ID NO: 26094 - DNA, 397 bp, Glycine max
  Peptide Sequence Number=SeqID_117779
tccactgaaagtgaggacgcgtagccctctaaaggcaagggcgtgcagccctctgaagttcaggatgtgccgccttttgaaggcgagggagtgtagtcctatgatggcgaggacgtgcagttctctaaaggcgaggacgtgtagtcctctaaagttgaagacgtgtagtcctctgaaggcgagggcgtgcggccctctgaaggcaaggacgtgtaatcctttgatggctgagtgcgtgtttcgccctgcgcctgcctgggggcgcatgtacttcttgatgaaagctcgattggttagtccttgcaggccgatccctgagaaacaagagatgactcaccgagagttgggggagggggagattggcattgcggtcgctgggcagaatgttgctaagtag

SEQ ID NO: 26095 - DNA, 228 bp, Glycine max
  Peptide Sequence Number=SeqID_117780
atggcgagggcatgtagccctctgaaggtgaggacatgcagtcctctagtggcgagggcgtgtagccctctgaaggtgaggacgtgtgatcctctaaaggtgagggcgtgtagccctacgaagattgactggccttttgaaagaggtgataattcatgcaacctcatcctatcttttttgcaaatctctccgggaactccctcagagtgtgtgttctgtttgatttag

SEQ ID NO: 26096 - DNA, 127 bp, Glycine max
  Peptide Sequence Number=SeqID_117781
atggtggatgcgcttgccactttagcgtccatgttccagctaaaaccacacggagacctaccgtacatcgagttcatgtgtcacggaagacccacacattgctatttggtggaagaggagcgggatg

SEQ ID NO: 26097 - DNA, 721 bp, Glycine max
  Peptide Sequence Number=SeqID_117782
agggctacacgcccttgcctttagagggcctcacatcctcaccttcagagggcggcacgcccttgccttaagagggctacacaccctcgccttcatagggctgcacgccctcaccttcagagggctacaggccctcaccttcagagggcaacatgtccttgccttcagaggactacacgccctcgccttcagagggctacacgccctcgccttcagagggctgcacgccctcgccttcaaagggttgcacgccttcgccttcagagggctacttgccctcgccatcagaggactacacgttctcgccttgagagggctgcacaccctcacctttagaggactacatgtcctcgccttaagagggctgcacaccctcgtcttaagaaggctacacgccctcgccatcagaggactacacgtcctcaccttcaaagggctacatgccctcaccttcagagggctacgcgtcctcactttcagagggttgcacgccctcgcctgcagagggctgcacgccttcgcctttagagggctacatgccctcatcattagaggactacacgccctcaccattagagggcggctcgcccatgcctttagagggctacacaccctcgccttcagagggctgcacgccctcgcctttagagggctacacgccctcacctttagagggctactagtaccctcgccttcagaggactacatgtcctcaccttaa

SEQ ID NO: 26098 - DNA, 231 bp, Glycine max
  Peptide Sequence Number=SeqID_117783
atgggaatagaaatacacaaaacacaatgtggaccaccatgggtacatagaatgaatcgaaaagcttggttcgagcaaaataggggaggtggttgccgcccagctcgtccaggcgagctcagctcgcccaggcgagccaggttgcttcctccagaagcaacagccttctggaggaatcttctggagggcccaagtgggcctgggtgctatttgcacccccatttttactaa

SEQ ID NO: 26099 - DNA, 222 bp, Glycine max
  Peptide Sequence Number=SeqID_117784
atgtggctccgcatgccaccggactcttgggtcacgcatttcgtttctaaacaaccatttagaggaaactctgggtccaacaaagataggagagaatcactcaaagtgtatcaatctcacacagtgcgtggcgagaaagtcgctagcgcacaggattttgtcggcaatcaaagggaaaggatcactttaggtcgtggttccttttccctatttacttggtga

SEQ ID NO: 26100 - DNA, 219 bp, Glycine max
  Peptide Sequence Number=SeqID_117785
atggctatggacttgaacttctcttcgactactcgggctctttcaagctctgctttagggcttccacttatgatagccgccgatgatcccattactgcttcccctaagctctctgtcctttcttcacgccgcatcccacgccttgcgaactccttggagtaccctcgcgttgtggtcactaaaaccccgtgtgatgaaaggcgtgatgctttcgtctaa

SEQ ID NO: 26101 - DNA, 315 bp, Glycine max
  Peptide Sequence Number=SeqID_117786
atgcctataggttggacctcccagaagagtggagctagtattgaagaggaggaaccaacagatttgaggtcaaatcctcttcaagggggaggggatgattcaatcctccctaggaagggaccagttactagagccataagtaagaggctccaagaggattgggctagagctattgaagaaggccctagggttctcatgaacctcagggctaaaggcccaagtggagaaggacaaagcctccaagtggagaaggatgaaggcccagaggcagagacactatcaagactattaattgttgctgaaggcccaaactaa

SEQ ID NO: 26102 - DNA, 405 bp, Glycine max
  Peptide Sequence Number=SeqID_117787
acgatccctccgccgcctattagtgcttcattgtcattagaggagatagacgataggtggatgcatttctcggaccatgtagcacctgcgggtgagatttgtgttgtccctggacagatatctcatatgttcgtcacaccgacccaggcaggtgatcagcccagacatccacctgccccacaagatgaggaatacgtcgagccacatatcccagaggttccagtggcatctgatctccctagacattcagtggatgcttgtgaaggttgtgaagcgatcgcagaaaggttggagcgtgtgctcaacctcaggatgatcactgaaggcacagagttacatgagatcatgcaggattgcctcaggattgctaggggtgacgcctcaaatggaagtcttagggcgtga

SEQ ID NO: 26103 - DNA, 471 bp, Glycine max
  Peptide Sequence Number=SeqID_117788
atgggaaatcaacagagacaaggatacaaccaaggaggatttttaggattccagcaaggtccctacaatcagccacctcaacaagggccaaatatttttcagaggaccaccaaattggaggagacactagctcagtttatgcaagtgaccatgtccaaccataagagtactgagtcagccttgaaaaaccttgagatccaggtgggtcaaatggccaaaatgttagctgagaagtcatccaacagctttggagcaaataccaagaaaaataccaaagaagagtgtaaagctgttatgacaagaagcatgaagcttgtggcggctgaggataaggatgttgttgctttgaaggagcaagtttctttgaaggacactactgttaaaaagaagaataggaaaattcttccaccaaagcacgaagaccctgggagtgtgaccattccttgctcaataggtgaagtcacagtgtga

SEQ ID NO: 26104 - DNA, 312 bp, Glycine max
  Peptide Sequence Number=SeqID_117789
atgacttttaaagaactaatgaaatggcttaagcactcaacagggggtataaaagtaaacaaaacgagaataaaacattgcacgaaaatcacaagtggaccaactcggtcaaaacatccccagaatggagtcgcaaaagctgtcgcaggtacttacccgttgaagatcgaagaacgagaagaggacgaacgaagaacgtcgcgggaagcgtgttccacgaaaggaatacgcgcggaaattcctcaccaacgtttatttgaggaaaacgttacggaaaaacttcggaaaagacgcgatctacgagctttttag

SEQ ID NO: 26105 - DNA, 654 bp, Glycine max
  Peptide Sequence Number=SeqID_117790
atggtgtctcctcaagggaggaatacatggacagttgatgatcttgtgccttatgtggaaaaaattacaatgttatcagaagagcaagagagagtcactgagccagtgtcacatggtcctgcatcagagcgtcaatttcccgaacaactgtttcacatacttcagtcaagtgttgaaactcagggcatagacagacgaagggagactgttgaagcggaagaatattcccaacaaatggcggagcgtggccatggaatgtattacacgccacaaacatttgctcagtatccgacacagatgtatcagtatccttttcagggtcatcacactgatacttctgcaagccagcaatcgtttggtggtgttgcggaaacacaagctcatttttcatggcccacaatcaccccttcacagcaatatcatggcccaattccaacacctaatgcaccattaggaacacaatggaatgtaccgggacaaatacctaataccggtgacttattcggtgttgatttgcgtaacgcattttctgcggaggctgacgaagaagaagcggggaggcatcggggcagaagaaatcctgatcgccaagcacgaagatgggatcgaccatgtggcacatcctcacggcatcacagacaccaaaatgaatga

SEQ ID NO: 26106 - DNA, 216 bp, Glycine max
  Peptide Sequence Number=SeqID_117791
atgtcaatctttaccctcagaagcaaaaagggggaaagaaggaaaattcccaatcaaagagtgggagaaagcaaaaagaaaagaaagaaaattcccaatcaaagaatgggagaaagaaaaaaaagagatgaagaagaaggaaagaaagctcctgatcaaggatcgaagaaaatagaagaaatgtgcagagaggtctttggaccagacaatatctga

SEQ ID NO: 26107 - DNA, 150 bp, Glycine max
  Peptide Sequence Number=SeqID_117792
atgttgctaagtagcaacgtcatctatatctgtgtaaaagtggtcatgttggcgcgcatgatccacactcgtctctttgcagcggcacgggtgaaatcttgccccgttggtcgccctccattatcagttggtggcccaggaactaattaa

SEQ ID NO: 26108 - DNA, 219 bp, Glycine max
  Peptide Sequence Number=SeqID_117793
atggaaggaggattgcttacatcccttgaagatattgaaagtccaaaagcaagggcaacctcaaaaatcttaagagctatgactaatgttcacctccaattgagttttgtcatcaaagtcatgtcatcctctttagtgattggtctagttgtgaatttgacttgttggattgatctgctggtgaaatgtgtcctaggtgaatcttccattgaactctga

SEQ ID NO: 26109 - DNA, 682 bp, Glycine max
  Peptide Sequence Number=SeqID_117794
atggaggggcgtctgttaaatggttccctcgctagaaggaaggaagaatcaggattctatcttcatgcgaaggatgtcccacgagaggagtgccatcagacgaaagcatcacgcctttcatcgcacgagctttcagtgaccacaacgcgagggtactccaaggagttcgcaaggcatgggatgcggcgtgaagaaaggacagagagcttaggggaagcagtaatgggatcatcagcggctatcactgtgagagacgatgaggttaaagcttcggaagaaagtgatgaggtacaagccctaaggcagagcttgaaagagcccggggcagcaatagtgagctcaagctccgaagaggtgaaaggaatcatcacgggtcaaaggcatgatcttgaaggacgagctaaagggaatatgtgggccatcatcgataagtgcaaagagaagctaaatctagcggcgactcacgagcaaaggctagaggatgagtacgccaagatatcagcagaaagggaagcaagggaaagggtaattgattcattgcaccaagaggcaacaatgtggacggaccgatttgctcttactttgaacaggagtcaagaacttcccccattgctagccaaggccaaagcagtggcggacacctactccgcccccgaggagatccacggacttctcagctatt

SEQ ID NO: 26110 - DNA, 382 bp, Glycine max
  Peptide Sequence Number=SeqID_117795
atggctacctcaccaaaagaaactgcagcttctggttcacccgctgtaccatcatctccgcaccaggaacaactagagttcaacatccaacccatacaaataattcctggtcaagcttcagtccctgagaaactggttcccagaagacaacagggagtgaagatttctgaaaaccctagccttgcaacaagtcctagggaagtagacacggagatggacaagaaaatccgcagtattgtgagtagcattctgaaagatgcttctgtgcctgaagctgatgaagatgtcccaacatcgtccaccccaaatgtttctgtgcctgatgtcaataaagatgttccaacatcctccgctccaaatgctgaagccctcccttcaccca

SEQ ID NO: 26111 - DNA, 288 bp, Glycine max
  Peptide Sequence Number=SeqID_117796
atgaaggccataactcgaagtatgcccctaagctccttgtctttcctcaatggacttctccacgccttgtggactctttgtataaccttgagactttgcgcgcctagatccctcacaaggagaggcgagagactctcctctgttggcgctcccctcatggggtaccctaactgccttatggcaagtgactccctccttgccttccttccatcggggaaaccaattgattgcgctgccccctatcccagccaaatgttggttgatcgaggccgtacccgaatcaaataa

SEQ ID NO: 26112 - DNA, 920 bp, Glycine max
  Peptide Sequence Number=SeqID_117797
atgggaacaaatcaaaccggcaagaggttctatcaagtcaaggtcaaaagcctagataccaccagcatcaaggaattagggcggttgatggaacccctccaaatgcaagccttccgcaagacttacggaaagatcttagagttgaccatagcagaggtatccatagaagccattgtatcgcttacccaatactacgaccagcctttgaggtgcttcacattcggagacttccaattagtaccaaccattgaagaatttgaggaaattctaggatgtcctctcgggggaagaaaaccatatctttcctccgggtgtctcccctctttgagcagaattgcaactgtggtcaaggattcagcaagaggtttggaccgcataaaacagactcggaacggcatagcgggcctaccacagaagtacctagaaaacaaggcgagggcaatcgacgctttccttgcctaccaccatagcaaggaaagtccggtggtagctgtcttggcagatctatttgatacatttgaccgaagaatagattgggaccagctcttggccgggataggaggtagaacaatcagttggttcccccgatggaaggaaggaaaagaaggagtccttttctcatgtggaagatacccaaacattccgctggtaggaacgaggggttgtattaactacaatcccgcgctcgctataagacaactagggtaccccatgaggggagcaccgacggaagaaagcatgtctcctttccttgtgagggatctcggcgcacaaaattccaagactatacaaagaatccataaggcatgggaaaccccgttaaggaaagatcaagagcttagaggcatttgtaatggcatcattggtgggtaccacgaatggctgaaagttcgcatacgaggtttagattggctcgccaa

SEQ ID NO: 26113 - DNA, 327 bp, Glycine max
  Peptide Sequence Number=SeqID_117798
atgcctgagattcaccactccctcaggtctccagacaacacaattctaataaaaacaagaatatcatttatcaataacagacgtgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 26114 - DNA, 705 bp, Glycine max
  Peptide Sequence Number=SeqID_117799
gtgccggagtgggcgaaagaccaagacggccactgggcgctggcttacaccggcaccatcgccttcatcatcaataaacagcaggtgaaagacattccgcacagctgggccgatctgctgaagggcagctatcaggtcaccatcggcgacgtcggcaccgcgtcgcaggcggccagcggcgtgctggcggccacctacgccatgggcggcaacgagaaaaacctcaagccgggcctggaattcttcggcaagctggccaaggccggccgcctgagcctgagtaacccggtgatcgcatcgctggaaaaaggggaagtgcaggttggcgtggtgtgggacttcaacggcctgaattaccgcgatcagatcgacaaaacccgctttgaagtgctgatcccgtcggacggctcgatcacctccggctacaccaccatcatcaacaaatacgccaagcacccgaacgccgccaagctggcgcgcgaatacatcttctctgacgccggccagatcaacctggcgcgcggctatgcgcgcccgatccgcgccgagcatctgacgctgccggacgacgtcaaggccaagctgctgccggccgagcagtacaagaacgcgcacccgatcgccgatccggcggcctgggaacagagcgccaaagcgctgccgcgtctgtggcaggaaaacgtcattatgtttatgcagcagtga

SEQ ID NO: 26115 - DNA, 452 bp, Glycine max
  Peptide Sequence Number=SeqID_117800
atgggatcgaaccaagcaccctcttttaagaaaaggttctatcatgtcaaaatcaagagcctagagttggtaccaaccgtagaagagtttgaagggatcttgggatgccccctaggaggaaggaagtcgtatctgttttctgggttatacccttccatggcaagagtagcaaaggtggtcaagatctcgacgcaagaattggaccgagtgaaacaaaatagaaatggggtggttgggataccaaagaagcacttggaagagaaagcgaaagctttggcggatcaaggagagtggacttctttcatttatgttttagcactattggtgttcggagtcatcctctttccaaatgtggatggactagtggatctagcagcgatcgatgcttttcttgcttatcaccacaacaaggaaagtccgaccgttgctattttggccgatgcctatgacac

SEQ ID NO: 26116 - DNA, 339 bp, Glycine max
  Peptide Sequence Number=SeqID_117801
atgacggacgtgtggggtgctaataccttccccgtgcgtaaatacaactcccgaaccttttcatttaaagttcgtagatcacgtcttttccggtttttccgacgttttccccaaataaacgttggtggcgactccgcgcgtattcctttcgtggaacacgcatcccgcgagtcacgcgttgccctcccgccgaaggctcataaggtggatagttacaatttggcccttgcttcgagactcaaattcttcaatgagatgacaccaatcctcctttccaattccctatgtggcaactcacaaacaaggaaaaaagagatcaagcaaagcaagactatctag

SEQ ID NO: 26117 - DNA, 231 bp, Glycine max
  Peptide Sequence Number=SeqID_117802
atgctgacccagcacgcaccccagtcgactctccagagcccgtcatgtacggaaaagaggtctttctgttacaggtggcatgcccaggttggatgtgtcccaatgaaccctcgtgttgatctctcaatcatgaagttcgccactttggcatctacgttcatcgtaggagggtcatgtcgctggtttcatttgtacaggatgtaccagcttacaaagaaaccaggtaggtga

SEQ ID NO: 26118 - DNA, 309 bp, Glycine max
  Peptide Sequence Number=SeqID_117803
atggaggagatacatggagaagaagatgaagaacaaggaattaaacttgaaggtaggaaaagatgtgatgcaagctccattggagcttgtaggcctaggatcttcttcatcaatggattcctttgcttcttggaagatgaatggcagcggaatggagaaaggaagagagagaagagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 26119 - DNA, 380 bp, Glycine max
  Peptide Sequence Number=SeqID_117804
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatatcattgaggaaagtagcagtgaatccacagatccaggtccgatcactatctcccttgaactcgccagcatggcataa

SEQ ID NO: 26120 - DNA, 209 bp, Glycine max
  Peptide Sequence Number=SeqID_117805
atgctgacacctccggaaagggaacagatgaccacattggcctccgctcgtcaatcacacttggggtcactgaatgacgaggtgcggataaccgtaaggtgtctccgcgggctaccagcttttgggtcatgtctccaccggaagatgctgacatctccggaaagggcgcagatgaccacattggcctctgctcgtcaatcacacttggg

SEQ ID NO: 26121 - DNA, 665 bp, Glycine max
  Peptide Sequence Number=SeqID_117806
atggcccacttggagcgtctcgattcatggcgcggcttcccgagcagctcgcaccgtcctacctatttaaagtttgagaataggtccgtagggcgttgcgcccccgatgcctctatatcattggctttacccgatagaactcagcccgcggagctccagctgatcctgagggaaacttcgttgggagggaaccacgctactaagcgacaactgattgccgtcgtcgctgcgggctctccaccagagtttcactctggcgaattcggccagaccgctcaggatattcaaccaaccatttcgaggcccgggatgctcggggagtcactacaccctcgcgcagcaacattgttacatgtggttcggggaaacgagtgtgacacccaggcaggcgggccctcgcttcctaatggccttcgggtttactcgcccgttcaagactcgacacgatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcacg

SEQ ID NO: 26122 - DNA, 251 bp, Glycine max
  Peptide Sequence Number=SeqID_117807
gcccacttgggccctctggaatattcctccagaaggcggttgcttctggaggaagcaaccctgctcgcctgggcgagctgggcggcaaccacctcccctattttgctataaataggggaggaagtgaagaagaaagggccgaggcgcttccgaaacgtttccgtaacgttttccatgaggaatctcgtaaagctttcaaccgttcttcgacgttcttcattcgttcttcatcgttcttcgatcttcaacgg

SEQ ID NO: 26123 - DNA, 201 bp, Glycine max
  Peptide Sequence Number=SeqID_117808
ggtgtcatcatcaaaaagggggagattgtggaagcaatgccttccaaggttattttttatgatgccaaagaatcaagagttaagcaatgtttcgagcaaagattcaagaatcaagtttcaagactcaagattcaagaatcaagaaaagactcaatcaagataagttttaaaaagttttacaaaacattgaatagcacatga

SEQ ID NO: 26124 - DNA, 607 bp, Glycine max
  Peptide Sequence Number=SeqID_117809
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtgacaaaaggtgcgaataaccataaggtgtgtccgcgtgctatcggacccttgggtcactatagcgaaattgagacttttacgtggtcttggccgaaaggcgctgacatctctgggaagggtgcagatgaccacattggtctctgcgtgtcaatcgggcttgggggtgcggataaccgtaaggtgtcttcgtgtgccatcgggctctcgggtcataggatagcaaaaagtgtgtgcgaatggccatcgg

SEQ ID NO: 26125 - DNA, 316 bp, Glycine max
  Peptide Sequence Number=SeqID_117810
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccagttaaggctaaactgaaaggacaagttttggtgactgcgctcttcagccagttactcg

SEQ ID NO: 26126 - DNA, 321 bp, Glycine max
  Peptide Sequence Number=SeqID_117811
atggaaagggagataatgatcgtgatggtagccacatcatcgctactctactatgaaaagagggtggggtgggcaccctcaaacctttccggattggtctttgcatcgctccgctccctcgtggatctgaaaagaggcaaatttaatcttcctgcttggacgaatgagaaaactggggcaaataaagagggtgacgatgagggagaaacccatgctgtgactgccattcctgtacgaccaagtttcccaccaacccaacaatgtcattactcaacccttctccttacctaccgcccatttatccacaaaggccatccctaa

SEQ ID NO: 26127 - DNA, 311 bp, Glycine max
  Peptide Sequence Number=SeqID_117812
agcatcatcaaaaagtgggacacagttgggagaattcttttgattcttccctttccctgaatcaaaagtgttcaaaggtcgttttgagaactgatgacaacaaagatgatgcaaaggtgatgaacaaaaagctcaaaagatcaaagaacaactcaaatgaatcaaagaacatctcaagtgaatcaagaacaagtcaagacttcaaggatcaagaagaattcaagactcaagaagaaagcctacaatcaataatcaagattcaagatctcaagaatcaagatcaagattcaagactcaagattcaagaataa

SEQ ID NO: 26128 - DNA, 543 bp, Glycine max
  Peptide Sequence Number=SeqID_117813
atgactacaggatcatcggtctactctacctcaattcaccatttcgaactttatacagaaggtttttccgtaccagctccttctacctataccgctgttgaagcacctaaaggagaatttggtgtctttctggtcagtaatggaagcaatcgtccctaccgtcgtaaaataagagcacctggctctgcccattcacaaggactcgattctatgtccaaacatcacatgccagcagatgtggtcaccatcatagtggatgagatcggtcgagtggtctccgttggagatgggattgcacgtgtttatggattgaacgagattcaagctggggaaatggttgaatttgccagcggtgtgaaaggaatagcgttgaatcttgagaatgagaatgtcggaattgttgtctttggtagtgataccgctataaaagaaggagatcttgtcaaacgaactggatctattgtggatgttcctgcgggaaaggctatgctagggcgtgtggtcgacgcgttgggagtacctattgatggagaggggctctaa

SEQ ID NO: 26129 - DNA, 237 bp, Glycine max
  Peptide Sequence Number=SeqID_117814
atgtacagacccatgatgtcttatcagatgagtctcagcctgcagagccagggctttacttcttttccgtgccctactccggaccagttcagggcagaggtcgcatggcctgaggcccagtcaggagaggcaccagtagaggcaccagcagaggctcccgacgaggcagatgaggcccgcgaggacgaggagatgaccgatttactggatttcttaggagggagcggggccacatga

SEQ ID NO: 26130 - DNA, 187 bp, Glycine max
  Peptide Sequence Number=SeqID_117815
atgggtggtggtgcatgggcgttcttagttggtggagcgatttgtctgggactatggccgcttaggccacggaagtttgaggcaataacaggtctggtgatgcccttagatgtttctggggcccgcacgcgcgctacactgatgtatttcaacgagtcttatagcccttggccgacagggtcccggg

SEQ ID NO: 26131 - DNA, 109 bp, Glycine max
  Peptide Sequence Number=SeqID_117816
atggcgactaagatgaagcgatgcccatttgaagccttaggttcgatggccccaatcatgtctatgcccaacattgagaacagtcacggtgctgctaacacgttcaatg

SEQ ID NO: 26132 - DNA, 484 bp, Glycine max
  Peptide Sequence Number=SeqID_117817
atgtgagggtcgattctttgaggaacctaacaacgagggtttgacaatcaatttcgatcgagatataagccaaatgataaacgaggaagaggaagaggacgtcctgtcaccagagttggagagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 26133 - DNA, 386 bp, Glycine max
  Peptide Sequence Number=SeqID_117818
atgggacctctccaaatgcaagccttccgcaaggcgtacagaaagattttagatttaaccatagcggagatattcacggaagccgttgtatccctcacccaatactatgaccagcctttgagatgcttcatgtttggagacttccaattagtaccgactgttgaagaatttgaggagaatctaggatgtcctcttgggggaagaaaaccgtatcttttctccggagttggatcatgtaaagcaaactcgaaacggcatagtgggcctaccacggaagtacttggaaggcaaggcaagggatatggcgaatcaagaggagtgggtctcgtttgtggacgtgttagcgttgctaatctttggggttgtcctctttccaaacgtggacg

SEQ ID NO: 26134 - DNA, 189 bp, Glycine max
  Peptide Sequence Number=SeqID_117819
atgatgttttgcagtgggcttgatcagttgctcctgaaaacggatttattgccaatcattatgaggtctgacacacagattggtgtaggaagaaagattttgttagaagagatattgggagtaggaaatgtgggtgtcccttcaagctttgtgggaaaccagtggttggagggcaaggttggatggtga

SEQ ID NO: 26135 - DNA, 612 bp, Glycine max
  Peptide Sequence Number=SeqID_117820
catcctttccaagcttcttatccaaggcttatcttggtggtgaatctccttcttccatggcttattcaagatgaggctactacttcaccttcctctagtgaaagtgaagaagcaaaaggggaagaatctagtgaagaaatctacccccaagaagaaggacaacctttaatgacaaatattaaagaagcttcccctcttagacaacctccacatcttctcctttgtaaaaagacacttgttagcactgccacacctcttgggtttgaggttattcctcaagtaaatgagttattggatgaaggtttagtttgtattaataggcaccaaatccctaaaataagtgatatgatgaatgtgttgaaagttacaaccctcttttgtaaaatcagtcatgcacccaacatcttcatgattcatgtacatagggactcattaggtagtgatcaaagggttcctacagaccctaagagaataaaggtcattcctgattggcctactccttcaagtgtcaagggaaggagcccagagtttgatgaacattgggatttgaggtcaaatcctttccaaggtcgaggggatgatgcaatcctaccccccaagggtattcgatag

SEQ ID NO: 26136 - DNA, 171 bp, Glycine max
  Peptide Sequence Number=SeqID_117821
atgtggcgtctccaatcatctttcttccttctccattccatagtcattgatcttcaagaagcaaaggactccattgatgaagaagatccaaggcctacaagctccacatggagctacatcatgtggtatcaagagcatcttcgtctatcaagagcatcttcgtctaggtga

SEQ ID NO: 26137 - DNA, 183 bp, Glycine max
  Peptide Sequence Number=SeqID_117822
atggtagccataacccctgctagggttcctcaacttccatttctccaaggatacgactcgaacgcaacgtgtgcttgtcatggagaagtcccggggcattccattgagcactgtatgacctcgaagcgtaaggattttcaagtttatgccattattgtaaaccacggttacaatgctaaataa

SEQ ID NO: 26138 - DNA, 547 bp, Glycine max
  Peptide Sequence Number=SeqID_117823
tacttcaccttcctctagtgaaagtgaaaaagcaaaaggggaagaatctagtgaagaaatctacccccaagaagaaggacaaccattagtggttaaagagaagtgtaaggaggtaagtgtctcctccaagagtttagctaagaaggaaactcattttacaatagagacaaacattaaagaaactttccctcttagacaacctccacattttctcttttgtaaaaaggcacttgctagcattgccacacctcttgggcttgagtttattcctcaagtaaagaagttgttggatgagggtttggttcgcaagagcttaaatccttgtgctttgttggtgcccaaaataggtattattaggcaccaagtccctaaaataggtgatatgatgaatgttttgagtggtgcattcctcttttgtaaaatcactcgtacacctaacatcttcatgggaaggagcccagagtatgaagaacctcgggatttgaggtcaaatcctttccaaggtggagggaatgatgcaatcctaccccaaaagggcattggatag

SEQ ID NO: 26139 - DNA, 144 bp, Glycine max
  Peptide Sequence Number=SeqID_117824
atgaagaaacacaatgaagagaagcggaagacaaaaggagaagaggagaggggaggcacccatccactagggaataagccaaggaagaaggagcttcaccaccaagaattgccttggataagaagcttgaagaggatgctttaa

SEQ ID NO: 26140 - DNA, 282 bp, Glycine max
  Peptide Sequence Number=SeqID_117825
atgattgctcacatcccagatccaagggttgatccttctcaatatcgtgatttagtacattattggtgttctgagaaagggcagaaaataagcaaaatcaacaaaaggagccgctcaaaatatgaggacttgcattgcatgggaaccaataatcttccaagatggattcatgagatgactacaaaggctaagggagtgcaaccttctagggcagaaatttatattgacactcgaactcgaaaagatggaagcattgttactgaaaaggctgctattgtaatt

SEQ ID NO: 26141 - DNA, 167 bp, Glycine max
  Peptide Sequence Number=SeqID_117826
gtgttattaggcaccaaatccctaaaataggtgttattaggcaccaaatccctaaaataggtggggttcccatgaaccctaagagaataaaggtcattcccgagtggcccgctccaccaagtgtgttgaggaaaaaagcccagagtttcaagaacctcaggatttga

SEQ ID NO: 26142 - DNA, 257 bp, Glycine max
  Peptide Sequence Number=SeqID_117827
gattttacaagatagtggaactctcaagcgggttgcttggggactggacgtaggcatcaagcttatcgataccgtcgacctcgagggggggcccgtcgggaaacctgtcgtgccagctgcattaatgaatcggccaacgcgcgggggagaggcggtttgcgattgggcgctagcggagtgtatactggcttactatgttggactgatgaggttgtcagtgaagtgcttcatgtggcaggagaaaaaggctgcaccgg

SEQ ID NO: 26143 - DNA, 213 bp, Glycine max
  Peptide Sequence Number=SeqID_117828
atgtcagtgaaaaaccttgtcgagcgcctaggagtacatgacaagacaaaccacacattagcaagtcagtgttttgcgagaatgctccaaccgtatgggatcaacataggcttaaaggagtactcaaaccgggtgacccccaaggcctacactccgaagagttcgtcagggcctctccctcctgattcaggtccaacccagaaaatattttag

SEQ ID NO: 26144 - DNA, 180 bp, Glycine max
  Peptide Sequence Number=SeqID_117829
atggccaccacaccccccgttttgttgaaaaatgggattccggggcttccgggacacccctgggttgcttctggaggaagcaacccagctcgcctgggcgagctaaggtcgcctgggcgagctaaggtcgctgggcgagctgggcggcacctcctccccctttttcctataaaaggctga

SEQ ID NO: 26145 - DNA, 883 bp, Glycine max
  Peptide Sequence Number=SeqID_117830
gggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcggtaaactacctgtctcacgacggtctaaacccagctcacgttccctcttggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacaggg

SEQ ID NO: 26146 - DNA, 222 bp, Glycine max
  Peptide Sequence Number=SeqID_117831
ccctgggatttgacggcgaacttaaaaagccacctacagacgctttacgcccaatcattccggataacgcttgcatcctctgtcttaccgcggctgctggcacagagttagccgatgcttattccccggataccgtcattgcttcttctccgggaaaagaagttcatgaccctcccagtgtggctgatcatcctctcggaccagctactgatcatcgccttg

SEQ ID NO: 26147 - DNA, 510 bp, Glycine max
  Peptide Sequence Number=SeqID_117832
atgctttggctcgaagccagtagtttccttttatcagttcctgggccaccccctgatattggagggcgaccaactgtgcgagcacatccagagagggaggctatcacgcatctattgtgcataccggggcaagatttcacccgtgccgctgcaaaaagacgagtgcggatcatgcgcaccaacatgaccactcttacatggatatggatgacgttgctatttagcaacattctgcccagcgaccacaatgccaatctccccctgcagatgtatcagttgggatcgcgcccacaagacgcccagtggacccgaagaagtccaacagggccatggggtttccagctctggttacgggcctttgtcagtcctacagggtgcccgttcccccagcaaggaatcgcacccacaaagacacccagtggacccagagaagtccaacagggccctggggtttccaactctgggatcgcgcccgcaagacacccagtggacccgaaggagtccaacagg

SEQ ID NO: 26148 - DNA, 249 bp, Glycine max
  Peptide Sequence Number=SeqID_117833
atggctgtccagtcgggtgcttggatgatgggggtcgtagtcagtgttcttttgagttggatagggaagggctactttgcaaaaatctcttataaagcgcctgagaatctataccccaagaaaagtcacctcatcagacatagcatagaggggtaccaggggcattgcatagcgaaagacatcctcctaatttattggccaaagatgccgaaagggcaggaaaaacagaagtggttttttcctaaataa

SEQ ID NO: 26149 - DNA, 433 bp, Glycine max
  Peptide Sequence Number=SeqID_117834
tatggatcgtacatgaacgtagttgagtcgtggctctctagggtttcctcatttgggatcctggggaagaaggatcaagctggcccttgcgaacagcttgatgcactatctcccttcaaccctttgagcgaaatgtggcaaaaggaaaaagaatccatggaccgaccccatcgtctcccaccccgtaggaactacgagatcaccccaaggacgccttcggcatccaggggaatctattgttggcctctatggttgggcactgagaggcggatggtttacccgggcgaggtctctgctcagttggtagagctccgctcttgcaattgggtcgttgcgattacgggttggatgtctaattgtccaggcgaggaccgaaacatgccactgaaagactctactgagacaaagacgggctgtcaagaacgtagaggag

SEQ ID NO: 26150 - DNA, 75 bp, Glycine max
  Peptide Sequence Number=SeqID_117835
ggctcaacttatgagaaagtgatggaagcttgcttgtggggcttctacggaggctggatctttgagcttcaatga

SEQ ID NO: 26151 - DNA, 480 bp, Glycine max
  Peptide Sequence Number=SeqID_117836
atgtcacgaaaccttacggattacgcaatcatcccttctttggcttccggaatgctacagaactttacggattgcgccttagcacgtcctttcaactcccgacatgtcacggaacatcacggattgcctaacgatgggtgtcaagtacctcgaagtggtcaagcaagggtcgcaccccaacaaacagatgatccccggacgaaattagggtgcagaatgaccataatttgtctctgcgtgccatcggacacgatcgtctggatggcgaaaaggtgcgaaatgaccataatttgtctccacatgtcatcggctcgccacctctggatgacgaaaagggcgcagaatgaccataatttgtctctgcgtgccatcggacacgattgtctccgaatggtgaaaaaggtgtgcggaatgaccataatttgtctctggatgtcatcgggttcgccgcctctagatgacaaaaaaggcgcagaatga

SEQ ID NO: 26152 - DNA, 432 bp, Glycine max
  Peptide Sequence Number=SeqID_117837
atgagagaaaaggaaagaaagcctcaagaggttaacattaacctcccatactttcatgggaaggacaatgtagagggtaacttagattgggaaataagggtagagcaacaacttaaaaggaagtctacatcaaaatcttatggctcccactcttatccaaagaaagaccaaggtcaaggcatcttaggggtgactccttctaagcccaaagatgataaggggaagacaatagaaaaaggacacattacttctcaatgccccaccaagaaaaccatgattatgaggggccaagacatttatagtagccaagatgaggctacttattcaccttcctttagtgaaagtaaagaagcaaaaggggaagaatctagtgaagaaatctacccccaagaaaaagaacaacctttaatggttaaggaggagtgtaaggag

SEQ ID NO: 26153 - DNA, 333 bp, Glycine max
  Peptide Sequence Number=SeqID_117838
atgtggcagagcttgaataaaataatagaaaaagaggaaacccttttatttaagaccaaaaagcttttctctctccacactcagcaaaacaaaaatttcagacagccctctctctccctcacgttgccattctcttcttcttcattctccattgaagctcaacacaaagcttccacctttggccatcatttctgctccaaatcgcgaaaggagagcattttcggggtcgtgaagtgcgtggctacgagtgggacttcgaaaattcaggaacttgttgaaagcttgttgaaattgccatgttgggatgagttagacatacccattctgttttag

SEQ ID NO: 26154 - DNA, 417 bp, Glycine max
  Peptide Sequence Number=SeqID_117839
atgagtcatcattcatctagtgttaatcgtgggggtactagtcataaggaccttctatctagaatcttagatgagttgagttccctcaagttatggaaagaaaaactagaaagaaaagaaaaaggaaaggagagggtagaaataaatcaaggtgagagggaacaaataaaggaagaagaaagaaggaaaatactaaaagagttaagaaaagaaaaacaggccacctatagtagtgatgactcttgtaagagcctaagtgaagaactttgtgactattatgaaggaatccgtaggtcacatcttagacctcactcccataggatagaaaaggaaagaaagcctcacgaggctaacattaacctcccatacttccatgggaaggacagtgtaaaggcttacatagattgggaaataagg

SEQ ID NO: 26155 - DNA, 261 bp, Glycine max
  Peptide Sequence Number=SeqID_117840
atgtatgactacaagttttgggatgaccaaaacaagaaagttatcagaagcaggaatgtcacttttaatgagaacttattttataaggacaaattttctgcagaatctacatgtgcagaatgtttccgtgaggctatgcaggggaatgactctattgagtggaagctagaaatgaaagatgagatgacatcccttcaaaagaataagacgtggtcttcaattaaattgctagaaggaaagaaagctttacaaaataagtag

SEQ ID NO: 26156 - DNA, 234 bp, Glycine max
  Peptide Sequence Number=SeqID_117841
atggaaaagatcggaggcaaacagaataattctcgatcaatgaaagaaaaagatcagagaacctttcgaccagataaattttcggcaagattgccattcaaagtcgttctcgactggcgatatcccaccccacctgaacaaagaggaaaagaccgaaacacccagcttcctctccaaaaaaacactaccctcgagaaaatcctattggtccgtgatcgtacgtttgatctttga

SEQ ID NO: 26157 - DNA, 546 bp, Glycine max
  Peptide Sequence Number=SeqID_117842
atgggtatcacccgacgcgattttctcaacggggtggcgatcaccatcgccgccgggttgacgccgctgcaaatcttgcgcgcgtcgccgcaaaccgccaatcaaaccctgtactacccgccggcgctgaccgggctgcggggtaaccatccgggctcgttcgagcatgcgcaccagttggggcgcgacggcaaaacctttgatttcggcagcgtgcccgccgttgaagagttcgatctggtggtggtcggcgccggcatcagcgggttggcggccgcctgcttctggcagcagctgaaaggtgagcagcagcgcattttgctgatcgacaaccatgacgacttcggcggccacgccaagcgcaacgaattcaacaccgacgacggcatgctgctcggctacggcggcagcgaatcgctgcagtcgccgcgctccaacttcagcccggtggcgatggggctgctgcgcaatctcggcgtcgatatcgatcggctggagcaggcgtttgacaccaccttctacccggatctgaacctgagccgcggg

SEQ ID NO: 26158 - DNA, 417 bp, Glycine max
  Peptide Sequence Number=SeqID_117843
atggagagaagtacgatagatgctgccagtggtggagcccttggagacatgacccctgtagaagccaggaatttaattgagaagatgacttccaactcccaacagtttagcgccagaaataatgctatagtcattagaggagtgtatgaggtagccacaaactcatctgcatcatctgaaactatgaagcttgaaggtaaactagacaccttggttaacctggtcacccaactggccatgaatcaaaaatctatacctgtcgcaagactctgtggtttatgctcatctgccgaccaccatacagaccattgcccttctgtgcagcaatctggagcaattgaacagcttgaagcttatgctgcaaacatctacaatagacctccttacctcagcagcaaatcaaccacaacagaataa

SEQ ID NO: 26159 - DNA, 207 bp, Glycine max
  Peptide Sequence Number=SeqID_117844
atggaaggtaaaggaaataagctattgaaagctcccaacacacttccaatgaaaggcctttttgttacaaaacttgaaagcaatgaagctcttaaggtggttggcccctttcttcgtgacacaaattcttcaagggatggcatcaatcctccttccaattccctatatggcaacccacaaacaaggaaacaaagagacaagcaataa

SEQ ID NO: 26160 - DNA, 1095 bp, Glycine max
  Peptide Sequence Number=SeqID_117845
atggccccgaggaagcttgcctcaaagaggtccaggaaggacaaggcggccgaaggaactagttccgctcctgagtatgacagtcaccgctttaggagcgctgtacaccaggagcacttcgaggccatcaagggatggtcgtttctctgggagcgacgcatccagctcagggacgacgagtatactgatttccaggaggaaatagggcgccggcggtggacatcactggttactcccatggccaagttcgatccagaaatagtccttgagttttatgccaatgcttggccaatagaggagggcgtgcgtgacatgagatcctgggaatgcgagtatggccagaggaggaaccggtctgacgggttcgatgaggaggccatcacccagctgctatgtacaccggggcaggattttgcccgaactgctgcagggaggcgagtgcgaatcatgcgcaccaacatgaccaccctgactcagatatggatgactctgctgctcagcaacatcctgcccagcgatcataatttcgacctccccctgccgaagtgtcagctggtgtacgccatcctgacgcggatgagcgtccatgtggctcagttaatcgctgatgccatttatatttttgcaggtatggcgcctaccaagcaccctttggatccagataagtccaacagggccctgggatttcccgcactgatcacaggactctgccagtcgttcggagtccccgttgcacctaccaaggtgattcggccgcctatcacccgggcttttattgagaagtactgtacccagagacaggctcagggtgatgctccacaggccgcaggcgcgcccccaccacctcatcaggctggccaggctggggcatttgacatggagcagtatttacggcatttggttcgccagcaggcggccaaccaccgagcacatgtacagacccatgattgtctgtaccagatgagccttagcatgcagagccagggcttcgcttctttttcatgccctactccagaccagttcagggcagaggtcgcatggcccgaagattggcccgaggcccaagcaggagagcacccccagaagctcccggcg

SEQ ID NO: 26161 - DNA, 240 bp, Glycine max
  Peptide Sequence Number=SeqID_117846
atgaagcggtgcgctaagcgaaccagtacagctcatctttttctggattcttcctcgcgcttagcccaggagtgttgcgtggtggtcgtcgtcgataagccagtagattggcttagcgagaatagtttggactgggattcagagctttgcatgtcgagggtttctagagagagaaaggtccaagttccaagcaaaaagagaacagctcacttgtcctcaagtgacaatgacatgcagtga

SEQ ID NO: 26162 - DNA, 207 bp, Glycine max
  Peptide Sequence Number=SeqID_117847
atggatgatcagatagtaaggaaatattacattacaaggaaatttggttgccaggctcccaacaatgggattttaacctctcattgtcatgagaagctttacactttagggactgatgtaggtagaagaagagaaatggatagaggaggagaaagggataaaggacatagaaagagggtttcccttattagagatgatcaagcttag

SEQ ID NO: 26163 - DNA, 318 bp, Glycine max
  Peptide Sequence Number=SeqID_117848
atggtgcagcccaaaccaagtgctggcctaaaggggaaacctcaccaacatgctttcactttcatgccttctttcatttcaaaaaatcaaaggcttgggcccctaagcctaagtcatgttttggcatttatcctaactttcgcaagctgtccgcatcccaaaaatggtgaaaagaacattgaggcatttcacctagcacttggtgggcgcacttttgggtaccaacaacaagggaatgggggcaatgtggcttgccccatcatttcagaacacaacctaggcctaaggccatcccctacaaccccccaattcaaataa

SEQ ID NO: 26164 - DNA, 219 bp, Glycine max
  Peptide Sequence Number=SeqID_117849
atgaggacgtgtagccctctaaaggcgagggcgtgcagccctctacaggcgaggatgtgcagtcctctgatggcgaggacatatggtcctctaaagattgactgtccttttgaaaaaggtgataattcatgcaaccctatcctatcttttgcaaatctctccgggaactccctcagagtgtatgttctgtttgatttagtcacgaccattttggagtga

SEQ ID NO: 26165 - DNA, 708 bp, Glycine max
  Peptide Sequence Number=SeqID_117850
atgggatcaagtcaaaagccttcgcttaaaaagaggttctatcaagtcaaaatcaagagcttagaggtcactagtttacgagagttggggcaattaatgggtcaacttcaacagcaagccttccgcaaagcctatggtaagatttgggacctagctagggtagaagtctccatggaactgattgcatccctttcccagtattatgaccagcccctaaggtgcttcacattcgaggacttccagctagtgccaactgtgaaagagtttgaagaaatcctgggatgcccactgggaggaaggaagccatatcttttctctggttctatccctccacgacaagagttgccaagggttagtggactagcagtgattgacgctttcctcgcctttcatcatggcaaggaaagcccggtcgtcgccattttggccatgtatgacacgttcgaccggggatgtgaaaagagcgacgcaagaattttttgttgtgcactggctctctatgtgtggctggtttcacacccttttctccaagaaggtaggcccgtctatccgctacaaggtcaccgctcgtgcgtcgaaaaaggaaaggcgaattgggaccaactcttggctagcatggaggggcgtctgttaatttgttccctcgctagaaggaaggaagaatcaggattctatcttcatgcgaaggatgtccaaatgttcccttga

SEQ ID NO: 26166 - DNA, 465 bp, Glycine max
  Peptide Sequence Number=SeqID_117851
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatccccctatgagaggctaaattgggagcctggaggccaaactcgtaatggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 26167 - DNA, 246 bp, Glycine max
  Peptide Sequence Number=SeqID_117852
atggagaaaagcatcggggtgtatgtgatgcaaagagagaagaccggtagactctgtagtgaggagagtagaccagatggagagaagacaaacaattcgaggcagaggaagacccaaaaaatgatgagaatcatgaaactggccaaatacaggctaaaggcccaagtggagaaggacgaaggcccaagtggagaaggacaaagcccccgagtggagaaggatgaaggcccaagtggagaaggatga

SEQ ID NO: 26168 - DNA, 228 bp, Glycine max
  Peptide Sequence Number=SeqID_117853
atgaacatagactggatcaaaagcgagcagattgataagaaggctgatggtgtaatgatgtaccaagctagactattctcatacttgggtacaactagcgacttgagcttgggtcaagacatggcacgaagtatagtgatggcacgacaagagcttcagtcaacacacaacgcgaggaacagtgatgccatagcgggagcttcggtcaagacacgacgcgacgtatag

SEQ ID NO: 26169 - DNA, 96 bp, Glycine max
  Peptide Sequence Number=SeqID_117854
atgggacaggtgggttctgtggctgatttaggggtggcctttgtggatgattgggtgttcttggctgatagggtggtgagtaatgagaagggctaa

SEQ ID NO: 26170 - DNA, 190 bp, Glycine max
  Peptide Sequence Number=SeqID_117855
atggcagaaaacactagaaaccaatctcttcttcatgaagtagaagaatgtttgagctcgaagttggatgagaggttcttgcagcttgcgggttcattatggcaaatgctacgtgcagacatggatgaacttctacaacaagaggtagtggagcattctccttcttccagcgtgggaattacgacacgcg

SEQ ID NO: 26171 - DNA, 240 bp, Glycine max
  Peptide Sequence Number=SeqID_117856
atgaagactttaaagactaccatggatggtaaaactgatcaagttgcacctcagtggattgaagtaaagagtcatgttcaaagtggaggctatgagtgtggctattatgtcatgcattggatgtggaacatagtaagagggggtttgaagaatgattgggccatgcggatggactcaagtggtgctcttagcaggattagccctcactcagcgaacatgcacaactcatccttcttctag

SEQ ID NO: 26172 - DNA, 228 bp, Glycine max
  Peptide Sequence Number=SeqID_117857
atgacgaaagaaggaggcgacaacatcgacatggagggtctcatcaacgttgctctcggtgctgatggtggcaatcaggaagaacaacaacgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaa

SEQ ID NO: 26173 - DNA, 300 bp, Glycine max
  Peptide Sequence Number=SeqID_117858
atggaaaaacgccagcaacgcggcctttttacggttctggccttttgctggccttttgctcacatgttctttctgcgttatcccctgattctgtggataaccgtattaccgcctttgagtgagctgataccgctcgccgcagccgaacgaccgagcgcagcgagaaacagctatgaccatgattacgaattcgagctcggtaccctccccccttccaacaaactcatcaccatgcttcttcaaaccatcggtcgcgccatcaacaactttggctccgtgaatctcatcggcgactcctaa

SEQ ID NO: 26174 - DNA, 426 bp, Glycine max
  Peptide Sequence Number=SeqID_117859
atgacagtcatgacgttaccggatgcgcagcaactgctggccatgccggattctgattatatgaactcggttcaacgggcgtttttccgccagctgctgcaagatgagcggcaaaagctgctgatgcacatcgatgagctgaaaaaagagatcgacggcggcgaagcgacgggcgatgaagccgacaaggcggcgcgcgaagaggatctgcgcctgctgttccgccagttggatcgcgaaagccgcctgctgccgaaaatcgatgcggcgctggcaaggttgcagaacggcgagtacggctactgccgggaaaccggcgaacctatcgggctggcgcgcctgctgctgcgcccgacggcggaactgagcatcgaggcgaaaaccgcgcaggagatgcgcgagccgcatatgcgcaaaggtggctaa

SEQ ID NO: 26175 - DNA, 2262 bp, Glycine max
  Peptide Sequence Number=SeqID_117860
atgacgccagaacgggtgatcctgcggcagcggctcgcgggcgaacacgtccagcgtggcggcggccagttgcccctgctccagcgccgccagcagatcggcttctaccaggtgcgcgccgcgcgcgatgttgatgagataggcgcccgaactcagctgcgcgaacagctcgcggttgagaatgccgacggtctccggcgtattgggcagcaggttgatcagcagtttgacgccgtcgaggaaggcggcgcgctgcgcctccccggcgaagctttgcacgccatcgatctgtttggcgctgcggctccagcagcgcacgctgaagccaaactcggtcagcttgtgcgccacgctctgccccagcacgccggcgccgaggatgccgatggtgaaatcatccagcgacgcctgatactcgtcgaaacggcggaaatagcgcagcacatagctcagcgcgtattcctgcatctgctgcgccatgccggtatcctccagccgcagcagcggcacgccggcaggcagcgtgccggggtgtttgcgctcctgatcgaggatcgcgtcgacgccggcgccgagggcgaacaccgctttcagatcgcggcggttggccagcatctcgtgcggcgggcgccacaccagcgcgtaatcggccggccgctcgtcgccgcgctgccattcgcggatctcggcctgcggcaggcgttgcttgataccggccagccattcctgggcgttaaacaaggggtggtaataaatgatgttcatactgcgggctcccgtttgtttttattggtttacctccagcctttcgcgattcgccgccggatgcaagcgttaaagcccaaaataaaaacagccccgaccagtggggctgttgtgcatgttagccaatcaggcggcagttgggccgtcgcgccggataaggcgccgcagcagcggaatgagaatcagcatcgccacgccgacgcccgtcgccccccaacccagcgcgctgaagatttcgctgtagccggggttggtctgcagcggcgtgctgccgctgttttccggcatcaggccggagacgtagcccgccagcaccgaggcgacgccggtcaccatcatccagcagcccatcatcacgccctgatagcgcggcggcgccagcttgccaatcatggcgtaaccgatcggcgagatcatcaattcaccgacgctttgcagcacatagctgatgacgatccatttaaacgccaccagcccgtcgccgcccgccatgctgatgcccagcggcagcaccagcatgccgagcccgatgcagaacagcgatccggagaactgcagcggaatgtcgatgttgcaaccgcgagcgcgcaagcggttgaaccaccaggccagcagcgggccgcccaccacgatcaccagcgtgttgatgttctggatccactgcggcgccacctgaatgccgtaaacgttcaggttgatgttgtgctcggagaacagcatcagccccatcggcgccagctggtacagcgcccagaacaccagcgagcccagcgccaggatcagataggccgccattctgcggcgctcatcgcgcggatggtggcgcagcgtcaccacgcacagcatcaggaagatcagcgcgccgagcacgatcacgaagtggccgctgaactcggcgtgggtcagcatcacgcggatgatcggcaccagcgccaccagcaccgccagcccgaccagcatgcgccaacggtattggctgcggctggcgtcgcgcagcggcgtattgagatccgccaaaatgcgccagcggcagacggcgacgacgatcgccgccgcgttgcccagcgtagcgaacaggaacagcgcgcggtagttttccgtcagttggaaatacccggcgacggtaaagccgacgaagaacccgaggttcatgccggcgtagttccacaggaacgccgattcgcgccgatcatcgtccggcttgaaacgctgggtgagcatcatattgatgcaggtgacgttaaggccgctgccggtcaggaacatcgccagcccccagtacagcccccacacgcccgcgacggcgatcagcgcacagcctatcacctgcagcaccatgccgagcacgaacagattgcggttgctgaggaatcggccgccgaggtaaccgccgaacatgtgcaggccatagttgaaggcgccgaacacgcccatcatggcgttggcgctgctttcgttgaagcccaatcgcttggtggcgtacagcaccagcgtgga

SEQ ID NO: 26176 - DNA, 324 bp, Glycine max
  Peptide Sequence Number=SeqID_117861
atgcacacacgaagtttcacaaatccacgattcattaagataggcctaactcacaaaaaatccccagtggagtcgccaactgtcgtaacgtgcccttttgcgggcgagcgaaggcgaggctcacgggtgcgctttccaaaggaggaaagatacgcggagtcgccaccaacgtttatatgtgggaaacgtcgaaaaaaccgatggaaaccggtcaaaatgaaaattctaagttcgggagttgtatttacgtttgaggaaggtcgacaaaagcgaggcttttgctcctacgtaccctccatcgaagaggaaatcagacctatgtag

SEQ ID NO: 26177 - DNA, 820 bp, Glycine max
  Peptide Sequence Number=SeqID_117862
gggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaactcacatcgacgggaaggtttggcacctcgatgtcggctcttcgccacctggggctgtagtatgttccaagggttgggctgttcgcccattaaagcg

SEQ ID NO: 26178 - DNA, 114 bp, Glycine max
  Peptide Sequence Number=SeqID_117863
ggggtgcatcacctggtaggcaactcccttgtggcccaagctgatcaccgagggggggagttacggtgcacgactaggtggcctcgacaattacagcatagtttccctaagtga

SEQ ID NO: 26179 - DNA, 348 bp, Glycine max
  Peptide Sequence Number=SeqID_117864
atgacccaagtgaggaacaagcaagtggttctaagagattatgtcaccggattccctaaagaatccgacatgaacattgttgaaggcaccataatattgaaggttccagaaggttccaatgatgtccttctaaaaaatctctacttgtcatgtgatccatacatgcgactcctcatggccaaggaccgttctttcggagatggctccttcacccttgcctctacacaaatgcggcaattacagtcgcattgggatcaccgaagtcccataaaccttatcggttctgccaaaatcacagttttgatgacaccttgttcactaatatttttttttaaaaaaacttgctga

SEQ ID NO: 26180 - DNA, 294 bp, Glycine max
  Peptide Sequence Number=SeqID_117865
tgcatttattctctaaaaaccaacaactggtatcagagctatcttcttacgagacttgtgaaatggaaggtgaaggaaatttctctcaagttgctcttccactctttgatggcaaaggttatgacctatggtcagtgagaatgcagtcttatctagaggggttggatgtatgggatgctgtggaagagaattacattgttcaaccgctgcccaccagaaccatgactctcaagtcacccaaagaaatttgggaatttttgaaggaagaaaatgcaggggacgacaaaatacgag

SEQ ID NO: 26181 - DNA, 399 bp, Glycine max
  Peptide Sequence Number=SeqID_117866
atgttaaactacactgactctgtgatgaaaagagaatctcctctatccctgcattacaaattgtttgaggggacacatgtcccagacattgtctcgacatcagggaaagctgctgcttcaggtgctgtgtccaaggatgccttgattgctgaactcaaggacacatgcaaggtgctggaagcaaccatcaaagccaccacagaaaagaagatggagctagaacggctgatcacaaggctctcagaaagtggcattgatgatgaagaagcagctgaagaagaggaagaggcagctgaggaagacaaagaagcagctgaagaagaagaagaagctgctgaggaagaggaagatgcagcagaagagacagaatcagatgatgattctgaagccaccccatga

SEQ ID NO: 26182 - DNA, 358 bp, Glycine max
  Peptide Sequence Number=SeqID_117867
gctgatcttccccaagagctcacatcgacgggaaggtttggcacctcgatgtcggctcttcgccactggggctgtagtatgttccaagggttgggctgttcgcccattaaagcggtacgtgagctgggttcagaacgtcgtgagacagttcggtccatatccggtgtgggcgttagagcattgagaggacctttccctagtacgagaggaccgggaaggacgcacctctggtgtgccagttatcgtgcccacggtaaacgctgggtagccaaagcctccggtagcacagccgagacagcgatgggttctctgccccagcggggatggagcgaaagaagttttgagaattcaagagaag

SEQ ID NO: 26183 - DNA, 327 bp, Glycine max
  Peptide Sequence Number=SeqID_117868
atgccccgggatattcccatggtacgtgtaagttgcgttaggatcataccactttgggaaagggggttgctagatcttcctgggagttattacgaccatttggttggcgatgagggacgagaagaggtcttcgtacgtcattgggagtgggtgaattctggaattggcttcgggggaaagttcctcattgcgttggaattgccgtccgggcgagccgtggttggagccggagcttggggggcctccctctggataggggcgggcgccttaggctgtactggcgctgaattggaggagttcccagcgcgagctaaaaagctcgaatga

SEQ ID NO: 26184 - DNA, 420 bp, Glycine max
  Peptide Sequence Number=SeqID_117869
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccaaacccgatcttcagggggggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 26185 - DNA, 174 bp, Glycine max
  Peptide Sequence Number=SeqID_117870
atgactgtgttgtacaaggattggcacgagatgctccctttcgcgctacatggagaaggtcgtgttgtcgaatttgaagtaagattttttctctttgagatactctctggtaatcgattaccaatggccaaaaagatttacaacagctacaaaactattggaattcaaatttag

SEQ ID NO: 26186 - DNA, 412 bp, Glycine max
  Peptide Sequence Number=SeqID_117871
atgagaggaaatcaaagaagacaaaacttcaaacctaaaagaaggactgaagagtcatctcaaatcccaaaatgctttgagtgcaatcaacccggacatctgagggttgattgtccaatctttaagagaaagatagagaagtctgaaaagaaaactattggagataagaaggcaaagaaggcctatatcacatgggatgataacgacttagaattttctgatgattctgaaaaagaaatggttaatctatgtctaatgggcaaaaattatgaaagcgacgaagaggtatctttgaagaagaaatggtacatagataatggttgttcaaagcatatgaggggagattcatcaaagttcacacatatctctcccaagaaaagtgggcatgttacttatggtgataacaacaaag

SEQ ID NO: 26187 - DNA, 457 bp, Glycine max
  Peptide Sequence Number=SeqID_117872
atggaggccatgaaagagcaaatggccatgataatgaaggccatgatgatcatgaagaagataatggaagccagtgcagttgcagttgccgctaccagcactgttgctaaggtgaatccgatgccccaatctggcctcaaccaaatgaatcatccaacctcagctatggtaggcaaagatttgggaagtatgggcggcccctatgatgtgcaaattcaaaatgagcacgccttcccgccatgtggcttgcctctcaactatacgccacccaatgtggcgtacagtcccaataagaatgtcaataactccactcctatacccattgagagccgacaaccccaaactgttcatgcacatgtctctcaacccatgggtgagacacatgaaattccccatcacaatctagccgacttcgagccttggctcggatatgccactgaagggcaagcagttggtg

SEQ ID NO: 26188 - DNA, 400 bp, Glycine max
  Peptide Sequence Number=SeqID_117873
atgactccttcacagcagcacgatgcccccatggcaacacctaacgccccatttgctccgcaatggaataggctgagcaagcagaagcggggagacaacgcggtggcaaaagaaatcttgatcatcaagcgcgaagatgggatcgaccatgtggcacatcttcatgacatcatggacaccataatgactgattttgattgtggcctatggcttggggttacggtttatgtgtttgggtttagggttagagcttatgggtttggattagcggtgggggtgtttggttttgggttagggttagggttagatgttaggggtttaagggatagggtatttgggttagtggttagggttaggttttatggattatatggattagggttgtttcctagtgcttggg

SEQ ID NO: 26189 - DNA, 324 bp, Glycine max
  Peptide Sequence Number=SeqID_117874
atggtccatgacatctccgtcaaggtgaaactggaagtaacagggacatcgacagccctaaatgtgtttggcagtagacgaagcaatgatgtaacacggtccatcttttgccccaatttttgcaagatggttactttcatgcttcaacttgactcgatgaacctttgggtaaaagcacgagcttggttcaaccccataacccagggaatggcaattttgatcgccaatacttcaacaacatttcatagggatgaaagactcgggaatacgcatgctatgcatggaaaatgggaaaacgcaagggtcacgcatgagcaaacatga

SEQ ID NO: 26190 - DNA, 396 bp, Glycine max
  Peptide Sequence Number=SeqID_117875
tcttacggatagcaaatgacgactttttcgcagtttcggccggaagactgctgacatctctggaggaagtctcgctggaagatgttgacatcttcgggaaagatgtaggtgatgacccggaagatgctgacatctctaggaaaagtgcaagtgacgattctcggctagaagacgctgacatctccggggaaggtgcagatgacgattcttggccgaaagacgctgacatctccgggaaaggtgcagaagatgttgacatctctgggaaaggtgcagggcgtctccgcatgccaacggactcacaggtcacgatagcaaaaagtggggcagtcgacaaaagcaaggcttttgctcctacgtatcctcaatttgtgatgaggaactcagacctacgta

SEQ ID NO: 26191 - DNA, 411 bp, Glycine max
  Peptide Sequence Number=SeqID_117876
atgaagttctgcaacattccgggagtcaaaaagagcatcgttactaaaaaggagggtgcaaatagcaaccaggcccacttgggccttctagagggttccaacagaaggcggtgccttctagtggaagcaaccctgctcgcctgggcgagctgggtggcaaccacctccctcttttctcctataaataggggaatgagggcagagcaaattgttcagcccttctggtacttgaggattctctcgaaattagtgagaaaaattgtttccgtgaaaaaaaatccaagtcgaggtgcttccgtaacgcttccgagacgtttccgtgagcgatttcctgaagattcttcaccgttcttcgtcgttcttcatcattcttcgttcgttcttcatggtttttcggtcttcaaccggtaa

SEQ ID NO: 26192 - DNA, 336 bp, Glycine max
  Peptide Sequence Number=SeqID_117877
atgccctcctttcgcgattggagcagaaatgatggccaaaggttggagctttgtgtggagcttcaatggagaatgagggagaagagaatggcaacacaacctgacaacctcccatcacaacatgaaccaaatcctaagagggaggatgtcaatgttgtgatgactagaagcaagaggattcaagaggactccgagaagaaggaaatttttttcccaaaagttgcagatggcatccttactaagaaggacaaggcatctcggaaagttgaggttcctactgatgagaatccagtggcaaacaaggagggtgagaaggaggtagtgacacttccctaa

SEQ ID NO: 26193 - DNA, 885 bp, Glycine max
  Peptide Sequence Number=SeqID_117878
atggaagacctttttaagaggtggaatgagcatcttgacagcacacgtttaaggatcagccaaccaccactgacaaattgtgatttttgtggaggagagcattacaatgacaattgtcatctctactccatgaataactttgggtggggatgggagttaagtccttacaatcaacatgaagaagaaaaaactcctagtcttgaaagtgtgtttgaagaattcatggcataccatgctagctctaaagccgatcaaacttcaatgaaaaatcatgaatttcaatttggcaagagctactccatagaagattaccaaggaggacctgagttacaaccctacaatcaaaatgaagcagaaagaggttccaatctggataatttgttgatgcaattcaaggaaacaactgaatcaactcaacaagcattcaaaagtgcagaaattcaggttggtcagctggcagaagaagtgactcaatttgtggccagaagaaaagaagattttgtagaggttgaagctcaagaggaaagccctgtaaaagagcatgaatcaagagaaaaagatgaagagaaaggtgaggaaaaagtgcaacaatgggaggagtactcaacagtagaaaatcaacaagaaagtttctccaagtcaatacctttcctcatcaacagattgtcaaggaagaaagcttctaagaagcagtggaagaaaaataacttagaaaaatctttcagtagtccactcgctaagcgcacccttcgcgctaagcgccattttcttcacgcgccaagcgagctcttgcttgcgctaagcgcattgacccctgatcattggctgaacattctcgctaagcacatctgttgcgctaagcccaaaagattctctggaatttaa

SEQ ID NO: 26194 - DNA, 425 bp, Glycine max
  Peptide Sequence Number=SeqID_117879
gagagcgcacgagggagcttccagggggaaacgcctggtatcttatagtcctgtcgggtttcgccacatctgacatgagcgtagatttttgtgatgctcgtcaggggggcggagcctatggaaaaacgccagcaacgcggcctttgtacgctgataccgctcgccgcagccgaacgaccgagcgcagcgagtcagtgagcgaggaagcggaagagcgcccaatacgcaaaccgcctctccccgcgcgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcccgaatggtgaatggcggctga

SEQ ID NO: 26195 - DNA, 159 bp, Glycine max
  Peptide Sequence Number=SeqID_117880
atggcacatcaaaaccccccatacttagccttttgcactcctgggcaaaaggaaacaaagaacaaaatccaaggatatcaaagagagacatacaaaaacatttacatatttctcaatgatcatcaaggaatgaaaggaatagtagcatttgagaactag

SEQ ID NO: 26196 - DNA, 294 bp, Glycine max
  Peptide Sequence Number=SeqID_117881
atgtcgtcacgcatgcattgtacgttggtctcgtcttttgtcacaggaagccagaaggtccatatcaccttcttaactgcacatatggggcactgtgcccccgaatgcaatattggcggtcaaaattttcattctctggcttatggggttgaaccaagctcatgcttttacgaaaaggttcatcaagtcaagttgaagtatggaagtaaccatcttgcaaaaaattggggcaaaagatggatcgagttacatcgctgcttcgtctactaccaagcacatttggggatcctctag

SEQ ID NO: 26197 - DNA, 472 bp, Glycine max
  Peptide Sequence Number=SeqID_117882
atgcagctcccgggagacggtcacagcttgtctgtaagcggatgccgggagcagacaagcccgtcagggcgcgtcagcgggtgttggcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgttattccgtaaatctatatttggggcagcagatgagattgaattgaagtttatgaacagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaggcg

SEQ ID NO: 26198 - DNA, 324 bp, Glycine max
  Peptide Sequence Number=SeqID_117883
atgaggaagatgctagcgttaaagttgattgcctctaatgcctttaatacttctgagttgtttggtagtcgtgatgaagttttacaatggactcaatcgttggctcatgacattggatttgttgtcgttataataaggtcatacatcaataccggtgttcaaggaagaatcttatttttgttgatagcttgtgaaaggagtggggagtataggcctaagaaacataaattgctgaaaaaggatgagaagattgttgttgctgatatgacgaagttccatggtgaagccaagaaatattttgttgacgttgaaggagcacaatga

SEQ ID NO: 26199 - DNA, 225 bp, Glycine max
  Peptide Sequence Number=SeqID_117884
atgagtgaagtagaggaggcgcaagagcagatgaaggctgacatggaggccatgaaagagcaaatggccacaatgatggaggccatgatgagcatgaagaagataatggaagccaatgcggttacagttgccgcaaccagcactgttgctaaggtgaacctgttgcccccatctgacctcaaccaaatgaatcatccaacttcagatatacggatgaccctatga

SEQ ID NO: 26200 - DNA, 219 bp, Glycine max
  Peptide Sequence Number=SeqID_117885
atggaagtgcttcttagtccaatagctcttaaggtggttggctccttgcttcttgactcaaattcttcaagtggtacaagtaaagggtacatctacttgggtttgactgagatcaagagagggtacatctcttgtggatcagttctagtggagggtacatccactagggtttcaaagagaacaagggagggtacatcccttgtggatctttgcttgtaa

SEQ ID NO: 26201 - DNA, 288 bp, Glycine max
  Peptide Sequence Number=SeqID_117886
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggcggtttgcgtattgggcgctcttccgcttcctcgctcactgactcgctgcgctcggtcgttcggctgcgcgagcggtatcagctcactcaaaggcggtaatacggtatccacagatcagggatacgcaggaagacat

SEQ ID NO: 26202 - DNA, 162 bp, Glycine max
  Peptide Sequence Number=SeqID_117887
atggaagtcatgatattgcacgagatagaagcaatctcgaaaaagctggttcgtagagtcactgtcgcaacctacccgttcggcgagagggatcgaggtcacggggtgtttccctcgctcctacgtatcctcaattgcgatgaggaaatcagacctatgtag

SEQ ID NO: 26203 - DNA, 225 bp, Glycine max
  Peptide Sequence Number=SeqID_117888
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggccttgtgccttatgatgataagatcaatgtgtatttcttgggaccaaatctgtgtttccttgtatgcaataactatatagattaa

SEQ ID NO: 26204 - DNA, 795 bp, Glycine max
  Peptide Sequence Number=SeqID_117889
gcaggcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaaacgcacggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctc

SEQ ID NO: 26205 - DNA, 1542 bp, Glycine max
  Peptide Sequence Number=SeqID_117890
atgccggaggatgtcgcggtagtgatcatcaactcgaacttccgccgtaatctggtgggcagcgaatacaatacccgccgcgagcagtgcgaaaccggtgcgcgcttcttcaacaaaaaggcgctgcgcgacgtaacgctggaggagtttgcggcggcagaacagcagctcgatccgctggtggccaaacgcgtgcgtcacgtgatcaccgaaaacgccaggacgctggaagcggcggacgcactgagcagcggcgatctgcagcgcatgggtgaactgatggctgcctcgcacgcttcaatgcgcgacgattttgagatcaccgtgccgcccatcgatcagctggtggagattgttaaagcggaaatcggcccgcgcggcggcgtgcgtatgaccggcggcggctttggcggctgcatcgtggcgctgatgccaaccgaactggtcgatcaggtgaaagcggcggtggcgcagcagtacgaagcgcagaccggcatcaaagagaccttttacgtgtgcaaagcctcagcaggagccggccaatgccgtggcgcatcaccgtgctgcgcaatccgcaacggcatggtcgccacctttatggactggggcgccacctggctgtcggcgcgcgtgccgttgcaggacggcagcgtgcgcgaagcgctgctcggctgcgccacgccgtccgactatctgcatcaggatgcttatctcggtgccaccatcgggcgttacgcgaaccgcatcgccttcgctgagctgaagccgcttaacaggctgctggcggccaatcagggtccgcaccagctgcacggcgggccgcagggtttcgacaagcgccgctggcagattctcagccagagtgacagcgaagtgcactatcgtcttgattcgccggacggcgaccagggctatcccggcaatctgattgccgatgtgatttatcagctcgatgacgataactgcctgtcgattcgctatgaagcgcagaccgatcaggcctgtccggtcaacctgaccaaccatgcttacttcaaccttgatgcgcatcatggcgacgcgcgccagcatcgcttacaactgcaggccgatcgttatctgccggtggacagcgcaggcattcccaatgcgccgctgaaagcggtagacggtaccagctttgatttccgccagccgaaacgcgtggcggatgagttcctggccgacgacgatcagcgcgcggtgaaaggttacgatcacgcatttctgctcaccaccgtcggtgacagcagccagcctgctgcacagctgtggtcagcggacgacaaacttagcgtgagcgtgttcaccgccgcgccggcgctgcagttctactccggcaactatctggagggaacgcgcgcccgtgaacagggcagctatactgctttccagggcatcgctctggagagtgagtttttaccggattcgcccaaccatagcgagtggccgcagcctgattgctggctgcagcccggcgacacatggcactccgtgacgcgttatcgcttcaccccgcactaa

SEQ ID NO: 26206 - DNA, 414 bp, Glycine max
  Peptide Sequence Number=SeqID_117891
gccgtaattatccagctgaacggtctggttatagggtacattgagcaactgactgaaatgcctcaaaatgttctttacgatgccattgggatatattcaacggtgggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 26207 - DNA, 261 bp, Glycine max
  Peptide Sequence Number=SeqID_117892
atggaggttgaggaaccttggttggggttatggctaccattgaattatcgagtggataggggatcaagtttagcatatgacaacggaatttggggtgaaccctacaggctttttgctgcaaaattcctttttgttggtgtttttgggatggcctttgtggataactgggtggtgggtaaggaggaggaatggcagtcacagcatgggtttctccctctttctcaccctcttcatttgccccaattttctcagtcgtcctag

SEQ ID NO: 26208 - DNA, 573 bp, Glycine max
  Peptide Sequence Number=SeqID_117893
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtgcaaaaggtggttctacttctaggaaagtgcttgttgtggtcacaggcattgtttcatctattattgctattcttgtgatattcgtgctcgtttactgcaacaagtttagaagcaaagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaggctgcaccg

SEQ ID NO: 26209 - DNA, 210 bp, Glycine max
  Peptide Sequence Number=SeqID_117894
catccgctaagcgcaacactcctaggctaagcgcgaggaagaatccagaaaaagatgagctgtacagagaccagagcatgaagcaggagctggcttcttggtatggaaagctaaatcctctattggatcttccctgtagtggaacttggtctaactctagagtccttgatagtgtagggttgatttgtcgtgctttcacgaggaatcagg

SEQ ID NO: 26210 - DNA, 309 bp, Glycine max
  Peptide Sequence Number=SeqID_117895
atggatgacgttgctactcagcaacattctgcccagcaaccactacgccgatccccccctgccgaagtgttagttggtttttgccatcatgacatagggatcacgcccccaagacacctagtggacccggagaagtccaacagggtcctggggtttccagctctgattacgggcccctgtcagttctacgaagtgcccatcacccctgacaaggtcatcagaccccttattaaccaggttttcatcaagaagtattgtgcccccaagcaagcgcagggcgaggcaccacagtggcccggggacgactag

SEQ ID NO: 26211 - DNA, 744 bp, Glycine max
  Peptide Sequence Number=SeqID_117896
atgggatcaaatcaaacaccttttctcaaaaagaggttttatcaagtcaagatcaaaagactagaagtcaccagtctgctggaattaagacagttgacgggtcaactccaacggcaagccttccgcaaagcctatcgtaagtgtctgggatcccgcacacaaggcttggattggctcctgaagctgaaagctacgagggaagaaaaggccgaggctctggaagagcgcaaagaggtgcaagccctaaaggcagagcttaagaaggtccaagcggtcaaggaaaagtttaagtcaatagctgtcaaagtccgaaaggagtatgacgagttgaaggacgtcaacacggccgccaccgaagccttagagcgagaaaccaagagggcccgaaaggaagaacatggtcggaataagttccgaagggctctatggggaagcaacaaagagcttaaactccggaaagagaaaagggaccaatcgcgagtcgatgacatggtttttgagttgaaggcttgtctaaaatccacaaggagtttatcccaacaactaagcgagatggagggaaacgtgatggccatcattgctaagtataaagaagagttgaatctggcaacgacccatgagcataagctagtagatgagtatgccaaggtggagaacatcataactaagcgtgccccaaggcatccctatcgcacccaatccaagtctaggacaatggttgacttagagaaggtgcacgaatag

SEQ ID NO: 26212 - DNA, 247 bp, Glycine max
  Peptide Sequence Number=SeqID_117897
cggccgccaccgcggtggagctccaattcgccctatagtgagtcgtattaaaattcactggccgtcgttttacaacgtcgtgactgggaaaaccctggcgttacccaacttaatcgccttgcagcacatccccctttcgccagctggccgcggcgggtgtggtggttacgcgcagcgtgaccgctacactttgccagcgctgatgtccggcggtgcttttgccgttaccgcaccaccccgtcagtag

SEQ ID NO: 26213 - DNA, 1095 bp, Glycine max
  Peptide Sequence Number=SeqID_117898
atgagtcttcattcttcatctagtgttaatggtgagggttctactcctaaggaccccttgtataagatattagatgatttgagatcccttaagttgtggaaagaaaaacaagagagaaaagaaaaaggtaaaaaaagagtggaagaaataagtcaagatgaaagagagaaaataagagaggaagaaagaagaaaaataatgaaagaaatgaaaagagaaaagcatgcctcatatagtagtcataactcttgcaagagcctaagtgaagaacttcgtgactattatgaaggaaggcataggtcacatcttagacctcactcccataggagagaaaatgaaagaaaacctcaagaggttaacattaaactcccatacttccatgggaaggacaatgtagaggcttacttagattgggaaataaggaaagaccaaggtctaggcatcttaggggcagcactttctaagcccaatgatgataaggggaagacaatagaaaagcaaccccctaaggctagtatgcaagaaaagactagctccataaagtgctttaaatgtcttggaagaggacacattacttctcaatgctccaccaagaaaaccatgattgtgaggagccaagacatttatagtagccaagatgaggctactacttcaccttcctctagtgaaagtgaagaagcaaaaggggaagaatctagtgaagaaatctacccccaagaagaaggaaaacctttaatagttaaggaggagtgtaaggaggtaagtgtctcctccaagaggttagctaagaaggaaagacattttgaaataaagacaaatattaaagaaatttcccttcttaaacaacctccacattttctcctttgtaaaaagacacttgttagcattgccacacctcttaggcttgagtttattcctcaagtaaaggagttgttggatgagggtttggtttgcaagagcttaaatccctgtgctttgttggtgcccaaaataggtattattaggcaccaaatccctaaaataggtggtatgatgaatgatttgggtggtgcacactcttttgtaaaatcactcgtgcacccaacatcttcatga

SEQ ID NO: 26214 - DNA, 588 bp, Glycine max
  Peptide Sequence Number=SeqID_117899
atgacggacaaaagaaaagttttaggaaaaaataatgaggaaacaagaagttattttacatggaatttggagatggaacgtgtactggctgatgtacttagagatcaaaggaatttgagcaataagggtgacggaggttggaaaaggtcagcattgaatgatgcagccgcagtgttgtttacaagcttcaatgttaatgtcacatcagataatgtcaaaaaccgtatcaaattatggagatcatgtgacatccttggagagagtggatttgattgggatagcactaagcacatgatcacaattgagaatgaaaatgcttggaatgaatattgcacttcgcataaatcgactaaacccgttttgattcaagatagagccacctgtcatggagttgaaactgttatggatgatgatgaagtgatgagtagagaaacaaatgaagtgaaattcatggggttaggtgctactgctaccatagacttagaagaaccaagctctaatacaaaaagaagacgaggttcacttcttcggcaccattctcacagaggagaaaaggaggatgcgcttctttcagaagtgtcaccgtga

SEQ ID NO: 26215 - DNA, 314 bp, Glycine max
  Peptide Sequence Number=SeqID_117900
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaaggctggactgtatgcacgaaccccccgttcagtccgaccgctgcgcccttatccggtaactatcgtcttgagtccaacccgggaaagacatgcaaaagcaccactggcagcagccactg

SEQ ID NO: 26216 - DNA, 611 bp, Glycine max
  Peptide Sequence Number=SeqID_117901
atgacggtaaccggagaagaagccccggctaacttcgtgccagcagccgcggcggatcgatcagtcaggggtgaaatcccagggctcaaccctggaactgcctttgatactgtcgatctggagtatggaagaggaacaccagtggcgaaggcggcttactggtccattactgacgctgaggtgcgaaagcgtggggagcaaacaggattagataccctggtagtccacgccgtaaacgatgaatcaacgcgcagaaccttaccagctcttgacattcggggtatgggcattggagacgatgtccttcagttaggctggccccagaacaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcgtgcgctaaccgcaaggaggcagctaaccacggtagggtcagcgactggggtgaagtcgtaacaag

SEQ ID NO: 26217 - DNA, 354 bp, Glycine max
  Peptide Sequence Number=SeqID_117902
atgacagcagagaccaagtttggtcgtctgcacccttgtatcatcagaggcggcggcccgatgatacgcggagataccttcgaggcggcgggcccgatgatacgcggagataccttacggttatccgcacccttttttcatccagaggcggcgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatga

SEQ ID NO: 26218 - DNA, 447 bp, Glycine max
  Peptide Sequence Number=SeqID_117903
atggtggtgacggtaaaagctcgtagtggaccttgggttgggtcgatcggtccgcctccggtgtgcaccggtcggctcgtcccttctgccggcgatgcgctcctgtccttaactggccgggtcgtgcctccgcatgggataacaccacaggattctgatcctattgtgttggccttcgggatcggagtaatgattaacagggacagtcgggggcattcgtatttcatagtcagagaacgaaagttgggggctcgaagacgatcagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 26219 - DNA, 321 bp, Glycine max
  Peptide Sequence Number=SeqID_117904
atgacactcgcctttagaggactacacgtcctcgcctttagaggactgcacaccctcaccttcagaggactacacatactcgccttcagagggcttaacggcctccccttcataggactacacgtcttcgccatcagagggctacacgccctcacttttaatggactacacgtcctcaactttagaggactacacgtcctcccctttcaaagggctacaagccctcgccttcgtagggctacacaccctcaccttcagaggactacacatactcactttcaggagtggctacacgggcctgccctttcagaggactacaac

SEQ ID NO: 26220 - DNA, 54 bp, Glycine max
  Peptide Sequence Number=SeqID_117905
atggctgacaataggcaaccaggtccaaagccaaaggtagtgaaaataccttag

SEQ ID NO: 26221 - DNA, 47 bp, Glycine max
  Peptide Sequence Number=SeqID_117906
atgaaccttgttcgtgggagcagaatgacagtggcagggtgcaagga

SEQ ID NO: 26222 - DNA, 1035 bp, Glycine max
  Peptide Sequence Number=SeqID_117907
atggggacaaatcaaaacggcaaaaggttttatcaagtcaaggttaaaggtctagatgtcactagccttaaggaattgggacgattgatgggacccctccaaaggcaagccttccgcaaagtttacgggaagattctagatttgaccgtagcggaggtatttacggaagctgtcgtatccctcgcccaatactatgaccagccgttgaggtgtttcacgtttggggacttccaaatggcaaaggcaagggatatggcgagccaagagaagtggggcccatttgcggatgttttagctttgctgatttttggggttgtcctctttccgaacgttgacggcttggtagacttagccgccattgatgctttcctcgcatatcaccatagcaaggaaagtccagtggtagctatcttggcggatttgttcgacacctttgaccggaggtgcgagaaaaacagtgcacggattgtctgttgtttacccgctctctgtgtatggttgatttcgcacctattccgacaagacacgagacacccgtgtccgcttcaaagctatcgctcatgcatcgaaaaaggaagagtcgattgggaccaacatttggctgggatagggggcagcatgatcaactggtttcctcgttggaaggaaggcaaggaaggagtttttttctcgtgtgtggactatcctaatgttccattgattgggactaggggttgtattaattataatcccgcactcgccataagacagctgggatatcccatgaggggagcgccgaccgaagaaagtctctcgcctttccttgtgagggatctaggcgcgcaaggtctcaaggttatacaaagaatccacgaggtgtggaggagtccgttgaggaaagacaaggagcttagaggcatccgaaacggcgtcatcggaggttatcatggatggctaagaattcacacgcggggcttagattggctctccaaattgaaagttattgatgaggagaacttcgaggcccggaggaagatgaagaagtccgagctctaa

SEQ ID NO: 26223 - DNA, 111 bp, Glycine max
  Peptide Sequence Number=SeqID_117908
atggggagatctttgatgcaatcctaccccgcaagggcattggatagaagactccaagtagattgggccagagatccaagggaagaccctagggttctcatgagccttagg

SEQ ID NO: 26224 - DNA, 365 bp, Glycine max
  Peptide Sequence Number=SeqID_117909
atgtcggaaatcgtccgtgaacttagccagttgggatgggacgataataaaattggcaaagagctgggaatggacagcgacgaagtgctgcgcctgaagcaaattaacggcctgcaagagttgtttgccgaccgatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 26225 - DNA, 312 bp, Glycine max
  Peptide Sequence Number=SeqID_117910
atggacccaaaatctaccttaaggctcatgagaaccgtagagccttctcttgcatctctggcccaatcttcttggagtcttctatccaatgcccttgggggggttgcaccactcaacactcaacacattcatcataccacctatcatagggatttggtgactcataatacctattttgggcaccaacaaagcacaaggattttagctcttacgaaccaaaccatcatccaacaactcctttacttaaggaataaccttaagctcaagaggtatggtagtgctaagggatgtttccctgataggaaaaggtaa

SEQ ID NO: 26226 - DNA, 216 bp, Glycine max
  Peptide Sequence Number=SeqID_117911
atggaggacatggaacacatgttaaagttgctgtcaaagataaaggttcagaaaaaccatacttttccgatggtttacgagcacgagtattacgatgtaaagggactggttctagttgaagtgatgaatcaacaactagagaatgattgggagggggccttggagggattgaaggctgaattagtggaacaatcagacgtctttggtaaaccatga

SEQ ID NO: 26227 - DNA, 357 bp, Glycine max
  Peptide Sequence Number=SeqID_117912
atgtcgtttaaagagtcgacaccgctttgcacaagaatcggttctttgtatggatggacagaagggctcagccagacccggttcaattcgttttttgcgggaataccaggttcaagttcaagggaagagaaaagaaagcgtaactctttgttgtcctcttactcttttagcctgccttgtggaggtctctcgggtgtctacggcggatccgatcagtctcgtgaagaagtcttttccgatcttccactaagaaagcaagtaggcgacgcgaatctatggtttctatgtttcaatcgggtaccaattgcttggatgcgtttgaagcctcgagattactttaagaaaaattctttctag

SEQ ID NO: 26228 - DNA, 349 bp, Glycine max
  Peptide Sequence Number=SeqID_117913
gaatcgcacccacaaagacacccagtggacccggagaagtccaacaaggccctggggtttccagctctggttacgggcctctgtagtcctacagggtgcccgttccccccggcaaggtcacatcatcataaggatcgcgcctacaggacacccagtggacccgaagaagtccaacagggtcttggagttttctatggagtacctgtcacctccagcaagggcatcaggccccctactaatcaagctttcatcaagaagtactgcgtccccaggcaggcgtagggcgaaataccacaacagcctggggatggccggcagcgggcaacagacgcaccgccatcacctctag

SEQ ID NO: 26229 - DNA, 420 bp, Glycine max
  Peptide Sequence Number=SeqID_117914
atgggtgaagtagaggaggtgcaagagcaaatgaaggccgacatggaggccatgaaagagcaaatggccacaatgatggaggccatgatgagcataaagaagataatagaagccaatgcggttgcagttgccactaccagcgctgtcgctaaggtgaacctgatgcccccatctggccttaaccaaatgaatcatccaacctcaaatatggtaggcaaagatttgggaaagtacgggcggccccccattatgcgcaaattcaaaacaagcatgccttcccaccatatgtggcatacactcccagtgaggatgtcaataattccgctcccatactcattgaaagccgacaacctcaaactgatcatgcagatgtctctcaaaccatgggagagacacatgaaattccccaccacaatctag

SEQ ID NO: 26230 - DNA, 513 bp, Glycine max
  Peptide Sequence Number=SeqID_117915
atgtaccctcccttgttctctttgaaaccctactggatgtaccctccactagaactgatccacaagagatgtaccctctcttgttctcagtcaaaccccagtagatggtaccccacttataccacaaaggatgtaccctccaatgtgttaagacaaagatctcaggctgttaaacctttgatactttgtgaatggggatacaaaagaattctcagggaatgggaagaatcaaaagaattctcagactgtgtcattttgaattctttgactagggagaagggagacacaaaagaattcaggcggttagtcccttgttcttttggaaaagagagaaaagagacacaaaaagaattcaggcggttagtccttggcgaattctttttggcaaagggagaagagaatgaaaagatgaatagcacaagttttcaaggtttagaaaaccagaaaacttcagaaagcttttggtacagaagaagaagaagaagaacttcaaagagatttcaaggcttgtaa

SEQ ID NO: 26231 - DNA, 474 bp, Glycine max
  Peptide Sequence Number=SeqID_117916
atggatgatcagtcagagtggaccatacagacccttgaagacatgcttagagtgtgtgttcttgatgaaggtggaagttgggacaagttttcatttgctactggtaatttgcgttgctctggaaggtctttcactataacaattccagttcatgagggatccacagtggttcacaacatccctttgttgcatggccaagtgaaggttggtgttgagaaggataaagatgcagaggctgtcgttcctgtacccattgacgaggttattttagtggggcagacacttaacaccttccttgcttggccgacacatctcgtgaagtgtttatcagaacagctgtgtctccagcaaaagctccagataggccggatcatgaggtcgatgatccctatatttgatgacattgaccatcccacagctctttttgaagcatttccaggttatgtgggatcctaccgtgttcgaggtgtttaa

SEQ ID NO: 26232 - DNA, 632 bp, Glycine max
  Peptide Sequence Number=SeqID_117917
cttgtggttacgtgagcatgaactactaccaatatatagatgttgtttacaccaatgagcacatcttaaaagcatactccgcacagtggtggcctcttgggaatgaagcggcaattcctccttctgatgaggcatggacactaatccctgacccaactacaattcgtgcgaaaggtcggccaaaatcaacaaggataaagaatgagatggattgggtcgaaccatctgaccaccgacaaaaatgtagtagatgtggagcagcagggcacaataggtgccgatgtccaatgcaatctgatcgtgggagtttaggggtgaacattttagggtttgtcccggggtcattgtgggccatgaaaaatgagcttgtgttttcacaacaccaccaaacgattgctggcttgcagaagtatcagtgtgatgaccctgaaaaggatactcatacatttgtgtcggatactgagcaaatgttagtggcgtgtaatacattccatggccacgttccgccatttgttgggaatattcttccgcttcaacagtctcccttcgtctgtctatgccctgagtttcaacacttgactgaagtatgtgaaactgttgtgagggaaattgacgctctgatgcatgaccat

SEQ ID NO: 26233 - DNA, 234 bp, Glycine max
  Peptide Sequence Number=SeqID_117918
atgagcaaagaggcaaggatagtctcacaagtcaacagcatctccaatcatgcaacacgcatcatcgcaccaaccatttcatgtgggggaaccctcttctcgtcatcaacactattctatgtagctatcaatgctgctactagtgctttatatgccccaacatctatgacggctactccaataaatatcatcccaacttgccacattgcaacctttttgacccatcaagtgtag

SEQ ID NO: 26234 - DNA, 378 bp, Glycine max
  Peptide Sequence Number=SeqID_117919
atggggtcgaaccaagtgcagacttttaagaaaaaggttttatcatgtcaaggtcaaaaatctagaagtacccagcttgcgaaagttggggcaggggatggatcagttagcaccaaccatagaggagttcgaggggatcttaggatgcccgataggaggaggaagccatacctattgtcataccctaatttcgtccggggactattgtttgatggcatgcaacctttggctgaccgcctcgagggggtgcaaatagcaaccaggaccacttgggccttccagattgttcctccagaaggcggttgcttctggaggaagcaacctggctcgcctgggcgagctgggtggcaagctcctcccctattttcctataaatag

SEQ ID NO: 26235 - DNA, 432 bp, Glycine max
  Peptide Sequence Number=SeqID_117920
atgtactcgaaacaaaactcaataacttcttatgcagtgtatctttcaacaatagatgctttaggacagtgtagattctttgtgtacccttttaagatcttcatgtatcactcaactggatacatccattttgatgtctcgctaagcgagctcaatgtgcttagcgagtgtcatccgctaagtgaggcatcaacgtgcttagcagataggaggaatctggaagggaatttgtcacgcaggcatgcgctaagtgcatcatcagctcgctcagcgagtcatttgtcaccttccaggcttagcgcaagtttggcactgagcgaaacttcacttactcgctcaacgaggggctttagcattgaaagatgtattgtctccttagaacttgatagagcaggattaggttaccgtatgtttggacacggagtgtggtaa

SEQ ID NO: 26236 - DNA, 1006 bp, Glycine max
  Peptide Sequence Number=SeqID_117921
atggagtccacgccggtgaattgggaagccctcgacgctctgctcatcgatttcgccaaatcggaaaacctaatcgaagactcctccgcgccgtcgtcgtcgccgtccccgtccccgtccccgtcgtcgtcttcgtatcactcccgcctcgtcatccgccagatcagacgcgccgtcgagaccggcgccattgacgccgccgtcgctctcctccgcctccacgccccctccatcctcaccgaccacaagattctcttccgcttgcacaaacaggggacagcggaggatcgagactctgctatcgagtgtctgaggacggctctcgctccttgcgcgctcgatgcttatccggaagcgtatgaggaattcaagcatgttctgctcgcgtttatatatgacaaggatgataagaattctccggtggcgaatgaggtcttagaatcctgggaggcaacaatgacacggttattggcttgcaatgttagagtggatttgcaggtcgttgcccggaagcaacgcgctgtatggctcgagtacagtgtcaaaagagcaagagccgctgcatcgttgcccggatgtagtgaaaagaggattcgctttggtacatggaatataggcacacttactggaaaatctatggaaatagtggatgttatggtgaggaggaagatcaattttatgtgcctacaagaaactaagtggacaggtgaaaaagcgaaagaattagacaactcgggatttaagctgtggtatacgggaaaaatcagatcaagaaatgggatagggattattgtggacaaggagtggaagaaggatgtcgtggatgttgggttagcagaacactttaaggtaaaattttgggaggatctagaaggggtacttcaggatataccccaaggagagaaagttttcctaggaggggatctcaatggacatgtaggtagcgtggctagaggttttgagggggtgcatgggggttttggcctaggggagatgaatggggagg

SEQ ID NO: 26237 - DNA, 318 bp, Glycine max
  Peptide Sequence Number=SeqID_117922
atgtttgctttgttgggattattgttttgcttgtggcatttaaggagtggagggctcacccctacaaccaataactttcaagtactgacgatgccaaggacactgaggcatctatgggcttggcgtagcttgcaaagagagtgggcatggtcgtgcaaatataacgtggagccaatacacccagttgaagttagaacggatcgaggagaccattcagacatttcgttcgaggaaatcgaagagtatatggaacttctatggcagttagagctaacatctaaagaggatagtgatgatccttttgaggacaagtcttag

SEQ ID NO: 26238 - DNA, 1884 bp, Glycine max
  Peptide Sequence Number=SeqID_117923
atgacgatgaagcaccaaaccaaacccagcaacaacaagaagaagaagaacgcattgattcatgtcaaccctcacacactcattcaactctctgctccaagcctgcaaaaccctaaaccaagcaaagcagctccaccaccggattctcctcaccggctcacaccacaaccatttcttcgtaaccaagctaatccaaatctacgccgattccaacgaccttcgttccgcagtaacactgcttcaccaaatttcccaccccaacgtcttcgccttcacttcaatcctctccttccactccaggcacggcctcgggcaccaatgcatccaaacctacgcggaactgaggcgaaacggcgtcgtcccagatggttatcgcgcttcggaagtggaaggggtgttcacaaagacgttgttgtgttcggggaagagtccaatttgcaagttcgtaactctgtgttggatatgtattcaaaatgtggggatgttgggagcgcacgccaagtgtttgatgaaatgtctgagagagatgttttttcgtggaattcgatgatgtcgggttatgtgtggaatgggttgccgcataaggctgtggaggtgttgggggttatgaagaaagatgggtgtggttgtgaaccggatgttgtcacgtggaacacggtcatggatgcttattgtaggatgggacaatgctgtgaggcgtcaagggtttttggagagattgaggatccgaatgtgatttcgtggacgattttgatctcgggttatgctggtgttgggaggcatgatgtttctttggggatttttaggcagatggtgaatgttgggatggtttcaccggatgtggatgctctttctggtgtgcttgtgtcgtgcaggcatttgggggctttggctagtggaaaggagattcatggatatggcctcaaaatcatgtgtggggatgtgttttataggtctgctggagctgccttgttgatgttgtatgccggttggggcagacttgattgtgctgataacgtgttttggaggatggataagagtgatgttgttacatggaatgctatgatttttggtttggttgacgtggggttggtagatttggcgcttgattgtttcagagaaatgcagggaagaggagtggggattgatggtagaactatatctagtatactgcctgtttgtgatttgagatgtggaaaagagatacatgcttatgttaggaaatgcaatttcagtggtgtgattccggtttataatgcgcttattcatatgtactcgatccgtggatgtattgcatatgcatattctgtgttttccaccatggttgcgagggacttggtttcttggaacacgattattggaggatttggaacacacgggcttggccaaacagctctggagcttttgcaggagatgagtggttcaggtgttagacctgatttggtgactttttcttgtgcactttcggcttgtagtcattcaggacttgtgaatgaagggattgaacttttctacagaatgacgaaggattttagcatgacaccagcaagggaacacttttcttgtgttgttgacatgttggcccgtgctggtaggcttgaagatgcttttcatttcattaaccaaatgccccaggaaccaaataatcatgtttggggagctttacttgctgcatgccaagagcatcaaaatattagtgttggaaagctggctgcagaaaaattgatcagtttggaaccacatgaagctggtcactatgtgacactgtcaaatatatactcaagagctggaagatgggatgatgctgcaagagtaaggaagatgatggatggccatggattgctgaagccatcaggacatagtttggtcggtactggaagttag

SEQ ID NO: 26239 - DNA, 348 bp, Glycine max
  Peptide Sequence Number=SeqID_117924
atgactggcgagttagggcaggcttttggtgcagtaaaggggagttgcaattgcaacttgcgatttgagtgcaagttgcaactcccattggcaactcccattgctgggcaactcgccactacgagtggcgttttccgtgccacgtggctgtgcccagcaaactcgccactagaagtggcggtttgctatattatccatgcaaagaaaaagaaaaactacaaacgaatcctcattacactcataacgtccacgagaatgatgagggtagacatcccagatatgagaagatggatcacaagtagctccatgcttggcaagacaatctacacgagttaccttccctgctga

SEQ ID NO: 26240 - DNA, 216 bp, Glycine max
  Peptide Sequence Number=SeqID_117925
atgaaggaaaataacttgcgaaaattgataacaaccaagaagttttacccacttcttgcaatgaacccaaaagcggttagtcttttagatccagtgatcaaccaagaagcaaatctgcttcttgcaatgaacccaaaaacggttagtcttttgagtctagtgtttaaccaagaagaccttgtcttgaaatacagtcaccaagagtcggtctcttga

SEQ ID NO: 26241 - DNA, 126 bp, Glycine max
  Peptide Sequence Number=SeqID_117926
atgattcacactcacatgtgctactccaacttcaatgacatcattcacccaatcatagacatggatgttgatgctgatgtgatcaccattcacactcacatttctcttgacctccagttaagataa

SEQ ID NO: 26242 - DNA, 634 bp, Glycine max
  Peptide Sequence Number=SeqID_117927
atggaagctctctttgaaaaactgcatgcgtatgaacatgagttgattcaacaatctcatgtagaagatatagaaaagaaaaggaaagggattgcacttaaagctagttcattaaaggaagaccacaaagaagactctagtgatgatgaagatgcagagaatttgaatttgatggtcaagaagtttggtaaattcctcaaaaggtccaaagacaaaaaattctctaaatcttcaaagaaggaagacaatgcatcaacgtcctccaactcttctagtgaagaagaaattgaaaatgtgtgcttaatggttgattcaatggatgactactcaaccattgaagaaattgaggtaaattctgaatttaaggaagttttggaagcctttaatgaaatgcatgaggaagttcaaaagcttgttgttttcaacaataagcttagaagcgatctaaaatggcatatcactaaattggcttcaacacaaagtgagcttgataaattgaagcaagaaaatgaaaaacttgtttcaagttataaagcaaccggttgtgtttgtgcttctacatctcttaatatggattattgcaaatctttgcaagatgagtttgaaaagtttaaaaatgatcacgatgaagaaa

SEQ ID NO: 26243 - DNA, 267 bp, Glycine max
  Peptide Sequence Number=SeqID_117928
atgggccaaaaatctaccctaaggcttatgagaaccctagggccttcttcaacagctttgacccaatcttcttggagtcttctatccaatgcccttgggggtaggattgcatcaatcaaccagaagcgtttgcaatggataattccaagggcgacgcaagggctcacgggtgcgtcttccaagaaaggaaaatgcacggagtcaccaccaatgtttattcgaggaaaacgtcagaaaaaccggaaaggtgtgatctacgaactttaa

SEQ ID NO: 26244 - DNA, 429 bp, Glycine max
  Peptide Sequence Number=SeqID_117929
atgtacagagataagtgggctcatactaagcccatggacccaaaatctaccctaaggcccatgagaaccctaaggcccatgagaaccctagggccttctcttgcatctctggctcaatcttcttggagtcttttatccaatgtccttgggggtgttgctacttctaaagtgaaagcaaaattttctaaaactaagttgatttctaagtccattgagagcccaaagtcacttgagagggcaaaagagggctatgtttttgttttgttttggcacgtaactttttacgaggacaatggagctccaggatcagcacaaggactaggaggacagatgaccagttcaaagccagatgagaccctacaacaagtggtagcaaaaattcttgaagttgcacatgtggtgaaggacattgaaccaaaattattttag

SEQ ID NO: 26245 - DNA, 462 bp, Glycine max
  Peptide Sequence Number=SeqID_117930
atgggtgccaagtacctcgaagtggtcaaacgaaagttgcatgccaccaaaaaatggtccccggacgaaattagggcaggagcaggtggtgatgaccctccttatctggatggagctcagaggttgttacttgatgctatgactgaacaaatgcaaagggtgacaagacaaaataatgaggagctctatggcaggattgaaggaatagaaaatcaattgaatcataatgttggaggtcctaatgtcgataggagggaaaggtttagagatgaggaaccagaggttgatacttgggctgaaatgaggagttatgagaaggagatatgtgccaaccagctacagcaagaccgtgcttctaaaactctagcaattgagtatgtggagttagaagatcaattgcacaaagtgatgcatgttaaacaacaactgaagaggacgggagctgcaaggaggaattcttga

SEQ ID NO: 26246 - DNA, 438 bp, Glycine max
  Peptide Sequence Number=SeqID_117931
atgggggtatctataaggtttaacattgataagggcggtgtttgggaagaggtggatatggtgttgaatggtacgcgaaggagggaggtgggtgggttcgcgaaaaatgttcgagaagtgactgaggacaaaggcaatttgtgggggtgtaacgaggatgaagatagtgatgctctgggtttgggcaaagtgcttaagttgttggccgaagcaagggagggtgtgaatgatgatgacaaaggtgatgacaaaaagctcaaagatcaatcaagaacaattcaagaagttcaagataagaatcaagaagaattcaagactcaagaagaaagtctagagacaagaatcaagattcaaggttcaagatctcaagaatcaagatcaagattcaagactcaagattcaaggatgaagagaagactcaatcaagataagtattaa

SEQ ID NO: 26247 - DNA, 981 bp, Glycine max
  Peptide Sequence Number=SeqID_117932
atggaagagtgccatttaagtgttgaaagcttccacagttctgggttgtttttggcaagtaggaagagaagcaagttgcaacaagtgataattgggagtaaaaaattcaaaaagcaaactcaagaaacatgttctaaatcctatgttaaactggatagctcattcatgaactttatttcaaacatgatcaaaggatgctcacaatcaactcaagatgaggacaagtctttggctcttaaccttgaaaatcctaatcatcatcttcaacagccagatcagaaacttctcaagtgcaacaagaatgaatatttagagctaaaaaatgcagggttcagatcaaattttcagtctatggtagaagcaaaatttaagaatgttggaacaagaatgtctcaaatcggagaggcttctaaagattttgagccaggtaccaaggtacatggaattgatgccactccaataaccttctatgcaaagaacaatagcctttacagacagtatttgcaatcaaataagcttgaaatatctgaagggagatttgatgcatgtccccccagacaaccacagataagacctataaattctctcaacagtcatcaacactggaaaaataactcaacggagaatgaaaattgttacaacttggagctaactagggagaaagaaggaatggcattactatcattacattcaccttcaactagacaaaatagaaatgataatgagaatgttgagtcttgtgcaatgtatgagagtaaggaaatgtgtcatagaagtggtaatgtggaagaggattccactgtccttgaggatgataagggaaatcaatatcacacagcaaagctgaataagttcaactcctttacacctttcccaggattgagagctgcagggctaatggtgtttgtgtttgcaaggagattaggtgccttaaaaaggaagcatttggttataagtataaaatggataataatttattag

SEQ ID NO: 26248 - DNA, 807 bp, Glycine max
  Peptide Sequence Number=SeqID_117933
atggaaattgagcattatgagtgtggaaaacggacatggtttggggacaaaagagaggaacaagctccaattgagtcaaatgaatttcttccaaggttaaggaggcaaaagtcagtaacttctaggtctcagtatataaacaaaaaggaactaagagtttgtgttggaacatggaatgttggaggaaagcttccacctgatgacctagatattgatgattggttaggcattaacgagctagctgatatctatgttcttagtcttcaggagattgtaccattaaatccgggtaacattttttgtgttgaagacactcgaccgagacagaaatgggaaaacattattcgagatgcacttaatagagttagatcaaaagcaccaaagatgaaatccttcagtgatcccccatcaccatcaaaatttaagccatcaaatgatgcgccagacatagaagaagaaacattacttgaaagtgatggtgatattggtgaggaagtccatcctttggatgaagaacacaatgtttatgatggaggtgcaaataaaccaaccacatatgaagaagccttgaatactaattttcaggcttcagatgttgttgatattgccaacacaaaagagccaataggcaatgatttaaagagacagatttatgatggaaagaggttgagtgatgccttggctgtattgaagaatagtatgagtgaccctaacaatgttcttcaaagttggaattgtacccttgtcactccttgcacatggtttcatgttaattgcaacagtgaaaatagcgtgacccgtgtgtaa

SEQ ID NO: 26249 - DNA, 187 bp, Glycine max
  Peptide Sequence Number=SeqID_117934
atgtcgaaatggacacttgcaaccgacaaggatggtgtcgatgacactgtttgtgaaaagtacgacattagaaggaaaagtagacccaattttgtcagagccacaaagacccttcgtggaaggatgtgcgaaagaaagcacgggccattcagaaacaaaatagtgccctcatgtgtgtctcgtggag

SEQ ID NO: 26250 - DNA, 495 bp, Glycine max
  Peptide Sequence Number=SeqID_117935
atggaagaaggagacaaacacacaagagtttttatactggtttggcaacaacccgtgcctacatccagtccccctatggcccttgagatttcttttcaaccttgtaaaaatccttttacaagccaagatccacaagggatgtaccctcccttgttctctttgaacaacctagtggattcaacaacccaagtagatgtaccctctacttgtaccacaaaggatgtaccctccaatgtgttaagacaaagttctcaggcggttaaacctttgaaactttgtgaatggggatacaaaagaattctcaggcgggagaagggagacacaaaagaattcgggcgggagaagagaatgaaaaggatgaatagcacaagttttcaaggtttggaaaaccagaaaactttggaaagcttttggcaaaaggaagaagaagaagaagttcaaaaagattcaaaagttgtaaaggattgtattgtaaaggttgttcaagatcattga

SEQ ID NO: 26251 - DNA, 96 bp, Glycine max
  Peptide Sequence Number=SeqID_117936
atggctcacatacttactgatctatgtgtatcttccaactcaagttggaaatgtctaacatacattcctcatattgggagggctctcaacatatag

SEQ ID NO: 26252 - DNA, 470 bp, Glycine max
  Peptide Sequence Number=SeqID_117937
taccaacggcgaaggtgctattcggatatttgcatgttcgcaccatactttccagcggagaacatccagcggttcgcgtgcgtgcaccatgtgtttggcggtggcaacgtaggaagcatgctcaacatcacaaagccaaagttgcggggttggaagagaatcatcgcaaggtgaaagaggaccttgccaaggcccaaatggagctggcccgatacatgggcccggagtttgtgagaaagctgagtcccaattatggtggtgagtcttctttgaagggtaagtttgtggcacatttgcagccgacaacaatggagcttgactttgctccctctattgccattgatgttgatgatcttgataagtgggacccttttccaccatgggaaactagttttcagaatgttggtccttcttcttcacatgcacatggtgaaggtgggaataggaagggtaagggtgttgctccttaa

SEQ ID NO: 26253 - DNA, 1143 bp, Glycine max
  Peptide Sequence Number=SeqID_117938
atgtcactcaccacatcatttgcgaaccccagacagtacacaagtcccccaagctttgagttcaatttgttggcgaaagaggttatcaagcatcgagggtggttaaggcttgacgggttgtctagggtgagcatgttttccttcccttctagtttactcagtggtcacatgttacggatgtgcgttgcttttttacatgtatcgcttcgtgagagggcacatcttaaagatgggttacatggtttggtggggattacgtcatggcgcaagttttcagggagtgtatatttggtttttttcatcttcacgcttgagcgccctttaccttcatctctgcaacttctagttcggattgtcacggaggttccctatgaggcttccgacaacgggtcctccttctgcgagaggttgatggacccgagtagcattagcgagggcagctcccgactccatgatggggagttgcgggaaggggctatagtagtgaagttagggtttcgcccagaaataggcattgtcatagtgatgaagtgccctcatccccttcctttgttgctaccgggtgactcccgtaagatgactatcatggcttgcggggaagatgagttcctattcatgcacgttgctcccgactgtccatccttctacgtttatcgctgggtgatggtgaaggcctttgagattctacgtccattcttcaacattaggcccaacattcccgtgttcccctacttctttcaaatgaagctgactgggaagattggttgggtgtcattgaacaacgagtccaagaagatgttcgagttcgactcgaatgtgtttcgcaaattcagggatcggttcttaaaggtcaaggcaaccagtatcattactgacagcctggaccatgcgcttaacgagtatcatctgctaagcgagacatcagcccgcttagcgagtaagaggaatcttgaagggaatctaccacgcaagcatgaggtcagcgcgtcatcagctcgcccaacaagtcatctgtctctttgggcgcttaacgggcctggcttgcttagccaaagatcacttactcgtgctaagcgcgcctttgaggatagaatgccctttttaaagcctggagtgaaagaaaagagagagctgggcagatag

SEQ ID NO: 26254 - DNA, 510 bp, Glycine max
  Peptide Sequence Number=SeqID_117939
atgcctattgactttgtatccccctttgataaaacgcttattcaatcagtcggggtgcaaaactcatctaatgttgtgaaggtcttcctccataggagcctgactacattggaggagaatagacaaaggcataaggaggccctgaccaggattacttctttggagtataaggttgccaaattgagggccactgctcgaacaatatgggttgacgatgtctttgctaagttggtgagcataagactggatggcgacgaggtgttcgaatgctgcatagatttattgaaggaaaagaatgacttgatgagcaagactaagttgaaggagtctgagcttaaagcgacgaaggagaagaaggccaacaagcaggtcagattctttattgagggtcttgacctaagcttctttgacccattcaaggatgtaaaggatggacaattgcttaatgaggatgagattgctgcctgggaggaggacgatggcgaaaaagacgatggggccaatgtttag

SEQ ID NO: 26255 - DNA, 162 bp, Glycine max
  Peptide Sequence Number=SeqID_117940
atggcgatagagacaaccatggggtcatcttggtttatagggttgatgcccttcaaatctctatcgtgcttagttttgtccagtccaagtctgggaggaggtatgaggggtaactgtatgggtatctttgcattgaaagcttcttcgagaatggtggcttga

SEQ ID NO: 26256 - DNA, 688 bp, Glycine max
  Peptide Sequence Number=SeqID_117941
atggcgagtgatgcagcatcgagtagtcctcgtcagccctccatcctagtggaggataccgacgaattcaccaccatgaagatcaccggagtcaaccctgacatcagatcggcttcaaattatagcaagctcgcgttagacgtccccaaggagacaagcacttcgctcacacgattaatgagcatacctagggagagtggcaaccctaacagaccagcagtcaacctacctttaggttggaaatcactcaacctagagcattatgacgggaccattgacccagatgagcacctggacgcgcttctcactcaggccaatctctacactaatgacgacgcgatcttatgtcgattcttccctatgtccctcaagggatccgcattgatgtggtatagaggattcccttcccggaaccttaatcccaaggtggcactgcattctatgttgcaagccccacgacttggaaaatttacttgtagtttatggaagaagctcccagcaacatggatgagttataggagcgagccaagggctacattcagatggaagaaatgtcgagattctgaaacgaagtttgacaggctggacaaaagcacaagaaaggagaaagtagcccaaagaccgacccacacacgttggacaagcgacacaaactggacaagggccaaccacttcaaaggggaccaag

SEQ ID NO: 26257 - DNA, 444 bp, Glycine max
  Peptide Sequence Number=SeqID_117942
atgtccattgtttctaattctgcattgggtttgggaggaagcgactctaggggttccattcggaaacccctagtggagtgggaggtagttcccattgttgattccttgtcagaggaggttcctcgcgaggtttttgacaacatctattcctctttcgagaggttgatggaccttggaaatgttgacgagggtagctccgggctacgtatggggacagaatctttagaggatcaaacttctccggagagtctcgaaaccatcaaggcagtgggcagaggtgatggtgataaggttagggtttcaccgaggaataggcattaccgtagtgacgaaacacctttgtctcctccgtacattgttggcttcaagtgggtgacgggcaacattttgaagtaccactcaacaataacgtcctccacgagcattggtgcccaatggcgttaa

SEQ ID NO: 26258 - DNA, 96 bp, Glycine max
  Peptide Sequence Number=SeqID_117943
atgagtcaagaagaagctcaccactatgccatggataagagcttgaagcccactaatccaagatcaagtccaagattctccactaagtgtgcttag

SEQ ID NO: 26259 - DNA, 603 bp, Glycine max
  Peptide Sequence Number=SeqID_117944
atggagtccatgagatggccaggatcaaggaagaagctaccaagctttgagcatcaagaagatacaacaccaaatcaagataggctcttcgatctcccacatcaggtttacaggtatcctccacctggggaacgaaaagggggtcctacaaaaatggactttggcgctcaagcaatagaagaatcaaggaagattccacgagtagggaagcgaggacctaactgggaaggcctatttagggtggtggcgagcttggataaaagagcatacaaacttcaagaactaggcacacttgaggctcgtcaaacccaaggtccgtccttggtgagtctcgccaaacctaggacaaacgtgttcttggtcaaatctccaaaggctcatcaaacccaaggttcatccttggtgagtctcgccaagcctagaacaaatgtgttcttggtcgaatctccaatggctcatcaaacccaaggcccatccatggtgagtctcaccaaacccaggacaaatgtgttccttgttgaatctccaaaggctcgtcaaacccaaggtccatcctcggtgggcctctctatgcctaagatccatcctacacggatattctag

SEQ ID NO: 26260 - DNA, 189 bp, Glycine max
  Peptide Sequence Number=SeqID_117945
atgtcattgagtcatccgcccttcatgtcggtgtggatgcgaggtgttgttatcatccacggtatcgttggtctgataggggtgcgattcaccgtaggtgcgctcgttgatcgtgtgagtagcgtcatgagtaacaatcttatcataaagactcacatatatcaagatcttaacagcctgaccacctag

SEQ ID NO: 26261 - DNA, 255 bp, Glycine max
  Peptide Sequence Number=SeqID_117946
cttccggaagaacccctaacgggtcttccggaaggctccgccgtgagcctcctttccccattttttccggcgtcctctcctctcgtcttctaccctaaggttactatcctaaggggagttagggagactaacctcgttcgcggagaagaagaagacgaggttcgcgcttgccttgcggagaagaagaagcagttcgcggagaagggagaagaagcagttcgcggagagggagaagaagcttcgcggaaggaatga

SEQ ID NO: 26262 - DNA, 192 bp, Glycine max
  Peptide Sequence Number=SeqID_117947
atgggacctatccttagacagacatgtcgaaggccggctgttacaaccagaaggcacatctttaccgctgatgtcacgcaagacatgatggaacataccaaccatttggttcttccagcatcagctttaaattttttgtttggatcaaaaaaatatgttcctgttcaacgtccaaatggcagacgtaactaa

SEQ ID NO: 26263 - DNA, 129 bp, Glycine max
  Peptide Sequence Number=SeqID_117948
atggataagagcttgaaggtaggagaagatgagttgagggagagggagagaaagagcacgaaattttgtgccccaaatgagtccactaatccaagatcaagtccaagattttccactaagtatgcttag

SEQ ID NO: 26264 - DNA, 507 bp, Glycine max
  Peptide Sequence Number=SeqID_117949
atgggaacgacaccgatgaggaggtggcaaatgcaacgagaaggttacaaacgtgacgatgaggttgcgaacgcgacaaggacatggaaaacacgacgaagaggttgcaaacgggacgtggagagagagggagaagcttatgaggtcttgggagcacatggcaggaaaataaatataaagccattgaatcaacaacattccttactaaacacaaaaattgtagctaataatcctaacccttcccttccatcacttaaaaccaaagttgaatcaccagaacactttgaggaagctagtaaattgggagattcaggtgcagacacaaatgcttttcaacccactacaccaagagggagtcctagtagcccaaatgctaaagttttggtgactgagggttcaaaagatgatttcaagcctactgacctaggtcacaaccctagcgttcactactacaaaagcaacattctacgtcggggattcaatgacggttgcaaacaaccgtcttag

SEQ ID NO: 26265 - DNA, 132 bp, Glycine max
  Peptide Sequence Number=SeqID_117950
atggtgagggtgttcttgggaccgatggttgcagcggattttcttccagcatggcgaaagactatgaaagcggagaagagttggaagttggaagtggaagttggaagttggaagttggaagttggaagttga

SEQ ID NO: 26266 - DNA, 1251 bp, Glycine max
  Peptide Sequence Number=SeqID_117951
atggcttctaggaaaagaaagacaccctctacacctacccaagccagatttgatagatccagattcacctcccaagaggcttgggagagatacactgacattgtggtgcctcgtaagattttaccagaaaggaatgtggtagtctactatacagagtttgaagagttcaaggaggaactcgagagacgccattgggatgaggagttgactgactttctagatgacaacattgatgttgccattgtaaaagaattctatgcaaacctctatgaccccgaggacaaatcacctaagcgggtgagggtgagaggtcatgtgattaagtttgatgaggatactcttaacacatttttgaagacccctgttgttatggaagaggggcaaaaactttgtgcttactctagatttgcactcctgaggcctgatcctcaggagttagctactaagctctatatcccaaggaggggattcgagcttaatgctgatgggcagcctttgaagattttgagaaagaacatgaccactcttgctcagacttggagcgttctttccttttctaacctcatccccacttcccacacttctgatgtcactcttgacagagccaaactcatttatggcatcatcatgaagatgaacatgaatatggggtacctcatctcccaccagatctccctcatagcacagcatgacacatccagactaggattccctgccttgatcacagctttatgtaaggctaggggagttcagtcaaattcgaggtccctggagagcctaagtcctgccattaatttggcatatattaagaagaactgttggaattttgatgatccaatagtaactttcagaggacccaggaaggtcaggggtaagagatttgaggtccccaccacttcagcaccagagacactagcttcttcttctaccacagctccattacctcccattcaaactccagttattcctcctacacccacacagataccacttccagctcctttatctgcagatgttgcactccatgctccagagcatccacagggggcagtctattatcatgcaaagccttcagggcttgggcttgccctccattttgagcatggaggagagcctgatactaaggagccgccagcaccagtagcagcagaggaggagactactccagatcagactccacagccatctccatcctctgcacctactcctgaggagacccagccatctacactagttgtggagtcagagtag

SEQ ID NO: 26267 - DNA, 300 bp, Glycine max
  Peptide Sequence Number=SeqID_117952
atgtatggaagccctagcatagctggaaacccagatgaggccaaccatgttagtgcctcaacatctgcaagcggcattatttctctcctgaaggaggagttagaccaaaaggatagaagcacagagaaggtgaagatcgatggtgaaaacaaccatagcactggagataaggaaactatggaagatgatgaagaaggtaatatggaacccgacaagcccttcaacccaagatcgaacatcgccattaacttgcaacttatgatagatggtgaagaccgtggcaacactccctctttgtga

SEQ ID NO: 26268 - DNA, 279 bp, Glycine max
  Peptide Sequence Number=SeqID_117953
atggttcagctaagcgcacatcgctgtgctaagaccaacatcttcactgtaagttgcaccttaagcaatgggcttagcgtgcatgctgcactaagcgcgccatcctacgctaagccccagattcattctgtagtggcgctaagcttgaatcactcgttgctaagcgcatattgcagaaagattcttggtattacagaaagcgctaagcgccgctgccgcactaagccccaaatgcttactaaagtttacaacttcaagttgggcttagtgcaaggctag

SEQ ID NO: 26269 - DNA, 186 bp, Glycine max
  Peptide Sequence Number=SeqID_117954
atgacatttcttgaccattattacttcatgaacataaacttcgtgtcaaagcaccaccagtcagaattgatagccaagcaaaatatggagctttgtcaagaggagatggggctatatatttatgtttccctcataaaggataccgtgaaagaatatgggatcatactgctggcagcattgttgtga

SEQ ID NO: 26270 - DNA, 828 bp, Glycine max
  Peptide Sequence Number=SeqID_117955
atgaccaataggaaccttcacaattttctcatgcaaatgtccaaaattagcatgctaaaggctagtacaagacacaatgaaggttttaaaaagcagtccacgacagcaatttcgactgcaacatcaagggaaactatatccgcaatttcccacaacattgtgatgaaagtaagatcgcaatttaaaaccttggacataataactgccacagaaaggaaaagagtgaatgctaaaaaaatagaggcagcacttaattgcctcattcaactcctccacgccgcgacccacatagcgttcatccagaagcagcaacctccacttctcctcgcaaactcttctccaagcaaattcctcaaaccaccacttccttcttcttcttcttcttcttcttcctcaataaccttaaaagcagcaaacccattctcccccacatgcttaacctcttcacttgcctccctcttcttcatcctcctcttattccagaacttcatgaaaccgctggtgttgaacgttctgaatgtcgtcattgttgtccgcctttccattgcagtgagacgagacgcctttcttcttcttcgtcatcgtcgaattctgtgttaccgttacctggttgaggcaagagaggggcgagggtgggggtcgaggtcgtcgctggggacgcgggcgatgttgcgaaggcagggtcagttgagaaggtggccatggaggcagccttctagggcggaggggacacggagcgcggcaatgtggaagactcacgtgaatgcttctttgcaaaggatgatgtcatcttgggatagtgttcccttgtggagggagggttcatag

SEQ ID NO: 26271 - DNA, 273 bp, Glycine max
  Peptide Sequence Number=SeqID_117956
atgggtcgttccgtcctcagtgccaagtctaaatccatacaaccaagaacaatttctacggcttccttccaggccttaaaatttgtcccattcagcattgggatagaattcacttgggcagtaacatttgcagcactgaggttactttggcaacataatggttcaaccaatttaattaaaaatactggacacgcaattaaatggaaaggatctgtaatggttaaatttgcaaccaattgtgatagcagtaaatgtttgaaaaacaacaccaag

SEQ ID NO: 26272 - DNA, 546 bp, Glycine max
  Peptide Sequence Number=SeqID_117957
atgggggggtgccctgaccttgttggatgtcccttgtgtgggaaactagagtggttaaagaatttaagcatttctgaggggatgcttaggcactttaattcatccatagtcatgtacttgacgacgctcatgtttcatacgttagatgttgtgtatgttcatggggggtgcagtgaccttgtcggatgtcccttgtgtggaaaaatagagtggttaaagaatttaaacatttctgaggggatgcttaggagctttaattcatccatggtcatgtacttgatgttgcccatgttcatacgtcgtatgttgtgtatgttcatggggggatgcgctgactttgttggatgtcccttgtgtgggaaactagagtggttaaagaatttaagcatttctgaggggatgcttaggggctttaattcatctatggtcaggtacttgatgacacccatggttcatgcctcatatgacataggaaatagtataaactgtggcagctatttccttggtattggatacggtacgtaccgcattgcatctgagagttga

SEQ ID NO: 26273 - DNA, 457 bp, Glycine max
  Peptide Sequence Number=SeqID_117958
atgagtggtcatcaacgcgcagcaagcaaaactttggcgatctctcgaacccttgagggcttaagacttttccatgagcttgacggcgacgagggtgccgatggggccaaagcctccgtggctgaggctcgtgtagaaggagttggtggcacggcggaggacggagaaggagaggcggtgcagcagggagtatgcgcaatgaaacgaggcatgacaaaagtggctaaaccaatttctgtgccctcaagctctcaccaactttgctccggaccttcgaaaactggatctatggctagaaagaagacaccgtcagaacttagggaacaggaagcctcggggtatgctcaagatgaggaagctgctgatgatcaagaggagacaggatggaagtacattcatggggatgttttccggtttccaaagtacaagtttttcttttcagcagcccttggttctg

SEQ ID NO: 26274 - DNA, 120 bp, Glycine max
  Peptide Sequence Number=SeqID_117959
atggtggatgaagtagtaagggtttgcttggcactgcgccaagaaaccgcaccaccggctaacatgaaaatacgcgtacatacttgggcatacatcaaactccctacagctgatgcatag

SEQ ID NO: 26275 - DNA, 477 bp, Glycine max
  Peptide Sequence Number=SeqID_117960
atggcatttgggactagggcagcttgcccaagcgagctgatgcttcatcctaaagtaattggctcacccaggcgagctacagctcacccaagcaagctggttcctttagccctaagcaatttgggggcccaggcgagccagaagctagtctggaacattgtgtttggactgatgaacatggatgcaagaggggatgcagtgaccatgatggatatccctggtgggggaaatagagtggttaaagagttttatgcatctttagagggggatggcttagaatctttaattatccacggtcagtgcattgatggtgcccatgtttcatacttcatattgcatgaaaatatttctcatgagggggaatacttgtactttggggcatgtcactcaatttggaactcccttgagactcaggctgatcactatgggggggagttgcatgtgcacgagaaggtgacctcgacacttgttgcctag

SEQ ID NO: 26276 - DNA, 613 bp, Glycine max
  Peptide Sequence Number=SeqID_117961
atgcacatagatataccgccaggctcccctcctcccgagtcagcaccatcaccgtctatgtccaagaggactagaaaagtcacacagcttagatcattgagtgccagacctatgggtttggagagaccactagctcatgtggatccaaacactaggaaagtccctgtagctcagaaggatttgatttggaaggacaatcaggattccttagaagagcaggatgtactaactattgtcattgggcaaccagagcaccctggtcgtgttcgtgctgctgaaggaattgtacatccagttatgccaaaggtagctccttctagtgctcatgtcagcacaaagcgaagttgtgttgatcccttagggcaggacccagacactgatgcatcagatatgtgtgggttgtatgttgatgacaatcctccctgtcgcaacatgcccttttgcgggcgagcaaaggcgaggctcacgggtgcgctttccaaaggaggaaagatgcgcggagtcgtcaccaacgaaggtattagcacctctcacgtcgacaaaagcggggcttttgctcctacgtaccctccatcaatgaggaaatcagacctacgtagttctttccgtaagg

SEQ ID NO: 26277 - DNA, 256 bp, Glycine max
  Peptide Sequence Number=SeqID_117962
attggccactagaccacctggggcagaaagacctgtggtcaacgtcgatcctactatcggcaaggccgacggtccccacaagaagaaattaagaacatatttggggattgtcgctcgtgataaggttgacgtgacatatgacacctggaaggaagtccctactgctcagaaggatttgatatgggagaatattcagggtgaaataaagacatttttgttttcactctccatgttcctagtgttctcattcttataa

SEQ ID NO: 26278 - DNA, 258 bp, Glycine max
  Peptide Sequence Number=SeqID_117963
atgtggaacgagagtgcctatttaaagctgatgatctcgtcattggcaatggctattccaagggcaactcgccacctgcttcgaagacctcccctagctcaactcgccaatgaaactgacgagttccaagcagctcaaatcgccaatggcactggcgagaccagcgccacatgtcaacgccagcccaaagttgccaatggggctgatgatttgcatgtaggattgtggaagtctttaacaatgcatctccatatataa

SEQ ID NO: 26279 - DNA, 366 bp, Glycine max
  Peptide Sequence Number=SeqID_117964
atgctctacgggggagggggggatttatggagcccaaatcgctactggagctggcgatttcctccaaccaaatcgccagtcaaactggcgattcacaacgaacctgcacctgcttctacttcttctgctacgcgcctgcaaccctcagaaatgcctgcaatccttggaaaagctcacgtagctcaactcgccaatcaagctggcgagtcccatgcaactcaaatcgccaatgacactgacgagaccagcgtcacatgtcaacgccagtccaaagtcgccaatggggctgatgatttgcatgcaatatacgtaaaaaacagtctcatgcagaaaatagtttcaaaagagcatcatttgcagaaatag

SEQ ID NO: 26280 - DNA, 231 bp, Glycine max
  Peptide Sequence Number=SeqID_117965
atggaaagcagaaacaaaaatgtccctgtcatagtctactacgatgcctatgtaggcgattgtgatgagggcattgagtttaagggcgaaaacaatgtacttgtttcaatgaggagaggcatgaccttcaatgtcttaaaaaaaattcaacctgttaccatcagtgacgatgaggatattgatggcatgttcgatgtctataaccgatatcaatgcttaagtggcttttag

SEQ ID NO: 26281 - DNA, 204 bp, Glycine max
  Peptide Sequence Number=SeqID_117966
atgaagaataagaaggttgttgtggctggtgtctcgctaagcgaagcttgtgcgcttagcgagaatcatccgctaagcgaggcacttagcccgcttagcaagttaggagaatctgccaagcatctgcgcgctcagcgcataatcagctcgctcagcaagtcatttgtcttctctcgcgctaagcgcgcccagcttgctcagtga

SEQ ID NO: 26282 - DNA, 777 bp, Glycine max
  Peptide Sequence Number=SeqID_117967
atggacgggcacattgatatggccctggttaaggagttctactcgaacctgtatgaccctaaagacaaatcaccaaaacagggcgcgcacagatcctcaggagcttgcttccaagctccgcattcaatgggcgcgggatttaactacactagcccagacttggagtatgttatcatactccaacctcgccccaacttctcatacgtccgatttgaatatggacagggcaaggttagtctatgggctagttatgaacatggacatggacatgggcttcctcatatcacacccaatttctcagatggcctagtccaactcctcgcggctcggcttcccagccctcatcaccgctttatgcgttgcccgaggaggacccgcaaggctcaggctagaggatctgagggcccatcttcttctgctcctgctcctgcttctacttctgctcctgcctctactgatccagctccctctccctctgctccaccatcatcaattctagcatatattcacgactcggatcagcatcggcctatcattagcatggaggatttcatggcacaggtggcctggccaagagtccagccttctcctttggggggaggtgaggctttcacagcccaggagcctcagccaaaacctcagatgaaggtagctccagaggccactccaaaggctactccacaggcttcaccagttactacaccaggggtagaggtctctgaggaggaggattacgctgcttatgtggattatgcagctgatatgactgtagcatag

SEQ ID NO: 26283 - DNA, 459 bp, Glycine max
  Peptide Sequence Number=SeqID_117968
atggaaagcaaaaatgaaaacgtccatgccgtagtctactatgatgcctatgtagccgactgtgacgatggcctagagtttaagggtggaaacaatgctattaccattagagatgatgaggatatttatggcatgttcgacgtctataaccaacatcaattcttaagtggctttcagtttctcgtacaatacgaacaacaaccttcttctactaccaatgtcaaaacaaccgttcaatcaccacaaattcacaaaacaccatacactgactaccatacaatgataacaacgataatgacatacaattacttttccaacaaacatcaattgaaaatgtctatcatccatatccaaatagagttgatgttggtgacaaccaagtgcccgacaaccccgactatagtcacttctcgtgctaagcgcatcaaccctactcattggctgaaagggcctcattga

SEQ ID NO: 26284 - DNA, 75 bp, Glycine max
  Peptide Sequence Number=SeqID_117969
atggtggttgtggtgatggttggtttggttgttaacggagatacatcgaagattgtcaatccgtataagttttaa

SEQ ID NO: 26285 - DNA, 291 bp, Glycine max
  Peptide Sequence Number=SeqID_117970
atgtataaacagaatcagaaggactttctcaggcttgtagtgagcttatactgggagcaaaggatgcaattatcattcaaagctggtgagtcaggtggagctgcaactttgttatctgagtcatcgggaatgattatcaaaggtggtgccgatggagctggtggaggtggtagaatctcaactttcagggaagccggtgggtctactacttggtggttgcgactcagctggtgcaggctctgtccttgttggtatgggactgtggggcacaacctcgggagatcttcctaa

SEQ ID NO: 26286 - DNA, 633 bp, Glycine max
  Peptide Sequence Number=SeqID_117971
atgtcgtttctgccgttgagattatggttagaatcagaggatgttcatcacgtggatgacgtagctaatgaggtcttccaacagcctcaagaagcagttgttaatgcccacggttttctaggcgggccgcatgacacatcagttctgattggctatgttgatcatgttgcagtcattgtttggaatgaagaggaacatcctgaattgaagctatcctcccatgaaaggaaggttcagaaatttgagaggcctgctgcaaagattgaagggttagttgctgccacaagattgagtcctttgatcgcatgttcattggacactggcgatcgaggacttatatcgacttttgcagagaggtggcacaaggaaactagcagtttccatcttcctataggagaggtgaccatcaccctcgatgatgtggcctctttgcttcatttgcccatcacaggcgccttccatagctttgagactcttcatgttgatgaagcggtgttgctgttagtggaattacttgaagttagtcagatgaagccaaagctgagacaatatagtgtcatggggcatatgtacaactatcatggctacgagacatttatcatagcaaatgtgatgccgcacactggattgtaa

SEQ ID NO: 26287 - DNA, 441 bp, Glycine max
  Peptide Sequence Number=SeqID_117972
atgtttaacactttgaaaaccgatggagaattcggccatttcaagttagggaatggtacaaaaatgaaggttgaaggcatagggagtgtgaggatgaagctccatgatggggctattcatactttctcaaatgtgaggtttgtaccttctgttattgtcaatattatttctatgggggagatgacatcacaagggtacaagtatgttggttcaaagtggggatgcaagaaacataaggataacctttgctatttggatggacaagccttgaagaggaaccatgatagcaaagtgaagaagaaagggaagttttctacttttgtaaagtgttgggagatactttcgatggatgaggagtttgttcactttcaaattgatcgaatgatatttcttttttggcttgagggggagtgtggcgtccctaaattaatgactagttaa

SEQ ID NO: 26288 - DNA, 258 bp, Glycine max
  Peptide Sequence Number=SeqID_117973
atggatcttgcagtaggacctgtttctattgcttccctagtgctgggatccatgctcacagaggaagtgtctcccaatgaacaacctcatctttttcttcaattaggtttaacttcaacattctttgttgggatctttcaagccgctcttggaattctaagtttggtcctgtcataccctaatttcgtctggggacctttgcttcgtggcatgcaacttgtatttggtcattttgaggtgcttggcacccatcattag

SEQ ID NO: 26289 - DNA, 211 bp, Glycine max
  Peptide Sequence Number=SeqID_117974
ctacggagctgaggtcacattcatttctagaggaaatcctgatcttcttatcgttcgtgacttccacctaaagtcattgcgttcagccctctccctatggtcgagcaactacgtacctttcttttctagacctcatgtgggagaggcatctgttactaaagaaatctcatttgccaacattcccttgggtattccccctaagaggccttaa

SEQ ID NO: 26290 - DNA, 255 bp, Glycine max
  Peptide Sequence Number=SeqID_117975
atgaccaaacttggtctctgcttgtcatcgggcccgccgcctctggatgacaaaagggtgcgaataaccataagaatgaccaaacttggtctctgctgccaacggacacgactgtgtctgaatggcaaaggggtgcggataaccgtaagaatgaccaaacttggtctctgcttgccaacggacacgactgtgtctgaatggcaaaggggtgcggataaccgtaaggtatcttcgcgtatcatgtgtgcagaatga

SEQ ID NO: 26291 - DNA, 72 bp, Glycine max
  Peptide Sequence Number=SeqID_117976
atggcattcaagatttccaaggttttcaatggcttagctcaagaccccactactctgtcgtatttgtccttg

SEQ ID NO: 26292 - DNA, 854 bp, Glycine max
  Peptide Sequence Number=SeqID_117977
accctaagtacctagatgtagagttctttaatgatgaaacgtttgattgctatcaagtgtttcaaaattctggccttgttgatttcatgtcattaaaactgccacattatcttgaacttgtaaaggtcttctactgcaatttgaaaattcaggatggcattatttcctctgaggtgcatggtattcctatgatcattgatcagtccttattcttttctttaactcatttacccagtcaaggtgcaccttttgagggcaccattgttgatgactggaaatttgattattctagtcatgatgctcgccgcatggtctgcaatgatcaggctggaatgaccgcacaagcctctgaggaggatttgattctgatgtgggcttttctcaccggtcgtcagatcgactgggcccatttggttcggtaccgaatgcataaggcattacgggtcaatgcacctctaccttatccacagttgataactttgtttctgcgtcattttcaaattccgcttgatgatgagccatttgttcatgtcaagcgttcctttgcaattggtgttggtgctgtgacttcctttggttatcgtaaggatcagaatggtcaatggctgaagaaaggcgcactccctcctcaagatgagcgtactccttcacctcctcctcagcgtgaagattcagcactcctgaatgaagtccttaccgaattacgaggtcttcgttcttatgttggtgaacgtttcgactcattggatacacactttgccggcatggatattcgtctcacacaagttgaagaagatgtctccttcatccgtacttgctttgatccaccaccaccgcctccatcatcctcttag

SEQ ID NO: 26293 - DNA, 300 bp, Glycine max
  Peptide Sequence Number=SeqID_117978
atgtgtgctcgtcatggagaagccccgaggcgttccattgagcattgtagggccctgaagcgtaaggattttcaagtttgtaccattattgtaaaccacagttacaatgttaaaatggataaagttgatatctttgtccctcatcctctcacaaacgcatctttgcttattcaactttcaccggaatgtgggtgcaagccattggtctgtttgctcaagcgacctgtgctcctgagtttggacttccaagaccgttcaatcagagattactcgtcttgcgcattggtggggctgccgtaa

SEQ ID NO: 26294 - DNA, 189 bp, Glycine max
  Peptide Sequence Number=SeqID_117979
atgaccataatttgtctctacatgtcatcgggctcgccgcctctggatgataaaaaggtgcagaatgaccataattgtctctgcgtgccatcggacacgattgtgtctaaatggcaaaagggtcagtatgacagagattgtggggcggccgacaaaagcgaggctcttactcctacgtatcctcaatga

SEQ ID NO: 26295 - DNA, 342 bp, Glycine max
  Peptide Sequence Number=SeqID_117980
atgaatctggctgtttacatggggaaccagccaagacaaaatttcaatggacagtggaggaaccaccctggtaaccaattcaacaaagaccagggtggtccatctaataggccacaacaacaagggcctagtctctatgatcaaacaacgaagttggaagagactcttgctcagttcattcaagtatccatgtcaaacccaaagagcacagagtcagccataaagaatttggaagtccaggtgagacagttggcaaaacaattggcagaccgtccatctagcagctttggagctaacactgagaaaaatccaaaggaggaatgcaaagctgtgatgacttga

SEQ ID NO: 26296 - DNA, 108 bp, Glycine max
  Peptide Sequence Number=SeqID_117981
atgggtttgccaggtcactctcactatcataggcttaaaggagcactcaaacccggtgacccccaaggcctacactccgaagagtccgtcagggtctctccctcctga

SEQ ID NO: 26297 - DNA, 186 bp, Glycine max
  Peptide Sequence Number=SeqID_117982
atgtcagtgaaaaacctcgtcgggcgcctaggagtacatgataatacaaaccacacactagcaagtttggtcactctcactagcttaaaggagcactcaaaccgggtgacccccaaggcctacactccgaagagtctatcagggtctctccctcctgattcaggtccaacccataaaacattttag

SEQ ID NO: 26298 - DNA, 210 bp, Glycine max
  Peptide Sequence Number=SeqID_117983
ttggcccagggcttcccggtatcaacagggacaccagatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 26299 - DNA, 390 bp, Glycine max
  Peptide Sequence Number=SeqID_117984
atgacgtcagagaccaagtttggtcattctgcacccagtacgcggagataccttacggttatccgcacccctttgccattcagacacagtcgtgtccgatggcacgcagagaccaagtttggtcattctgcacccatgatacgcggagataccttacgagaccaagtttggtcattctgcacccatgatacgcggagataccctacggttatccgcacccctttgccattcagacacagtcgtgtccgatggcacgcagagaccaagtttggtcattctgcacccatgatacgcggagataccctacggttatccgcacccctttgccattcagacacagtcgtgtccgatggcacgcagagaccaagtttggtcattctgcacccatga

SEQ ID NO: 26300 - DNA, 237 bp, Glycine max
  Peptide Sequence Number=SeqID_117985
atgaggtgcaggggtgctcgcccaggcaagctaacctacacttttttttttaggggagacataagcctaggatcttcttcatcaatggattcctttgcttcttggaagatgaatggcagcggaatagagaaggaagagggagaggagacgccacttcaaggagaagatgagtctagaagaagctcaccaccacaggaggccatggataagagcttggaggaagaaggagatgaatga

SEQ ID NO: 26301 - DNA, 489 bp, Glycine max
  Peptide Sequence Number=SeqID_117986
cctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcggattcccactgtccctgtctactatccagcgaaaccacagccaagggaacgggcttggcggaatcagcggggaaagaagaccctgttgagcttgactctagtccgactttgtgaaatgactgagag

SEQ ID NO: 26302 - DNA, 246 bp, Glycine max
  Peptide Sequence Number=SeqID_117987
atgacagtcgacgtcggccaggaaagcccatgtggagaaggacgaaggcccatgtggagaaggacaaaggcccatgtggagaaggacaaagcccccgagtggagaaggatgaaggcccaagtggagaaggatgaacgcccagaggcagagacactattaagactattaattgttgctgaaggcccaagtggagaaggacgaaggcccatgtggagaaggacaaagcccccgagtggagaaggatga

SEQ ID NO: 26303 - DNA, 164 bp, Glycine max
  Peptide Sequence Number=SeqID_117988
cttccacatcaagcaagttcatctcaaagctcttatgcaaacaatagaattcaaaagttgggaatttgcttggaaaccttgtagctgtgctcctaaagtacgattttctgcagaagaatgccacaaattaatcaaggtcttagaagctataattcaagagtctg

SEQ ID NO: 26304 - DNA, 488 bp, Glycine max
  Peptide Sequence Number=SeqID_117989
atgagcgtccatgcggctcagttgatcgctgacgccatttatttatttgcaggtatgccacctaccaggcaccctctagaaccagataagtctaacagggccctgggttttccagcattgatcacgggtctcttccagtcattcggggttcctgtcacacctagtaaggtgattcgaccgccgatcaccggggccttcattgagaagtattgcacgcctagacaggcacaggacgtaccgcccccacctcatcaggctgatccaactgggtcatttggcatggagcgcattagtcaacagagacagggtttcgctccttttgcgtgccctactccagatcagttcagggctgaggttgcatggcccggagattggcctgatgcccaggcaggggaggcgcccgcagaggctctcgacgatgcaaaggaggctcgcatggatgaggagatgatagatttactcggtttcttgggatggagtggagccac

SEQ ID NO: 26305 - DNA, 309 bp, Glycine max
  Peptide Sequence Number=SeqID_117990
cgggcaccagaacctgctccaggtgacctcattgacctagaagaagtagaatctgatgaggaacctgtcgcaacctacccttcggcgggagggcgacgcgagactcgcgggatgcgtgttcctcgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 26306 - DNA, 354 bp, Glycine max
  Peptide Sequence Number=SeqID_117991
atgactacaggatcatcggtctactctacctcaattcaccatttcgaactttatacagaaggtttttccgtaccagctccttctacctataccgctgttgaagcacctaaaggagaatttggtgtctttctggtcagtaatggaagcaatcgtccctaccgtcgtaaaataagagcacctggctctgcccattcacaaggactcgattctatgtccaaacatcacatgccagcagatgtggtcaccatcataggtactcaagatattgtgtctggagagatcggtcgagtggtctccgttggagatgggattgcacgtgtttatggattgaacgagattcaagctggggaaatg

SEQ ID NO: 26307 - DNA, 367 bp, Glycine max
  Peptide Sequence Number=SeqID_117992
tcaaggtgcaccttttgagggtaccattgttgatgacgggatgtttgattactctagtcatgatgcccgccgcatggtctgcattgaccaaattttgatgccttgttcttcaactcttgctcaagcctctggggaggacttgattctgatgtgggctttcttgaccggtcatccaatcgactgggcccatctggttcattactgcatgcataaggcattgcggtctagtgcacctctcccttaccctcagcttccttttgtgctagttaaatgctcctttgctattggtactggtgcggtaacctccttaggctattgtaaggacgtagatgggcattggctgaagaaggacgcgcaacctccataa

SEQ ID NO: 26308 - DNA, 381 bp, Glycine max
  Peptide Sequence Number=SeqID_117993
atgaccataatttgtctccgcatgtcatcgggctcgccgcctctggatgacaaaaggtgcagaatgaccataatttgtctctgcgtgccatcagactcgatcgtctctagatgcgaaaaaggcgtgcggatgaccataatttgtctccgcgtgtcatcgagctcgccgcctctggatgacaaaaggtgcaaaatgaccataatttgtctttgcgtgccatcagactcgatcgtctctggatggcgaaaaggtgtgcagatgaccataatttgtctccgcatgtcacatgacctccgggtcagattgtggggcggccgacaaaagcgaggctcttgctcctacgtatcctcaatttgtgatgaggaactcagacctacgtag

SEQ ID NO: 26309 - DNA, 114 bp, Glycine max
  Peptide Sequence Number=SeqID_117994
atggtttcaatgaatggcatcaaaggttcatggactccattgaagagtttacaagagatatgggaaactcaagtgggttgcatgaggacactggaattgggagtgaattcgtaa

SEQ ID NO: 26310 - DNA, 332 bp, Glycine max
  Peptide Sequence Number=SeqID_117995
ttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacgggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 26311 - DNA, 345 bp, Glycine max
  Peptide Sequence Number=SeqID_117996
atgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattatgcgtaaggagaaaataccgcatcaggcgccattcgccattcagctgcgcaactgttgggaagggcgatcggtgcgggcctcttcgctattacccagctggcgaaagggggatgtgctgcaaggcgattaagttggtaacgccaggttttcccagtcacgacgttgtaaaccgacggccagtgaatttgtaa

SEQ ID NO: 26312 - DNA, 195 bp, Glycine max
  Peptide Sequence Number=SeqID_117997
atgtcagtgaaaaaccaccttgggcacttaggagtacataacaagacacaccacacaatgggtttgtcaggcttaaaggagcactcaaacccggtgacccccaaggcctacactccgaagagtccgtcaaggcctctccctcctaattcaggtccaacccctaaaatcattttagcatacagactctatctatga

SEQ ID NO: 26313 - DNA, 483 bp, Glycine max
  Peptide Sequence Number=SeqID_117998
atgagttctggatgtttgctagttgatccctacggtcaaaatggcgtcttattgacgtcgaccaccaaagttttctgcctttgctctgttttgcttggctgtgatagcttgtgctgtgtgaatgtttgtttttgcttggatgttgtggaagcttggggaggattgatggcgcaccccggtgttgagagaaacgaggatatgggctacgtgggagtacgtgagctcagtttggagggtgggcaacaggggaggagtggtacctggagatattgtcgcgggggtcaggagaccttggggacgtcaggtgggggtgctatttgcccaaaacccaagcttgaccaatccccgacccaaccccggcatagtcggtcagtgaaaaaccctggaatgttccctaaaacaggcgagctcctagcagtcaacagaaaaaaaggaacaaaagaccacaaagcaaggaggcttgtggtggctggccagctatga

SEQ ID NO: 26314 - DNA, 717 bp, Glycine max
  Peptide Sequence Number=SeqID_117999
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggaggatgttgtacttagaaaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaaa

SEQ ID NO: 26315 - DNA, 210 bp, Glycine max
  Peptide Sequence Number=SeqID_118000
atgggagaagtactcaatagtagaaaaccaacaagaaatccttttgctaagcgcaagcctcacgctaagcacatcttttgtcatacgctaagtggagagtctctagcgcttaccgctcaacccttgcatcttaggttgatttggtctgctaagctagccaaggctgagctaagcccatttcaattcgatttgaattgggctaagcgatga

SEQ ID NO: 26316 - DNA, 267 bp, Glycine max
  Peptide Sequence Number=SeqID_118001
atggccaaactctctaaaaagtccccagtggagtcgccaactgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaactttttagtgaaaaggttcgggagttgtatttacgcacggggaagggtgtttccctttgctcctacgtattcctcaatttgggatga

SEQ ID NO: 26317 - DNA, 672 bp, Glycine max
  Peptide Sequence Number=SeqID_118002
atggcgagtcaagaagagtgggtcccgtttgcggatatagtagctttgctaatctttggggttgtcctctttgcgaacgtggacggtttggtggacctagccgcaattgatgcttttgaccgaagagtagattgggaccaatacttggctgggataggaggcaacacaatcaactggtttcctcgatggaaggaaggaaaggagggagttcccttctcatgtggggactacccaaacattccattgatagggacaaggggttgtattaactataatcccgcacttgctataagacagttagggtaccccatgaggggagcaccgacggaagagagcctctcgcctttccttgtgagagatttcagcgtgcaaagtttcaagatcgtacacagagtccataaagcagttcatacacgagggttagattggctctccaagttgaaaattatcaacgaggagaacttcgaagctccagaagaggatgaagaagtccaagctctaaaatcagagctaggaaaggcaagactcgccaaagaaaaattcaagttagtcgctacagacatccggaaagagtgtgccggattacgagaggaaaatgcggctaccacaagagccctcgaacgagaaaccaagagggctcgcaaggaagagcatggccgagataaattctga

SEQ ID NO: 26318 - DNA, 507 bp, Glycine max
  Peptide Sequence Number=SeqID_118003
atgagtacgaccgggcgtgggaggcactcggtcctccggattttcaagggccgccgggggcgcaccggacaccacgcgacgtgcggtgctcttccagccgctggaccctacctccggctgagccgtttccaggtgccgttcacatggaacctttcccctcttcggccttcaaagttctcatttgaatatttgctactaccaccaagatctgcaccgacgaccgctccgcccgggctcgcgccctgggttttgcagcgaccgccgcgccctcctactcatcggggcttggtccttgccccgacggccgggtataggtcgcgcgctttagcgccatccattttcgggctagtgattcggcaggttagcgcgcagttgggcaccgtaacccagcttccggttcatcccgcatcgccagttctgcttaccaaaaatggcccacttggagctctcgattccatggcgcggctcaacagagcagccgcaccgtcctacctatttaaagtttga

SEQ ID NO: 26319 - DNA, 225 bp, Glycine max
  Peptide Sequence Number=SeqID_118004
atggggtcagaaatctaccctgaggttcatgaaaacctatcgcaacgtgcccttttgcgggcgagcgaggcgagactcgcgggtgcggtttccaaaggaggaaagatgcgcggagtcgccaccaacgaaggtattagcacctctcacgtcgacaaaagcggggcttttgctcctacgtaccctccatcaaagaggaaatcagacctacgtagttctttcttaagc

SEQ ID NO: 26320 - DNA, 911 bp, Glycine max
  Peptide Sequence Number=SeqID_118005
cattcctcaacacctctcagatattcacgaaaccactccaaaagctctgcttctccatggctacctcaccaaaagaaacttcagctcctggttcaccctctataccatcatctccgtcatccaccaaagcaccatcaaaccaggaacaacctgaattcaatatccaacccatacaaatgattcctggtccagcccctgttcctgagaaactggtccccaaaagacaacagggagtgaagaattctgaaaaccctagctttgcaacaagccctagggaagaagacactgagatggataagaagatccgcaatgtcccaacatcttccaccccaaatgctgaagtcctctcttcatccagtgaagagaaatcaacagaggaagaggatcaagccacagaggagacccctgcactaagggcaccagaacctgctccaggtgacttcattgacctagaagaagtagaatctgatgaggaacccattgccaaaaagttggcacctggcattgcagaaagattacaaagcagaaagggaaaaacccccattactaggtctggacgaatcaaaactactgcacagaagaagagcacaccaatcactcctaccacatccagatggagcaaagttgcaatcccttccaagaagaggaaagaaatttcctcatctgattctgatgatgatgtcgaactagatgttcccgacatcaagagagccaagaaatcagggaaaaaggtgcctggaaatgtccctgatgccccattggacaacatttcattccactccattggcaatgttgaaaggtggaaatttgtatatcaacgcagacttgctttagaaagagaactgggaagagatgccttggattgcaaggagatcatggacctcatcaaggctgctggactgctgaaaact

SEQ ID NO: 26321 - DNA, 315 bp, Glycine max
  Peptide Sequence Number=SeqID_118006
atggtgatatcatggttttcattaaggcttgtagtgagctcaaaaaaggaaagggaaacaaggctcaaaagggctatcaaaggaattaattcaaggaagcatcaacaagaatcaagccaaggctattgtgcaagcaatcaatggggcaaaacacaccaaatgattatgatgatggatggctcaaattctcacaaaggagatgaggaaaagaaaaactctttaagttgtaatggggaggaaggtatggagaaaggaaaagtgctcaccaactccctaaaggaattagaggagcaatggggtataagtgcatattaa

SEQ ID NO: 26322 - DNA, 444 bp, Glycine max
  Peptide Sequence Number=SeqID_118007
atggggcgcttagcggatgatgcacttagcccagaagatgagtggctgaaaacttcccttcttagacaacctccacatcttctcctttgtaaaaggacacttgttagcactgccatacctcttgagcttgatgttattcctcaagtaaaggagttgttggatgaggatttggtttgtaaaagcttaaatccttgtgctttgttggtgtccaaaataggtattattaggcaccaaatccctaagataggtggtataatgaatgtgttgagtagtgcaaccctcttttgtaaagtcacccatgcacccaacatcttcatgattcgcatacataggaactcattagggattcccacagacagtaaaagaataaaggtcattcctgagtggcccattggtgatcaagggagtcccatatttttctatacttctagcaccacacattaa

SEQ ID NO: 26323 - DNA, 468 bp, Glycine max
  Peptide Sequence Number=SeqID_118008
atgatacgcggagataccttacggttatccgcacccttgtgtcatccagaggcggcgggcccgatgatacgcggagataccttacggttatccgcacccttgtgtcatccagaggcggcgggcccgatgatacgcggagataccttacggttatccgcacccttttgtcatccagaggcggcgggcccgatgatacgcggagataccttacggttatccgcacccttttgtcatccagaggcggcgggcccgatgacaagcagagacaaaatttggtcattctgcacccttgtgtcatccagaggcggcgggcccgatgatacgcggagataccttacggttatccgcacccttgtgtcatccagaggcggcgggcccgatgatacgcggaaatacccgagtggttatccgtataaatattcttttgctatctgtaagacagaacgcttgatagcatgcagagactga

SEQ ID NO: 26324 - DNA, 1173 bp, Glycine max
  Peptide Sequence Number=SeqID_118009
atggccccgaggaagcttgcctcaaagaggtccaggaaggacaaggcggccgaaggaactagttccgctccggagtacgacagtcaccgctttaggagcgctgtacaccagcagcgcttcgaagccatcaagggatggtcgtttctccgggagcgacgcgtccagctcagggacgacgagtatactgattttcaggaggaaatagggcgccggcgatgggcaccactggttactcctatggccaagtttgatccagaaatagtccttgagttttatgccaatgcttggccaacagaggagggcgtgcgtgacatgagatcctgggttaggggtcagtggatcccgttcgatgctgacgctatcagccagctcctgggatatccgatggtgttggaagagggccaggaatgcgagtatggccagaggaggaaccggtctgatgggttcgatgaggaggccatcgcccagctgctatgtataccggggcaggattttgcccggactgctgcagggaggcgagtgcgaatcatgcgcaccaacatgaccaccctgacccagatatggatgacgttgctcctcagcaacatcctgcccaccgatcataattccgacctccccatgcctaagtgccagctggtgtacgccatcctgacacggatgagcatccatgtggctcagttgatcgctgatgccatctatatttttgcagactctgccagtcgttcggagtcccgttgcacctaccaagtgattcggccgcccatcacccgggcttttattgagaagtactgtacccagagacaggctcagggtgatgctccacaggccgcaggcgcgccaccaccacctcatcaggctggccaggctggggcatttgacatagagcagtatttacggcatttggttcgccagcaggcggccaaccaccgagcacatgtacggacccatgattgtctgtaccagatgagccttagcatgcagagccagggcttcgctcctttttcatgccctactccagaccagttcagggcagaggttgcatggcccggagattggcccgaggcccaagcaggagaggcacccccagaagctcccggcgatggagaagaagcccacgaggatgaggagatggctgatttgcttgacttcttgggagggagtggagacacgtga

SEQ ID NO: 26325 - DNA, 348 bp, Glycine max
  Peptide Sequence Number=SeqID_118010
atggtcatcattgtcaatgcggaagcttgtggttacgtgagcatgaactactaccaatatatagatgttgtttacacaaatgagcacatcttaaaagcttacaccgcacaatggtggcctcttgggaatgaagcggctattcctccttctgatgaggcatggacacttatccctgacccaactacaattcgtgcgaaaggtcgcccaaaatcaacaaggataaggaatgagatggattcggtcgaaccatctgagcaccgaacaaaatgtagtagatgtggagccgaagggcataacaggcgtcgctgtccaatgcaatttgagcatgggagttgttcaaatcattga

SEQ ID NO: 26326 - DNA, 336 bp, Glycine max
  Peptide Sequence Number=SeqID_118011
atgctcccacataccaatacaggaggcccctccgataatccaaagactgttcaggctaatttgtctgtctctcctcatagaaaacatgtcttgattgcaaatcatgttcctgtccttcataattcttctgacctcaaagaaacagggaacactgagtttggtgatcctatagaagaggggtttgttcaggtgaaaacaaaacaccagaaaaaaggtaaaaaagtgcaactcataaagacaacccgtactgaggatatgcacgctaatgtccaaagaggaagaaatcataaagctataactagggtcagggaggcttcctcccgttcgaatccatga

SEQ ID NO: 26327 - DNA, 888 bp, Glycine max
  Peptide Sequence Number=SeqID_118012
atgtctcctttccttgtgagggatttcggcgcacaaaattccaagactatacaaagaatccataaggcgtgggaaaccccgttaaagaaagatcaagagcttagaggcattcgtaatggcatcattggtgggtaccacgaatggatgaaagttcatatacgaggtttagattggctcgccaagttaaaagtcgtcagcaaagagagttttgaagcaccggaagaggacgaagaagtccaagctctcaaaagcgagttaggaaaggcaaaacttgccaaggagaagttcaagttggccgctacacacgttcggaaggagtgtgccgggttacgggaagagaatgcaattaccgcaagagcccttgaacaagagaccaagagggctcgcaaggaagagtatggccggaacaaatttcgcggagctctatggggtagcaatagtgaactcaagttgcgaaaggaagaaagggaccagtcgcgagcacatagcatggttttgaaagaggagttagttgcctgttcaaggtccaaaaggagcttgtctcagcgtttatgcgagacggagaccaacatgctagctatcatcgccaagtaccaagaagagttaagtctagccacggcccacgagcatagggtcgcggacgagtatgcccaagtatacgtggaaaaagaggctagaggaagggcgatcgactctttacaccaagaggaaaccatgtggatggaccggtttgcttttaccttgaacgggagtcaagaacttccccgattgttagccaaggccaaggcaatggcggacacctactccgcccccgaagaaattcatgggcttctcggctattgtcagcatatgatagacttaatggcccatataattagaaaccgctag

SEQ ID NO: 26328 - DNA, 261 bp, Glycine max
  Peptide Sequence Number=SeqID_118013
atggctactcagttgaaccaagctcagtcccaaaattctaaaaaattgccttcacaaactctgcagaatccgaaaaatgtgagtgccatcaccttgaggtctggcaaccaaattcaagtgcctccaccagtagtagcacctgcacctgaacctgtcaagcttcattctacacctaaaaaagaagataagatagttgcacaaaagaggaggcttcctgatcagggagctaacaaaaattttcatgcaggtggaccttcttga

SEQ ID NO: 26329 - DNA, 369 bp, Glycine max
  Peptide Sequence Number=SeqID_118014
atgtcatctattgtttgcagggattgtgcccgcaagacacctagtggacccgaagaaggccaacagggtcttggagttgccagctctaaatacgggtctctgtcagttctagggagtgcctgtcgcccccagcaaagtcatcaggcccccctaccaatcgagctttcatcagaagtactgcgcccccaggcaggcgcagggcgaaacaccacagcagcattgggatggccggtagcgagcaatagacacaccgccaccacctctagagttcacctcagctcatccataaaaaggcatccagctcaagacgttaaagaagcgctactaggaggcaacctagtaccttttgaatctatgcttgttatttga

SEQ ID NO: 26330 - DNA, 171 bp, Glycine max
  Peptide Sequence Number=SeqID_118015
atgggggagatgcttgccacccagctcgcccaggcgagcaaggtgccttcctccagaagcaaccgccttctggaggaatcttctggagggcccaaattacataatcatcccttttttgacttacggaatgttacggaacctcacgaattgtgcaacgatgcttccttttga

SEQ ID NO: 26331 - DNA, 263 bp, Glycine max
  Peptide Sequence Number=SeqID_118016
atgacactatgcataccggggcaagatttcacccgtgccgctgcaaagagacgagtgtggatcatgcgcaccaacatgaccactattacaaagatatggatgatgttgctacttagcagcattccgtccaatgaccacaatgtcgatctccctctgtggaactctggttacgggcccctgttagtcctacagggtgcccgttccccccagcaaggtcacgccatcatgacatatgatgcaatcctatcccgcaagggcattgg

SEQ ID NO: 26332 - DNA, 397 bp, Glycine max
  Peptide Sequence Number=SeqID_118017
gattcgaccatctaaggttgggatgattcctccatccgggattgtacctgttgctggagagcataagcttcaagctgttcaattgcttcagattgttgcacagaagggcaaaggttaccaggttaatccaatgggcatttctagtttaccttcaacttcttatcacttcctgatgaacttcgtggctacttcatgcataactcctctaagcaatagcatcacttctgttcttcaagggaaggttgcggaggggcctcaactatttgttgtttctggggctgttgctgttgttgttggtgctggattggtggaggaacgtatggtctgcttgggccaacaacattttgaaaataaggctattgttgttgctgctgttgtgaaggattcgaccatctaa

SEQ ID NO: 26333 - DNA, 276 bp, Glycine max
  Peptide Sequence Number=SeqID_118018
atgaggcttgttatgaaacagaatgcatcgacgtcagcagagtctcaattgtcagaatatttccagcacgcgggttcagaatatgccagtgaaaaagaggtcatcgcgctgatttacaaacagctggcggcggtgaaactgcgtgtgagcaataaagatattattctggccctgctggagcgattagagtctgaacatgacgtggttcagctggatatttatcgccaggcactggaacttattgttcagcgcacgcctgacgatatcgcttcctga

SEQ ID NO: 26334 - DNA, 1155 bp, Glycine max
  Peptide Sequence Number=SeqID_118019
atgggggccggcggcttctttcccggtattgatgcgctgccgctcaccggccagtacacccattactcgctggacaagaaaacgcataagccaaactacgtaacggattctgccgcgtcggccaccgcctgggccaccggcacgaaaacctataacggcgcgattggcgtcgatgtcaacggcacagatcaggtcacgctgcttgaactggccaaagcagccggtaaagccaccggcaacgtctcgaccgcagaactgcaggatgccacgccggccgcgctgatggcgcacgttacctcgcgcaaatgctacggcccggaaaaaaccagcgagctgtgtccgggtaacgcgctggagcagggcgggaaaggatcgatcagcgagcagctgctgcaaacccgtcccgacgtcacgctgggcggcggtgccaaatctttcgctgagcgggctaaagcgggcgactatcagggcaaaaccctgcgcgagcaggccgaaatacgggggttccagctggtcgataatctcgccgcgctgaacgcggtacagcaggcgaatcaacatacgccactgctggggctgttctcggagggcaacatgccggtgcgctggcaggggccgaaagccagctatcacggtaatctggataaaccggtggtgacctgtgaggtcaacaaagatcgtccggcatcaatgccaaccctggcgcagatgacgcaaaaagccatcgacctgctcagccacaacgacaacggcttcttcctgcaggtggagggcgcgtcgattgataagcaggatcacgccgccagcccgtgcggtcagattggtgaaaccgtcgatttagatgaggcggtgcaggtggcgctggcgtatgcgcgcgagcacggcgatacgctggtggtggtcaccgccgatcacgcgcacagcagccagatcgtcgaaaacggcaccaaagcgccgggtctgactcaggcgctcaacaccaaagatggcgcagtgatgaccatcagctacggtaactcggaagaggattcccaggagcacaccggcacccagttgcgcatcgcggcctacggtccgcacgcggcgaatgtggtcggcctgaccgatcagaccgacctgttcttcacgctaaagcaggcgatggcattgaagtaa

SEQ ID NO: 26335 - DNA, 567 bp, Glycine max
  Peptide Sequence Number=SeqID_118020
atgactacattagcgcctgcgcggtcatacccggccgtaaaatcgcgtggtgaagatgtgaaaaacttccttacccgccagcgcgcgcgtattgatccgcagatctatggcttcagccggcaaaaccagcgggataaccgtcagatcggactgcgtcgccgaagaagtggcacagctggcggcggtcatcgcgtcagctggtacacctgcagcgggccggcagcagcagcggctttaaaggcgatcattcagtactttcggcccgcacgtcgcgtttcagcgtcatccgtcagacagctaccgacaccaccggcaccggcacacgcagcgagtactcaagcggccttccagttccggaaccacccggccaagcctttcagcatgcgccgctggagtacggcacaatcgggacagcgcctgccgcacgcgtcgccgcgcaggatctttctctggctggtcgtgcagtcgcctgactgttggtataggcatgggtggtgttcatcagaccgtgctctataccaaacgcctgatgcagcacctgcgcggcgggcgccaggccgttggtag

SEQ ID NO: 26336 - DNA, 3061 bp, Glycine max
  Peptide Sequence Number=SeqID_118021
caggcagggtttgatgttggccgccaggcgcaggccggcatcgtgaaacgcctgactcatcgcttctggctgcggcactttgtcgtagttccagttgaacacatagcgcttgttattgatggaggtatagcccgaagagagctggaaggagtcgcacggaatagcgtgctcttcgcacaggcggatgaagttcatcagttggttttgcgcgtccggcgcatcggtgtagtgcatggtcgagccgctgtatcccagactccatttggggccgaacagcgttttgccggtcaggcgtacgaaggttttggtgatatccagcacccgcttaccgacaaacaggtagtaatcaatatcgccactctccgcctgccagcggcgatacggctggtgatagttatccagctcgttacccagatcgaaccagctggtgctgaggttatcgtagaacaggccaaagctgacgtcgttacgccgcgtgagggtgaagggcacatgtttgtagagcggatcggtggaggaggcgttgtaacccatagcatccagattacgcatctcatagcgtttgccgttgcgttgcagatcgccggttttttcgcccagaccgtagtagcggtcgtccgccatgcggcgctgatagtgcgccacgccgtcgccgtgtgcgttgatctgataggcgctggtggggcgatcgccggtcagcagttgccagtggccagcggcatcacgcgtaaagccgggcaggctaaacccggccaggctgtcgcgcggacgcccttcccacggaacatcctgttccggcgcaatgctccaggtgcggtccagactgtagttgccgtggcgcttgatcaccacgcggaacagacctttttccagcacgtacaggcacagatggtgtttgccatcgacgttaagcaccacatggaagactgcaccgatcaggtcaaagaagcccatggcgacaaacagcgggttaaagccgattttgtcagccgtcacgccaatcaccagcgaaaacaggaagctggagatccaggcaaacgagccgcgcatgccattcaccgtggccatttggcccttatcaaatttttccaccaccagcgcactcaacatgcaggaaatgatctgatgaccaaaaccgccaatcgagatcagggcaatcgcgacgtaggggtctttggtcatcgccaccagcgccagcgacagcatcagaaaggcgccggtgaccgagctggcgacaacggaatttacctgcctgaagccaaacagccgggtatagatgcgcgtcaggtagccgctggctgcactgccgagatccgccgcgaggaacggcagccaggcgaacatggcaatctgtttcaggtccattcccaggtcttttgccagatagagcggcacccagaaactcaacacgccccatgccggttcagccataaaagcgggaatggcgataccgtaaaaacgcttgtttctggagacggttttcagggctttgaaaaagggcagtttgaccgccggtggctcattatcctgacgaataaaggccagctcatcgctgctgagattcgggttacgttccggatcgcgatacaacagccaccacagcaccacccagcccagagccagacagccggtaaacaggaatgcgccctgccagccgaacgaggcgtgggcaaagtagatgatgggaggtgccagcatagcgccaatcgagaagccgacgccggcccagccggccgcgatcggacgctcttttttcgggaaccattcaccaatcactttggcgttggccggcgtggcggccgcttcagctccgcccatgacaaagcgcaagatggccaggtgcaaccagctggcggcgccggcatggaacagacaggccagcgcccagatggtggcgcagatgaagaagccgagtttgaggccaatgacgtcaatcagccagccgcagattggttgaaagaagttgacggtgacaccggcgagaaacagcaccagcacccaccagcgcagatgacggatgacgcgtttcgtgccggttgcggcaatccctggattcaaactgcggttcatcggattctccattcattattaacagcatgtgtgagcaacgtctgtgactgcctggccggaggtggagtccataccggccagcgcataaccctggcccttgattgccgggcgtggcgtgatgcgtcctgttttacctatccgccgggagtgaaccacagcactttttacgactcagaaagcgcttcgcttgtaaaattggtcaaccaaaatggaagggctttgaggatgatcctcaggcccgcaggagagaacgacatgaagcagacctggcgctggtatggccctaacgatcccgtttcactcgccgatgcccgacaggcgggcgctaccggcattgtgactgccctgcatcacatcccgaacggcgaggtgtggccagtggaggagattttgcagcgcaaagcgatgattgaggcggccgggctggtctggtcggtagtggagagtgtgccgatccatgaggagatcaaaaccggcagcgggcagtgccagcagtggatcagcaactatcagcagtcgctgcgcaatctggcgcagtgcggcatccacaccgtgtgctacaacttcatgccgattctggactggacgcgcaccgacctggcgttcgagctgccggatggcgcgaaagcgctgcgcttcgatcagattgaatttgcggtatttgagctgcatatcctgcagcgccagggcgcagaaaatgattacagcgctgacgagatagccgaggccgctgcgcgcttcgccagcatgagcgaagagcacaagctgcggctgacgcgtaacatcatcgccggattacctggcgcggaagagggctacacgctggcgcagttccgtgctcagctggcgcgctatgacggcatcgacaaagcccggctgcgcgagcactttgccacgttcttgcgcggcattatcccggtcgctgaagaggtcggtatccgcatggcggtacatccggacgatccgccgcgcccgatcctcggcctgccgc

SEQ ID NO: 26337 - DNA, 877 bp, Glycine max
  Peptide Sequence Number=SeqID_118022
atgccgatctatgattaccactgccacctcaatccgcaggagattgcagaagaccggcagtttgccaacctcgggcaaatctggctggagggcgatcactacaaatggcgcgcattgcgcgcggcgggcgtagaggaatcactgatcaccggtaacaccaccagcgattacgataaatacctggcctgggcgcagaccgtgccgaaaacgcttggcaatccgctctatcactggacgcatctggagctgcgccggccgttcggtatcactgacacgctgtttggaccggaaaccgcaccgcgcatctggcatgagtgtgcggagaagctggccacgcctgaattttccgcgcgcggcatcatgcgccagatgaacgtacgcatggtgggcaccaccgacgatccgatcgactccctgcagtaccatcgtcagatagctgaagacagcagctttgatattgaggtggcaccgagctggcgtccggaccgggtgttcaagattgagctggaaggattcagcaattacctgacccggctggaagccgccgcggatgtcagtatcgacagctttgatgcgctgcgtgtggcgttactgcgccgtctggaccacttttccgcccatgactgccgcgctgccgaccacggcattgaaacgctacgctatgctgcggtgccagccgacagcgtgctggatggtattctcgccagacgccgcagcggggcggcgctgagcgagctggagattgcgcagttcagtaccgctgtgctggtgtggctgggcgcggaatatgcccgtcgtggctgggcgatgcagttacatatcggtgcgatccgcaataacagcacgcgcatgttccgtcagctcggcccggacagcg

SEQ ID NO: 26338 - DNA, 1407 bp, Glycine max
  Peptide Sequence Number=SeqID_118023
atggcaagtgtaagtaacctgaacgctggaacgaacctcggcttaagcgatttatatgaccagctgcaaacggcggagcaggctaacctgacgccgattacaacacaacagacttcttataaagccaagctttcagcatggggcatcgtgcagactgcactgcaaaaagtgcagactgcggcggcagcattaaaagacacttccgctatcgcctcgaccaaagtcagcagcaccaacaccgcgttcactgccacgctggccaatgatgcggcggccggtaacttttcggtagaagtgacccaactggctaaaacgcagtcgcttctgtccaaaagtgccacgagcaaagatgccgacttaggcgatagcagccaggcttcacggactattaccattacgcagccgggtcagaaagacccaatgaccatcacgctgagcaaagatcaaaccagcctgacggacattaaagatgcgattaacaaacagcagggcagcgttaccgccagtatcatcaaatccgatgacaatacctattatctggcgctgacctcgcgcgataccggtaccaccaacgagatgacggtgtctaccgatgacagcgccctggcgcagtacattggttttaccaaaggcggcggcagcaatggcatgacggagcaggtggaagccgccgatgccaaattgagcatcaatggcgtcgccattacccgcagcagcaacaccattacagatgcgccggaaggcgtcacgctgagcctgaccaaaaccaacactggcagcccggagaccttatccgtcaccaaggataacgcaccgatgatcgccgcagtgcaggcttacgttgacgcgtataactcgctgcaaaccactatcggtaatcagaccaagtacaccgccgtggatcagggcagtacctcgcaggactccagcaatggcgatctgataggtgatggcacgctgcgtaacattcagaccagcctgcgctctaagctatccaccagtgcccagagcggcggcagcatttccctgctgtcacagatcggcattacccaggatgtgaatggcaagctgaccgtcgacagcaccaaactgaacaaagcgctggatgaaaaatcggcggatgtggtcagtttcctgtccggtgacggcaaaaccaccggctttgctacccagaccagcaattacctcgatcagattctgggcaccaatggttccgtgcagaacgctaccgatggtattaacaagacgctaaaaaaactgtctgacgattatgaccgcgtaaacgcacagattaccgccaccatggcgcgctataagacccagtttaccaatctgaacacactggtctcatccatgacccagacgcagaactatctgacgcaacagttcgcgaacatgagcagttaa

SEQ ID NO: 26339 - DNA, 693 bp, Glycine max
  Peptide Sequence Number=SeqID_118024
atggtaatgggtgtgccggtaataacattgccgggaccaacatttgctgggcgtcattccgcttcacaccttgtacatgcgggaatgccagaattagtcgcaaaagactgggaagattaccgaaaaattgctaaagagcttgcgaatgattcagaaaaccttgctctgattcgatgccatttgcgagagattcttttatcatcacctgtatgtgatggtaaacgtttcgcacgtcacttttctgatgctatgcgcgctgtatggcagcgctatgccgagaacaagttacctgagtcgttgtcatttgatgaaaatgaagatgtttattttaaaggggaagaaagctcagttattctaaaccgaccaatgaaaatggacacctcatctttctgtgataatgaatcaggttttgcgttcaaccttgacggacaggttaaggcactagactatggtggtatacttgctcgacaagataaattcaaagcgataatggctacgaatggcactttcatgatcatcattgaccctctcggcatggtcgaagatcattaccttcctttaaaaagaaattcattgcagaaaatacaaatgcaattacttggtgatgggaatgatacccagctatatatgtgtcttgatgccaaatatagtagcgatctaacctgcaatcagcgtaacttcacagcaagaatg

SEQ ID NO: 26340 - DNA, 1724 bp, Glycine max
  Peptide Sequence Number=SeqID_118025
gcgtttctctattttcgtcgtaacgatgaagcgcgtaaaagcggacgctggaaagtgatcggcgaaacccgggtctacgcgatgctcgatccccgctcggcggaagcgcaaaacctgctcaacagccgcggttttaagctggtgctgatgcgtcagaccgaagaggatgagtactggcagctgtttgatccgcaggcgcatccctgtttcccgctgtcgcgcaagatccagttcttagtggtgctcagcacgccgcagcagaaaatgcccagcgcggtgataccgggtactgaagtggggcggcgcgtcaaggcgaaagtgttccagcgcgccagccaggcggagttcagcgcggcggtgaaagcgcgctatggtgcctgcattattaccggcacgcgtttaaccgagcgccacagctggccgtgggtggaagcctgccatatcgacacccaggagaatgaagagggctttctggcggataacagcgtcgacaacggcctgttcctgcgcagcgacctgcagcggctgtttatcaataaaatgattagcattgacgcagaaaccggtcaggtgctgtttaattccgcgctggaatgcgacgagtccattagccctttttatcaggcgcttgagggcaaaacctgtgcgctggtagtcaacgtgaacgatctctataccgccgatggcgtgatggataaacattcgctctggcagcgctacgttcctctggtgcggcatgaagcgctgcgcctgcaggtgcgtttgccagccagcgttgagcttgacgatctgctgcaggccggtggtattggcttactgaatgccgtggagcgctatgacgcgctgcagggcaccgcctttaccacctacgccgtgcagcgtatccggggcgcaatgctggatgagctgcgcagccgcgactgggcaccacgcagcgtacgtcgtaatgcgcgcgaggtggccggcgctatgcatcaggtagagcaagcgttggggcgcgcggctaccgagcaggaagtggctgagcggttgaatgtttcgctggaagagtaccggcagattctgctggataccaataacagccagcttttctcgtacgacgagtatcgggaagaacacggcgacagtgcggaactggtcacggaggggcatgaggaagccaacccgttgcatcagttaatggaaggaaacctgcgtgaacgcgtgattgaagcgattgaggcgttgcctgaacgcgaaaaattggtgctcacactgtactaccaggaagaactgaacctgaaagagattggcgcggtgctggaagtgggggaatcccgcgtcagccagttgcacacaatgggagccaaagttaaagccagaccgttaagtcgctaccttaaagactacaaacacagccaaagcaactgttcacactgtggcaaagttttagaccgtatggcgttagtgttccgcggccagatcatcaacaaagaggccatcgcacgcatggatcagatgattgacgatcaggtatggatgaaactccagccggaactgacggcgctgtgccgtttctgcagcgatattttttgtaatacccatccgaattacttcgatatcatggcgttcaaacaatatctgtttgagcagaccgagatgagtcacagtaccattcgtgaatatgtggtgcgtctgcgtcgtcttgatgacatgctgaaagcgaaaaatttcccggcagaaag

SEQ ID NO: 26341 - DNA, 732 bp, Glycine max
  Peptide Sequence Number=SeqID_118026
atggctttctctccgattcgtcgccagctggtgatgggaatgatggcggtcgcactggtggcgggcgtgaacgtaaaaagctttgcggcagaagatttgctggcgcaggtcaagagcaaaggtgagctgcgcgtcgggctggaaggcacctatccgccgttcagcttccaggatgaaaacggcaagctgaccggttttgaagtcgagtttgcccaggagctggcaaaacacctcggcgtgaaagcggatctcaaaccgaccaaatgggacggcatgctggcctcgctggattccaaacgtatcgacgtggtgatcaaccaggcgctgacgctgaagaaaaacgcgggctccatcaccaaaccggaagatctgtccggcaagaaagtcggcgtgggtctcggttctaactatgagcagtggctgcgcgacaacgtcaaaggcgtcgatatccgtacctatgacgatgacccgaccaaatatcaggatctgcgttcaggccgcgtggatgccattctggtcgaccgcttagccgcgctggatctggtgaagaaaaccggcaataccatggcggtggcgggcccggccttctcccgtctggaagcgggcgtggcactgcgtaaaggcaatgaatcgctgctgaaagcgattgatggtgccattgccgacatgcagaaggatggctcgctgagcaagctgtctgagaagtggttcggcgcggacgtcacgaaataa

SEQ ID NO: 26342 - DNA, 924 bp, Glycine max
  Peptide Sequence Number=SeqID_118027
gtcagcgatctggataaagaggtgttcggtccggtgctgcacgtggtgcgctttgcgcgcaacaacctgccgcagctgattgagcagattaatgcctcgggctatggcctgacgctcggcgtgcatacccgaatcgatgaaaccattgcgcaggtgacggccggggcgaaagtcggcaacctgtacgtcaaccgtaacatggttggcgcggtggtcggcgtgcagccgttcggcggcgaaggcctgtcgggcaccggtccgaaagccggcggtccgctctatctctaccgcctgctggcccatcgtccggacggtgctctgcgcatcacctttgatcgtcaggatgccgaacggccggtggacagcagcgtgcgcactacgctactgagcgcgcatcaggcactgcagagctgggcacaggataagccggagctgctggcgctgtgtcagcgttacgatgcgttgagccaggccggaaccgtgcgactgctgccaggcccgaccggtgagcgcaacacctttacgctgctgccgcgcgatcgggtgctgtgtatcgcggataaccagcaggatgcgctgattcagctggcggcggtcaccagcgtcggtagccaggcactgtggcaggatgacgagctgcatcggacgctgcgccagtcgctgccgaccgcggtgcaggcgcgcatcacgctggcgaaagatgtgctggcggcggagtttgatgcggtgatctatcacggcgatgccgatcagctgcgcagcctgtgcgaacagattgccgcccgcgaaggcgcgattgtgtcagtgcagggctttgcccgcggcgagaccaatctgctgctggaacgtctgctgattgagcgctcgctgagcgtcaataccgcggccgccggcggcaacgccagcctgatgaccattggttaa

SEQ ID NO: 26343 - DNA, 3789 bp, Glycine max
  Peptide Sequence Number=SeqID_118028
atggtgttgattggttttatcgcgtaccgctcaaccaaaaactttgacgactatattctgggcggtcgcagcctcggcagcgtggtaaccgcgctgtcggccggggcctcggacatgagcggctggctgctgatgggactgccgggcgcgatttttctctccgggatctctgagagctggattgccatcggcctgacgattggcgcgtggctgaactggaaaattgttgcgggtcgcctgcgcgtgcagaccgagcatcacaataacgctttaaccctgccagactttttcaccagccgcttcgaagaccacagcaaaattctgcgcgtcatctcggcactggtaatcctgatcttcttcaccatttactgtgcctcgggcgtcgtggcgggggcgcgcctgtttgaaagcaccttcggcatgagttatgaaaccgcactgtgggctggcgcggcagcaaccattctatatacgctggtgggcggtttcctggcggtgagctggaccgataccgtgcaggccagcctgatgatttttgccctgattctgacgccggtgattgtgattatcgccgtcggtggcctggatgattcgctggccgtgattgaagcgaaaagcctggaaaacctcgatatgctgaagggcctcaacttcgtggcggtgatttcactgctcggctggggccttggctacttcggccagccgcatattctggcgcgctttatggcggcagactcgcaccgttctattcgtaccgcacgccgcatcggcatggcctggatgatcctgtgcctggccggcgccgtcgcggtgggcttcttcggcatcgcctatttccagaaccatccggatcaggcggcgggcgtgagcgaaaacggcgagcgcgtgtttatcgagctggcacgtattctgttcaatccgtggatcgccggtattctgctgtcagctattctggcggcggtgatgtcgaccctgagctgtcagctgctggtgtgctcaagcgcgctgaccgaagacctgtataaaggtttcctgcgtaaaaatgccagccagaaagagctggtgtgggttggccgtttgatggtgctggtgattgcgctggtgtcgattgcgctggcctccaacccggagaaccgcgtgctcggcctagtgagctacgcctgggcaggctttggtgctgcattcggtccggtggtgctgttcggtgtgtgctggaagcgcatgacgcgcaacggcgcgctggccggcatgattatcggtgccgccacggtgctgatctggaagcagtacgcctggctcaatctgtatgaaatcatcccgggcttcctgtttgccagcatcgcgattgtcgtggtgagcctggccggtcgcgaaccgtcggctgaagcgcagcagcgtttaccctccttaacattcaagaggttggtgatgttcgtcccttttctcattatgctgcgcgaaggtcttgaggcagcgctcatcgtcagcctgattgccagctatctcaaacgcacccagcgcagccagtggttccccgcgatgtgggccggcgtgtttatcgctgcggcgctgtgcctcgcgctcggtattttcatcaacgaaaccaccggtgagttcccgcagaaacagcaggaactgtttgagggcatcgtggcggtgattgccgtggtgatcctcacctcaatggtgttctggatgcgcaaggtgtcgcgcaatatcaaagccacgctggaaaaatccgtcgatcaggcgctgcagaagccgggcggcagcgggttgccgctggtgctgatggtgttcctcgccgtggcgcgggaagggctggagtcggtgttctttctgctggcggcgtttacccaggatgttggctatgcgccaccgattggcgcggtgctgggtctggcgaccgccatcgtgctgggcatgctgatttactacggcggcgtgcgtcttaacatggcgcacttcttccgctggaccagcctgttcatcctgctggtggcggccggactggcggcgggggcgatccgcgccttccacgaggcgggactttggaaccacttccaggcgaccgcgtttgacttcagcaacacgctctctacccattcgatctttggcacgctgctggaaggcattctgggttatcaggaagcgccgagcgtcagcgaagtcgcggtatggctgatttatctgatcccggcgctgctgctgtttttcttcccggcgcgtccggcacccagcgccgcacgggatatgactatgacgattcgcttccgccgtaaggcgctgttgctctccatgctggcgctgtccggtgccgcttctgccgctgccgtaccgcaggtcacggtgacggtcactgacaagcagtgcgagccgatgtcgctcaacgtgcaggccggtaaaacccagttcatcatcaaaaacaacagccagaaagcgctggagtgggaaatcctcaaaggcgtgatggtggtggaggagcgcgaaaacatcgcgcccggcttcagccagaagctcaccgccaacctggaagcgggtgaatatgacatgacctgcggcctgctcaccaatccaaaaggcaagctggtggtcagcggtgacagccaaaccgccagcagcggcaagccagatgtgctgcagctggtcgggccgattgccgattacaaagtctacgtgatgggcgaggtgagcgcgctggtggccggcaccaaagcctttaccgacgcggtaaaagccggtgacgtggaaaaagccaaagcgctgtatgcgccgacgcgtgtgcactatgagcgcatcgagccgattgccgaactgttctctgacctcgacggcagtattgacgcgcgtgaagatgacttcgagaaaaaagcggaagatccgaaatttaccggcttccaccggctggaaaaactgctgttcgccgacaacaccaccaaaggcgcggacgcgttcgctgaccagctgtataaggatgtgcaggatctgcaaacccgcgtcagcgagctggccttcccgccagcgaaagtggtcggtggcgcggcaggcctgattgaagaggtagcgtccagcaaaatctccggtgaggaagatcgttacagccgtaccgatctgtccgattttcaggccaacatcgacggcgcacagaaaatcgttgatctgctgcgtcctctgctgcaaaaagccaatccgcagctgctggcgaaagtggacgcgaactttaagaagctgaccaccagcgaccgtaatgcgctgaaagggccaatcaccacgctggcggatctctccctgttgcgcggcactttacgcatgctggggggcgcggctgctgacgcagcgctttgcctttctctcccagggcggaccggcgccggcggtaccccctcccagctgccgccgctcgactccggcatcctgggggcggacatcgcgcccgataacctgaccctgacgctgtcggtgggtgattcactgttcgacgagcgcttcgggctggccgcgcataaacccagccagctgcagacgatgacacgctttcccaacgattcgctcgacgccgcacagtgtcatggcgacctgctgattcagatctgcgccaatacccaggatacggtgattcacgcgctgcgcgatatcatcaagcacacgccggatctgctggcggtgcgctggcggcgcgacggcttcatcgccgatcacgctgcattcagcaaagggcgcgaaacgccgatcaacctgctgggtttcaaagatggcaccgccatccggatacccacaatgcgcagttga

SEQ ID NO: 26344 - DNA, 696 bp, Glycine max
  Peptide Sequence Number=SeqID_118029
atgattatgaggggccaagacatttatagtagccaagataaggctactacttcaccttcctctagtgaaagtgaaaaagcaaaaaaggaagaatctagtgaagaaatctacccccaagaagaaggacaaccattagtggttaaagagaagtgtaaggaggtaagtgtctcctccaagaggttagctaagaaggaaactcattttacaataaagacaaacattaaagaaactttccctcttaggcaacctccacattttctcttttgcaaaaagagacttgctagcattgccaaacctcctgggcttgagtttattcctcaagtaaagaagttgttggatgagggtttggttcgcaagagcttaaatccttgtgcttttttggtgcccataataggtattattaggcaccaagtccctaaaataggtggtatgatgaatgttttgagtggtgcaaccttcttttgtaaaatcactcgtgcacctaacattttcatggtgtgtgtacatagggacccattaggtagtgatcaaggggttcccatgaaccctaagggaataaaggtcattcctgagtgtcccactccaccaagtgtcaagggaagacaccgagagtatcaagaacctctagatttgaggtcaaatcctttccaagggggaggggatgattcaatcctaccccccaagggaattggatag

SEQ ID NO: 26345 - DNA, 96 bp, Glycine max
  Peptide Sequence Number=SeqID_118030
atggaggttacatcaccaagggtattggatacaagactccaagaagattgggttagagctgctaaacaagaccgtagggttctcatgaacctcagg

SEQ ID NO: 26346 - DNA, 615 bp, Glycine max
  Peptide Sequence Number=SeqID_118031
atggaacctctccaaatgcaagccttccgcaagacttacggaaagatcttagagttgaccatagcagaggtatccatagaagccattgcatcactcacccaatactacgaccagcctttgagatgcttcacgttcggagacttccaattggtaccaaccattgaagaatttgaggaaattctaggatgtcctctcgggggaagaaaaccatacctttcctccgggtgtctcccctctttgagcagaattgcaactgtggtcaaggattcagcaagaggtttggaccgcataaaacagactcgaaacagcatagcgggcctaccacggaagtacctagaagacaaggcgaggggtatggccaatcaaggagattgggtcccgtttatggatgtgttagctttgctaatttttggggtcgtcctctttccaaacgtagatggtttggtggacctagcagcaatcgacactttccttgcataccaccataacaaggaaagtccggtggaggtagaacaatcaattggttcccccgatgaaaggaaggaaatgagggagtccttttctcatgtgagggtacccaaacattccgctgataggaacgaggggttgtattaa

SEQ ID NO: 26347 - DNA, 1188 bp, Glycine max
  Peptide Sequence Number=SeqID_118032
caaaacacgaggcatccatgtccgctccaaagccatcgctcgtgtgctgaaaagagaggaatagattgggaccaacttttggccgggataggaggtagaacaatcagttggttcccccgatggaaggaaggaaaggagggagtccttttctcatgtggagggtacccaaacattccgctgataggaacgaggggttgtatcaactacactcccgcgctcgctataagacaactagggtaccccatgaggggagcaccgatgaaagaaagcatgtctcctttccttgtgagagatttcggcacgcaaaatttcaaggctatacaaagaatccataaggcatgggaaaccccgttaaggaaagatcaagaacttaggggcattcgtaacggcatcattggtggttatcatgaatggctgaaagttcatatacgaggtttagattggctcgccaagttaaaagtcgtcagcgaagacagttttgaagcaccggaagaagacgaagaagtccaagctctcataaatgagttaggaaaagcgaaacttgccaaagagaagttcaagttagccgctacacacatccggaaggagtgtgccgaattacgggaagagaatgcaactaccgcaagagcccttgaacaagagaccaagagggctcgcaaggaagagtatggccgtaacaaattttgcggagctctgtggggtagcaacagtgaactcaagctgcgaagggaagagagggaccagtcgcgagcacatagcatggttttgaaagaggagttagttgcctgttcaaggtccaaaaggagcttgtctcagcgtttatgcgagacggagaccaacatgctagctatcatcgccatgtaccaagaaaagttaagtctagccacgacccacgagcatagggtcgcggacgagtatgcccaagtatacgcggaaaaagaggctagaggaagggtgatcgactctttacaccaagaggcaaccatgtggatggatcggtttgctcttaccttgaacgggagtcaagaacttccccgattgttagccaaagccaaggcaatggcggacacctactccgcccccgaagaaattcatgggcttctcggctattgtcagcatatgatagacttaatggcccatataaatttagaaaccgctaggaaacttggatggtctctcagatcttga

SEQ ID NO: 26348 - DNA, 311 bp, Glycine max
  Peptide Sequence Number=SeqID_118033
gcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtgggacccattccatccaggctctttgttggggacgctggaggatttcaaatgaacgtgggtggtctagtgcccccacattgttccttaaaatcggttgtctcggatgacgcttgccctggcgcttgctttgttcaacgcgatgctactactcttagttag

SEQ ID NO: 26349 - DNA, 267 bp, Glycine max
  Peptide Sequence Number=SeqID_118034
atgtccccagtggggtcgccaactgtcgcaacgtgcccttttgcgggcgagcgagggcgaggctcacgggtgcgctgtccaaaggaggaaagatgcgcggagtcgccaccaaagtttatttgtggaaaacgtcgaaaaaaccgaaggaaaccggtcaaaatgaaaattctaagttcggaagttgtatttacgcttgaggaaggtcgacaaaagcggggcttttgctcctacgtacccacctttggagaggaaataagacctacgtag

SEQ ID NO: 26350 - DNA, 267 bp, Glycine max
  Peptide Sequence Number=SeqID_118035
atgaaacttgcacataaatttgaggccgttattgcaatttttccttatgatagtgcagtgattgattttgggaaccttgaatgtggtcatcctgaaacactcttgatcctaagtttattgactcctaaaactttggtaaacaatcctagtgagttcaacatacataggaaggttgaaagtaagcccaaggcaatcaatataccatgcttaaagaaacaaatcgctggtgctggcagcttggacatacaaacttgtaaaaattactga

SEQ ID NO: 26351 - DNA, 450 bp, Glycine max
  Peptide Sequence Number=SeqID_118036
atgttgctaagtagcaatgtcatctatatctgtgtaagagtggtcatgttggtgcgcatggtccgcactcttctctttgcagcggcacaggaaccgttaaaagggaaactactggcccccttacccagaagtgcaagtctcggtttagcatttaagggccagaggaccttaaattcttttaaggcgtgcagccctctcaaggcgaggatgtgtagtcctttggaggtgagggcgtgcagcccgctgttggcgaggatgtgtagtcctcttcaaggcgaggacgtgagggcgtgcagccctctgatggaaaggacgtgtagtcctctcaaggcgaggacgtgtagtcctctcaacggtgaggaggtgagggcgtgcagccttctgatggtgaggacgtatagtcctctcaaggcgaggacgtgtagtcctctcaacggcgagggtaactag

SEQ ID NO: 26352 - DNA, 396 bp, Glycine max
  Peptide Sequence Number=SeqID_118037
atgtcccggtttgccacaattgtagcagaggaatggctcaccgggattattcttggcaggtggatgttgtctagcatgttagacccttggggggttcttgttgcggttggaggtattgctcacattgcggttctgattcttaaagtttttgcctataggcttcagaactgcacctgtgttcttccttttagagttgttgtgagacacaaccaacacttcatctttctaatcttgtctgtgtgcctcttcctcaatgcgcagacgtgtgatcagagactccaaagagaattctttggtcttgtgtctgagaaggtttttgaaatccttccagctaggaggcagcttgtctatgatgacagcaacttgaaattgctcatccaatgccataccctctga

SEQ ID NO: 26353 - DNA, 132 bp, Glycine max
  Peptide Sequence Number=SeqID_118038
atgtcggattacgaaactgtccgagggacaccatgtcccgacaatactgtctcgacatcaggtgtagcaacaggagctttgttgctgaatctatctttaggacacatgcaaggtgtaaggagataccattaa

SEQ ID NO: 26354 - DNA, 636 bp, Glycine max
  Peptide Sequence Number=SeqID_118039
atggaagagggattttcccatggttcagttccaattattttaggcaggccatttatgaaaatagcccaaaccaagatagatgtttatgctggcacattgtctatggaatttggtgatattgttgttcattttaacattcttgatgccatgaaacatccatctgaggatcattctatttttcgtgctgagataattgatcaaattgttgatgattatatgtttgattttgattctgttcttaatggtaggaaacatccatttttatctgatctacatacttgtcattccttatgcattaaatatgaatctgagtttgaatttgatcttgtatctgatttttatgctaagagtgaaattgaatttgagtctggtgttgtacctcttgatgttgatattttagagtcaaaatgcactaaccatgttgcaggaagtacatatacttatgacttgctttatgcggtacaggctgaggaaccttcttcttctcctaccctggttcctcccactgttcagccaccacccacaccagagttgaagcccttaccagcaaccctcaagtatgcttacttggaggataaatttctagtgatcatctttgcctcccttgatgctgagcaagaggagaatttgttgcta

SEQ ID NO: 26355 - DNA, 226 bp, Glycine max
  Peptide Sequence Number=SeqID_118040
attcctccagaaggctgttgcttctggaggaagcaaccctgctcgcctaggcgagcttgagctcgcctggggcgagctgggtggcaaaaaaatcctaagccgaggcgctttccgaaacggtttccgtaacgttttccgtgaggaatttcgcaaaggtttccgaccgtttttcaacgttcttcattcgttcttcattcgttcttcatcgttcttcgatcttcaacgg

SEQ ID NO: 26356 - DNA, 452 bp, Glycine max
  Peptide Sequence Number=SeqID_118041
aaatctactctgagctttggaatcctcaagccttagggaaaatcctgtccaatattggttcgcccattcgatctgaccatcttactgcttctaaggggtctatttcttttgctagagctttagttgaggttgatgcttctttggagctcatcgatgaaatgattgggcaccgcctcactaattgtaaaactgtcactgcaaataagcctgttctcatcagagcctgccccaccttggatcagccacaagtgggtgattcagcaatgcccccacataccaatacagcaggcccctctgataatccaaagaatgtccagactaatctgtctgtccctcctcacagaaaacatgttctggttgcaaatcatgttcctgtccttcaaaattcttctgacctcaaagaaacagggaatactgagttggatgatcctatagaagaggggtttgttcag

SEQ ID NO: 26357 - DNA, 639 bp, Glycine max
  Peptide Sequence Number=SeqID_118042
atgcttggggatggaaatgaaggaatgtctacactacctggattgaatcagatacaatttgaagggttttgtaggttcattgatcggggcttaccagaagggctttttaagtttccaaaaattgaggatacagatcaagaaattgaatttcaattatttgtagaaacatatcaattattagaacccttgataaacgaaaaagatgctgtatatgaatcgcttacatattctgctgaattatatgtatctgcgggattaatttggaaaagtagtagggacatacaagaacaaactatttttgttggaaacattcctttaatgaattctctgggaacttctatagtaaatggaatatacagaattgtaatcaatcaaatattgcaaagccctggtatttattaccgttcagaattggaccctagcggaatttcggtctatactggcaccataatatcagactgggggggtagattagaattagagattgatagaaaagcaaggatatgggctcgtggtcaaaagaaaatgccattttggagttttatcgacaatttgcttgtgttggtggagatccagtattttctgaatctttatgtaaagaattacaaaaaaaattttttcaacaaagatgtgaattag

SEQ ID NO: 26358 - DNA, 471 bp, Glycine max
  Peptide Sequence Number=SeqID_118043
atgccaatctccccctgtggaaggatcgcacccacaagacacccagtggacccagagaagtccagcagggccctgaggtttccagctctggttacaggcttctatcagtcctacagggtgctcatccccccagcaaggtcatgccatcgtgacatagggatcgtacccgcaagacacccagtggactcggagaagaccaacagggtcttggggtttccagctctgattacgggcctttgtcagttctacggagtgctcgtcgcccccaacaagaagtactgcgccccccagacaggcgcagggcgagacaccacagcagcttggggatggccgaaagcgagtaacagacgcactgccgccacctccaaaacccctcagctcatctacaaaagctggagtgttgcctacgacccgtgttcgaccagcaggcgaccgagtccaaagccaaaggtcatagtagggcacacctag

SEQ ID NO: 26359 - DNA, 669 bp, Glycine max
  Peptide Sequence Number=SeqID_118044
atggggacaaatcaaaatggcaaaaggttttatcaagtcaaggttaaaagtctagatgtcaccagcctcaaggaattgggacgattgatgggacctctccaaaggcaagccttccgcaaagtgtacgggaagattctagatttgatcgcaacggaggtatttacggaagctgtcgtatccctcgcccaatactatgaccatccgttaaggtgcttcacgtttggggacttccaaatggtacccactattgaagagtttgaggaaatactgggatgccctcttgggggaagaaaaccgtatcttttctccgggtttcttccctccttgagcaagattgcagctgtggtcggggattcgacaaaaaagttggatcgcatgaggcaaactcgcaacagcgtagtaggtctgccacgaaaatacttggaaggcaaggcaagggatatggcaagccaagagaagtggggcccgtttgcggatatactggctttgttgatttttggggttgtcctttttccgaacgtgggcggtttggtggacttagccgcgattgatgctttcctcgcatatcaccatagcaaggagagtctagtggtggctatcttgacagatttgtttgacacatttgaccggaggtgtgagaaaaacagtgcacggattgtctgttgttaa

SEQ ID NO: 26360 - DNA, 522 bp, Glycine max
  Peptide Sequence Number=SeqID_118045
atgtcacagaaaggatccaagaaaccacatagagaaagaaagaacaaggagaaaaagttcaagtcaaaatgtccagatcttgataaatcagctcacatgaaaaagttcttcaaaccagaagacatgaaagtattgatgagcacatgggaagaactggacaacacgtcatctgatgaagaaataaaggaagaagaagaagccaacctttgtgtgatggtagcgctacatcggaaaggattaaagaaaagcctgaaattctcaaatgataaacttaaacagtatgaggctttccaaaagcaacctcaagatgttgttacacttcatcgagagattgaatttctgagagaaactctatccaaatttgtgggaatcacagagaaacttaacaaaatgttaagataccccaaatgcctaattgtcaaatttggaaatggatatacaggaaaaaattatgctcatgaggaagaaaccatagtatgttatttttatgcgaaaggttggacacatgacatccaagtgtag

SEQ ID NO: 26361 - DNA, 292 bp, Glycine max
  Peptide Sequence Number=SeqID_118046
tgaagatgctgcagtgaattgcttcacagcagtaggagcatggagacagggggagcagaaagctgataatgccgcagtgaactgcttcacagcagtaggagcatggagacagggggagcagaaagctgatgtcacgatccacgatgtcggatacaatgtccaggacatcctgcccgaaaatactggagttgctgcacaatgcacaaggcaagataaaagaattgaagctgcaggatccacgatgtcggatacgatgtccaggacatcttgcccgaaaatactggacacataa

SEQ ID NO: 26362 - DNA, 225 bp, Glycine max
  Peptide Sequence Number=SeqID_118047
atggcttacactcacattccggattcacaagcgattctcctcaaatttcagccagcccgcatcaattggaccttgcaccttatgcttcagggccctacaatgctaaatagaatgccccggggctcctccatgataaccatacattgcgttcgagttgtatcctcagaaaaatggaggttgaggaaacctagcaggggttatggctaccattgcagtatcaagtag

SEQ ID NO: 26363 - DNA, 276 bp, Glycine max
  Peptide Sequence Number=SeqID_118048
atgtcaggatttacacgcaattctcctcaaatttcagccagcccgcatcaattagaccttgcaccttacgcttcagagccctaccatgctcaatggaatgccccggggcttctccgtgacaagcacacgttgcgttcgagtcgtattctcagagaaatggaggttgatgaaccttggctagggttatggctaccattgaattatcaagtagatatgggagcaagtcagcataggacactggaattggggtggtgttcgtcattggaagtgcggtag

SEQ ID NO: 26364 - DNA, 72 bp, Glycine max
  Peptide Sequence Number=SeqID_118049
ctttgagaagcatgtgatcctttggcatcatcaaaacattcagcttgatcctttgtctacatgttcaaactg

SEQ ID NO: 26365 - DNA, 624 bp, Glycine max
  Peptide Sequence Number=SeqID_118050
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagcttcacaagttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaggctgcaccggtgcgtcagcagaatatgtgatacaggatatattccgcttcctcgctcactga

SEQ ID NO: 26366 - DNA, 111 bp, Glycine max
  Peptide Sequence Number=SeqID_118051
atgggtattgaagaccaaaagattagctttgagctatttgatgaagaaaggatattgctggaccagaatgttggtctagaggtgaaggaaagcgaagagaagcatgtttag

SEQ ID NO: 26367 - DNA, 477 bp, Glycine max
  Peptide Sequence Number=SeqID_118052
acccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttagctctgcctgttgctttgatgatcatgataactcgtcggatcgcacggcctttgtgccggcgacgcatcattcaaatttctgccctatcactttcgatgttaaaaagctcgtagttggaccttgggttgggtcgatcggtccgcctccggtgtgcaccggtcggctcgtcccttctgccggcgatgcgctcctgtccttaactggccgggtcgtgcctccggattctgatcctattgtgttggccttcgggatcggagtaatgattaacagggacagtcgggggcattcgtatttcatagtcagag

SEQ ID NO: 26368 - DNA, 408 bp, Glycine max
  Peptide Sequence Number=SeqID_118053
atgcatcaatcaccctccctcttgcttccttcttggcctagcatgctttgctccgtggcttctaagtgttggaccaaactcctcttggatcttgagcaagcagctaactcctcctttaagaccaagccatgtactcgtgattggtctctttcctctctccggagcttgagctcattgttgcttccccacaaagctcctcggaatttatctcggccatattcttccttgcgagccctcttggtttctcgttcgagggctcttgcagtagccacattttcttctcgtaatttggcacactctttccggatgtgtcgcaacctacccttcggcgggagggcaacgcgtgactcgcgagatgcgtgttccacgaaaggaatacgcgcggagtcgccaccaacgtttatttga

SEQ ID NO: 26369 - DNA, 527 bp, Glycine max
  Peptide Sequence Number=SeqID_118054
ttggagcagagattgatagagagttccgagatttgaatctagcaatcgagatgcgacccaagagcttatttgtgggagcgttgcagattaccaatgaattcgtagatcacatacgcgaagctcaagagaatgacccgtttttgcaaggcaaggtgttagatgtaatgggggataaggatgtggagtttgagaaggacacaaccgggtggagtcgtcttagttatccggagtgcactaaccgacactccaagagtttacccaagacagttgacatgatgctgtgtgggttgatcgactcaccaaatgctcagttttttccggtagaatatgaagtattgagaagcgggaagcttggagttgtacatcaaggaagtagtgagggatccgaggttcacttcgcgattttggacaagtctacatcttggggacaaagctttgaagcttttcagcttgatcacagagtcctcaaatgcagagtcagacaaggaactcaatatgaggcaacgaagatggatggagttccttaa

SEQ ID NO: 26370 - DNA, 211 bp, Glycine max
  Peptide Sequence Number=SeqID_118055
gggaggtggttgccgcccagctcgcccaggcgagctcagctcgcccaggcgagcagggttgcttcctccagaagcaaccgccttctggaggaatcttctggagggtccaaatgggcctgggttcgggttttccccgattcttaaattcgggggtgagggtggttttggtattgctgataactgccctgtccccgcccccgccccacactga

SEQ ID NO: 26371 - DNA, 435 bp, Glycine max
  Peptide Sequence Number=SeqID_118056
atggaggagcgtgattggcatagggaattgtataagctgaagactcgtgtcgtaaaaaacaactgcaaccctgactggaatgaagaattgaccctttctgtaaaggacgttaaaaccccaatacatctgacggtttatgacaaagacactttctctgttgatgacaaaatgggtgaggcagagatagacttaaaaccatatgttcagtgtaagcagatgggattgggcaagctcccaaatggttgttcactcaagagaattcaaccagatagaactaattaccttgctgaagagagcagctgcatttggcaaaatggaaagattgtccaagaaatgtttttgagattgagaaatgttgagagtggagaaatacttgtggaaattgagtgggttgatgttgttggttgcaagggcttatcagaggtagaactttaa

SEQ ID NO: 26372 - DNA, 189 bp, Glycine max
  Peptide Sequence Number=SeqID_118057
atggaccctaagagaataaaggtcattcttgagtggcctactccaccaagtgtggaggaaaaaatccatgagtttcaagaaccgtctggatttgaggataaggtttctgcttatacttcttcctctagtgaatttagtgaagaagctcaaaaggggaagactagtgaagaactaccctcagaagattag

SEQ ID NO: 26373 - DNA, 333 bp, Glycine max
  Peptide Sequence Number=SeqID_118058
atggcttcaaacctgacacacatcgttttcaagcctggtaatcgattacaccccgtggtaatcgattaccagagaccatcttggcctcctgtcttcatttttaagccttgtaatcgattacccacccttggtaatcgattaccagagaccatacctcacataccaatcaaagttcacagctggccagccaccacaagcctccttgctttgtggtctttgttccttttatctgttgactgccaggagctcgcctgtttaggtacatcacaggttctcactgaccgactatgcccgggttggtcgggattggtcaggcttggttttgggcaatag

SEQ ID NO: 26374 - DNA, 153 bp, Glycine max
  Peptide Sequence Number=SeqID_118059
ggtgcggataaccgtaagggtgcggataaccgtaagggtgcggataaccgtaagggtcagtatgacaaagattatggggcggccgacaaaagcaaagctcttgctcctacgtatcctccaatgaggaactcagacctacgtagttctggataa

SEQ ID NO: 26375 - DNA, 141 bp, Glycine max
  Peptide Sequence Number=SeqID_118060
atggctggaggaaaaattgggggcgagggttttcgagagagtgaaaggttgcaggtgcagggaagcgtcgtaatcgattacacaaatatggtaatcgattaccagagaacaattttgccagaaataactgcttgtaattga

SEQ ID NO: 26376 - DNA, 291 bp, Glycine max
  Peptide Sequence Number=SeqID_118061
atggtggtcatcctgcccaagggaacacttagttgtctgggtcttgatgatgctccacagcctaaatcaaaggctcctgctaggtggattgtcgtcaagtgtaatagacaaaaaggaactactgagtgcggctactatgtcatgcactggatgtccaccatcattttaggaacttttacaaataattgggaagcgtattttaacgaccctagaccattggagcctgagagattaaaagcattgcggatccagtgggcacagttttatcttcgaattagagatcaggcctag

SEQ ID NO: 26377 - DNA, 565 bp, Glycine max
  Peptide Sequence Number=SeqID_118062
atgtcagcatcttccgatggagacttttcaagtctcacaagttatccagaactacgtaggtctgagttcctcattggaggatacgcggcgggcccgatgatacgcggagataccttacggttatccgcacccttttgtcatccagaggcggcaggcccgatgacaagcagagaccaagtttggtcattctgcacccttgtatcatctagaggcggcgggcccgatgatacgcggagataccttacggttatccgcacccttttgtcatccagaggcggcaggcccgatgacaagcagagaccaaagaccaaatttggtcattctgcacccttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaa

SEQ ID NO: 26378 - DNA, 186 bp, Glycine max
  Peptide Sequence Number=SeqID_118063
atgtggttcaacttcagttttaggctaaaggatgaagaagaagaaggcgaagcactcagctcgcttagcgagttgggagaatctaaaagagaatctgtcattcttgcacgcgcccagtgcgccatcagctcgctcagcgagtcatttgtcttttctcgcgctcagcgtgcccagctcgctaagtaa

SEQ ID NO: 26379 - DNA, 180 bp, Glycine max
  Peptide Sequence Number=SeqID_118064
atgagtgaatggattgtcatcatcaaaaagggggagattgtggaagcaatggcttccaaggttattttgatgatgccaaacaatcaagagttaagcaaagtttcaagcaaagattcaagaatcaagtttcatgattcaagactcaagaatcaagtttcaagaatcaacattcaagaataa

SEQ ID NO: 26380 - DNA, 252 bp, Glycine max
  Peptide Sequence Number=SeqID_118065
ctgatagcagatgctgcagtaagagcatggagacagggggagcagaaagctgatgtcacgaaagctggagttgctgcacgtgatgtccaacgttatgacaaggaatcagattgggctgcacaatgcacaaggcaagataaaatgtcaaatgaagaattgaagctgcaggatccacgatgtcggatacgatgtccaggacatcctgcccgaaaatactggacacataaatctgttatatctttaacagattaa

SEQ ID NO: 26381 - DNA, 408 bp, Glycine max
  Peptide Sequence Number=SeqID_118066
atgcagtcggaagaaaagaaggttcccccaacccccaaagccctagtaatatgtttcactaggaaagggaccggctccaggcctatgtacccgccgacagcgcccaagccaacaccgtttgcatatcaaagcaataaggccgttccgtggaagtatactcctcgcgcttttggagaaagagttgcaactgaagttgactctttatcagccaaggtgaccaacatcaccggccttagtggcgtaacccgcagtggtcgggtgttcactccccctcactcggcggaattgccctccaaggggaaggcgcccatgattcaagagcccacagacgtagccaccccctcaaaagaagtggattctccggtggtaaaaggagctgagaagaaagatggtcttcaaggacaggcg

SEQ ID NO: 26382 - DNA, 704 bp, Glycine max
  Peptide Sequence Number=SeqID_118067
tcgattggggtgatgttcaacccgagcatgactggggtgtacatctagatgaaaattcgcatattgctttggacatctacgacaatgcgatgtttttgatcgcccttgacaactacatggatctacttcctgagaaaaaagaaaaatggggaaaaatcagagcttccatagcaagtaataccatgaaacacctttgggatgaaaagaaccaaaagtttattccccatatttatatcaaaggctctccatttgcagctgattttgatgaaaatcaaatctattatcatggtggaacagcaattgctattgaggctaatttactcagcaaagagcaaataaaagtttcattggataaaatgattaaaaatgtaaaagacgctggtgcagcaacaattggacttaccgtgtacccaacttatccggcaggctcgtttaaaaacaaaggcatgtatccgtatggttaccaaaatggtggagactggacctggttcggtgggcgtatgattcagcagctcgttaaaaatggttttcaacaggaagcttatgaacaaatacagccgatgcttgcccgtgttatcaaaaataaaggtttttatgaatggtacacaaaagataacaaaccagagggttcaggaacttttagaggtgaagcaggtgtgctttacgatgccatcgaattattagaaggtgctggcaagaaataa

SEQ ID NO: 26383 - DNA, 336 bp, Glycine max
  Peptide Sequence Number=SeqID_118068
atgggtcaaaccccagcaaacactcatggtacccatcagtacgcgcaacaccacccaagcttctcggctcatgcggggaacgcctctagttcaacacccgtgcagcccgacgaagtccataaagaccctcaaagattatgctcggagggatgtcgagttttatcccccgatccccgaagggcacccacccaggcacgttccccaagttccaacatcgcagcgtcgccaatatttctggaagggcccccggtaattccaacaagacaaggaggaagttcgatctccgaggaaacgattgagggccggaaggatttcatccccgtcccaatgacgtga

SEQ ID NO: 26384 - DNA, 429 bp, Glycine max
  Peptide Sequence Number=SeqID_118069
atgaggtggaaaattgtaggaggtgataaggtcaggctttgggaagataaatggaatcagcaacagcaacctctagctgagaggtatcctagattgtaccaaatatctacacagcaaaaccaaatcatcagacacatgggacagcacatgcagtcaggctgggaatggcaatttctatggagaagatcgctgtttgaaaatgaaattgagtcaacagtcaattttttaaaggatattgaaggatctgcgatgtcctttctgcagagaagctgtagaggaggcatctcacttgttcttccactgcgtctttatccaaccaatttggtgggaatcgatgtcatggctgaacttacaaactgcctttcctcttgggccgaaacagaattttctacagcatatatctatccaggcagcaggattaaggagtaa

SEQ ID NO: 26385 - DNA, 192 bp, Glycine max
  Peptide Sequence Number=SeqID_118070
atgaaagataaatggaatgtgcatgaatcgcacagtatgttagttcaggaagaaacgaggcttaagaatcaaggaagtcaccgagtccattatagattccttacaatccaaaccataagcctaaatgagaagttcattttcatggggaatagagtgagactccagtgtaagcagtcgatacttattgcgtaa

SEQ ID NO: 26386 - DNA, 203 bp, Glycine max
  Peptide Sequence Number=SeqID_118071
gtgtagctaattcagatgatgaggggtctacagatttgaggacaaatcctcttcaagaaggatgggatgatgaaatcatcccaaggaggggacccatcaccagagccatggctaggagactccaggaagattgggcccgggatgcaggagaagaccctagggttcttatgagccttagggtaaattttgggcccatgggctaa

SEQ ID NO: 26387 - DNA, 336 bp, Glycine max
  Peptide Sequence Number=SeqID_118072
atggatgaaaacattataagcaaggtcatggataagaccccacaggcatccaatgtagctccaactaatgagggtgaacctagtgttgtcatcatctactccacaagctcagcacctatccccttaaactatgtaccactcattgttgtgactaaagaacaagtgcaagaaatgataggctcagatgaccatgctgggagttgtgttgcacctacatccatgcctacactcgtacccccaacacttgagcctacaccatcgtccattgaacaaacaccaccacctccaccctcttcacctccacttactcaacttccatcaccacctcaagtttaa

SEQ ID NO: 26388 - DNA, 246 bp, Glycine max
  Peptide Sequence Number=SeqID_118073
atgataataacaaaagatgatgacaaaggtgatgacaaaaagctcaaagatcaatcaaagaacaactcaagtgaatcaagaagaattcaagagttcaaaatagaatcaagaagaagaaagttaagagtcaagaatcaagattcaaggttcaagatctcaagaatcaagatcaagattcaagactcaagaaaaggcttaatcaagataagtatgaaaagtttttctcaaaaattgagtagcacatga

SEQ ID NO: 26389 - DNA, 174 bp, Glycine max
  Peptide Sequence Number=SeqID_118074
atgaggcatgtaaagcatgaaggacatgcacaaagattgcatcaaatagccatgcaaggggagaggttgaggaggtctgaaaaactgaaaaagagaagaaaaatgcagaaaggtgaaaaagaagaagaaaaagaaaagtcaaggcattgccaaattgaatcgaggatcgtttaa

SEQ ID NO: 26390 - DNA, 390 bp, Glycine max
  Peptide Sequence Number=SeqID_118075
atggtggggtacacaccttcaagctttgcggatttggtcttcgctagcgaaaggatcgaagtgggtctgaaaagaggcaaagttaatcatcctgcttggacgaatgagaaaactggggcaaatgaagagggtgagaatgaaggagaaactcatgctgcgactgtcgttcctacatggaaaatcccccaccagctcaacaacatcattactcagccaatatcagcccttctcattacccaccatgcagtcatccacaaagccataacccctgctagggttcctcaacctccatttttccgaggatatgacttgaatgcaacatgtgcatatcatggaggagttccgagacattccattgagcactgtatgacctcgaagcgtaaggtgtaa

SEQ ID NO: 26391 - DNA, 207 bp, Glycine max
  Peptide Sequence Number=SeqID_118076
atgaaatttggatatgttgctcgaaattcaatttcgcacactctaaccgttgggatttgcgagataatattcgtggtgggagaaaaaggaatcgcatggagacagtacaagcggaggcttcaatctcttctccgtctctctgacgttcgagaattctatcggagcagtcggaggaaaaacttgaggaatctcaaggaaacgctatag

SEQ ID NO: 26392 - DNA, 83 bp, Glycine max
  Peptide Sequence Number=SeqID_118077
cgattctgtggaattcttcatcgttcttcgtcgttcttcaccgttcttcatccgttcttcattcgttcttcgttcttcaacgg

SEQ ID NO: 26393 - DNA, 357 bp, Glycine max
  Peptide Sequence Number=SeqID_118078
atggtagatacgttacccaagttctactatgaaaagctgataggctacatgccagctaactttgcggatctcgtcttcgccggagaaaggattgaatccggactacgaaaaggcaagttcgaatatgcttccaatgtggtccccaacaacaacagaagagccccagtagtgggcgcgaggaaaaaggaaggagacgcccacgcggtcaccaccgccccgacgtggatgaaagcaccctaccagcccaatcccccaaatttttcaatccgagccaggagttccctcccaactcaagtaaaaggaccgcccgcggcagagagaacgccggcccaacgcacagctccagccacgccctga

SEQ ID NO: 26394 - DNA, 156 bp, Glycine max
  Peptide Sequence Number=SeqID_118079
atgactctaagacaacatggattaagcctaggatcttcttcatcaatggattcctttgcttcttggaagatgaatggcagtggaatggagaaggaagagagagaggagatgccacttcaaggagaagatgagtctagaagaagctcaccgccatag

SEQ ID NO: 26395 - DNA, 300 bp, Glycine max
  Peptide Sequence Number=SeqID_118080
atgggcaaattttgtaagtctgtcaacgacaaccaagatggtgttgaacccatgagaagcatttcctgcaatgcaacattctttatagtggcttgttcaatcttcggcattatactacttgaggttcagaccaagacaacatcatcattcatgacaaagaatcagcagctagattctcctttctggccttgtattcaatcacacaatcatatcccaaaaacctgtgtaaccactcctgttgttcaggtgtctgtaggggttgttccatcaatgatctcaagcttttttgatcagttttga

SEQ ID NO: 26396 - DNA, 354 bp, Glycine max
  Peptide Sequence Number=SeqID_118081
atggtggtcatcgtgcctaaggaacacctagttgtctggttttgttcattgcataacaggccagacaactaccttaaggggatacttaacagtgctttaaaaggttttgatgatgctccacagcctaaatcaaaggctcctgctaggtggattatcgtcaagtgtaatagacaaaaaggaagtactgagtgcggctattatgtcatgcactggatgtccaccatcattttaggaagtttcatgaataattgggaagcgtattttaacgaccctagaccattggagccagagagattaaaggcaatacggatccagtgggcacagtattatctccaagttagagctcagagctag

SEQ ID NO: 26397 - DNA, 297 bp, Glycine max
  Peptide Sequence Number=SeqID_118082
atgtaccttgtgggggccggcggtccacgggacatagtcctttcaggcagtgcccgtttagtccatggtccattagatggtcgatgcaaggccagaaattggaacacattgattccgctcgttcctgtccttcgcttcagggcctgtccctcggtgtgggcctctttcctcctcccttttctgctcactcgtaaggggtccggacccccacaaaggttaaggagtcgactgaacatctcagccattggcgggaatttcgcccgcatccgatccccaattcttgttcaccccggatga

SEQ ID NO: 26398 - DNA, 623 bp, Glycine max
  Peptide Sequence Number=SeqID_118083
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgctaaacgacggccagtgccaagcttgcatgcctgcaggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccg

SEQ ID NO: 26399 - DNA, 675 bp, Glycine max
  Peptide Sequence Number=SeqID_118084
atgggtgcgaagcacctcaaaatgaccagacacaagttgcatgccaccaagcaaaggtccccggacgaaattaggagacagaggtcaccaaagcaaccgaatttcctatcttcagcacagttgaatctcttgtcttattctccaatgacacactttgatggcctgtatcacttttcttcgtatgttctagtggttcagcttcagaatgcatggagcaatctgaattttccagtgatcaccaaaggcttctgcattagcattgacactctccaccctctttggtttatgcttctgtgctgcattccgtgcttcctccttttaaatctcacatttataagaggttgcactagaacgataaacaccaatctgtgcttcttcctcgtctaccaactcaatatctttcctttcaacttttgttttgtaaattacagtgtagtttacaaaagcaaaggtgaaacggaagatattgagctggtagaggaggaacaggcacggattggtgctgattcttctagtgagacctccaataaatctgagaattataaggaggatgcacggaatgcaacacataagcataaaccaaagagggtagagagtgtcaatgctgatgcagaagcctttggtgatcactggaaaattcagattgctccatgcattctgaagctgaaccactag

SEQ ID NO: 26400 - DNA, 250 bp, Glycine max
  Peptide Sequence Number=SeqID_118085
atgcccttttgcgggcgagcaaaggcgaggctcacgggtgcgctttccaaaggaggaaagatgcgcggagtcgccaccaacgtttatttggggaaaacgtcgaaaaaaccgaaggaaaccggtcaaaaaatgaaaattctaagttcgggagttgtatttacgtttgaggaaggtattagcacctctcacgttgacaaaagcggggctcttgctcctacgtaccctccatcgaagaggaaatcagacctac

SEQ ID NO: 26401 - DNA, 393 bp, Glycine max
  Peptide Sequence Number=SeqID_118086
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 26402 - DNA, 306 bp, Glycine max
  Peptide Sequence Number=SeqID_118087
atgaattgcttaaaagaacttggcaggtggtcgcatgagtacatgaacctcttcggtggcacagagagatttgaacaattaaagttgtccctacttgttgatggattttcaaaggttagtgtggacaagtggatggatataacagacatgggatatgtgattgcttcacggtataacgtaatccttgtatcgttgtcccaacaacaaagcatgacatttttccctcttagaagtcaaccaccacctgactcttctggccaccgcatcatatgtgtcggtcacgtgtttggaaatcattttgttcag

SEQ ID NO: 26403 - DNA, 672 bp, Glycine max
  Peptide Sequence Number=SeqID_118088
gccctgcgtgacctcactcttgctgggctgtatgcatgggagctgctgggctcgtccatatgtaccatcagcttaatgatgccagtcttagcaccagttgacagcttgctgtgtttgatatacgagcactttccgtcagttggggagtgcaatgctgatctagactacgacgaggtgtcaccacatgcgtgtcagtggattgcgacaaagaggactgtgaagaagtgtttgatatacgagcactttccgtcagttggggagtgcaatgctgatctagactacgacaaggtgtcaccacatgcgtgtcggtggattgcgacaaagaggactgtgaagaaggtatctacagcgacgtacaggcagtgcctggatcatctgaggatcctagatgtttgccagatgccatattcagagtatcgacctgtgcaggactttcatccgatttcgtgcttctcgggacaactccgctggggacctgttgttgttagatacagaccagagagggttatgcgtcaatttggctacatccagtgcattcctgcacaccctgtccatccatgggtgtcatatgatgacgtagacaatacgtggacacactactcaaaccatctagcggcagctggtgatccatgtgttgtgccaggtcagtgtgcgcctgactacatagactag

SEQ ID NO: 26404 - DNA, 290 bp, Glycine max
  Peptide Sequence Number=SeqID_118089
tccaacagggtcctggggtttccagctttgattacgggcctctatcagttctacggagtgcccatttcccccagcaaggtcatcaggcttcctactaaccaagctttcatcaagaagtactgcgcccccaggcaggcaaagggtgagacaccacagcagcctggggatggccagcagcgggcaacagacgcaccgtcgccacctccagagcctttcagctcatctacaaaggctggagcgttgcctatgacccatggccgaccagcaggcgaccaagtccaaagccaaag

SEQ ID NO: 26405 - DNA, 305 bp, Glycine max
  Peptide Sequence Number=SeqID_118090
gactcatatgtgattctcctctaatttcagccagcccgcatcaattagactttgcaccttacgcttcagggtcatacaatgctcaatggaatgccccggggctcctccatgataagcacacattgcatttgagtcgtatcctcggaaaaatggaggctttttgctgcaaaattccttccttggttggtgttttggttcgtgctaaagggatggactttgtggataactgggtggtaggtaaggagaagggttgttattggctaagtaatgacattgttgggttggtgggaaacttggccgtatag

SEQ ID NO: 26406 - DNA, 342 bp, Glycine max
  Peptide Sequence Number=SeqID_118091
atgactaccctgactccgacatggatgacattgctgcttagcaacatcctgcccaacgatcataattccgacctccctctgccgaagtgtcaactggtggcgcacgtgcagacccatgactgcctctaccagttcagcctcagcctgcaaagccagggttttgcctcttttccatgccctactctggatcagttcagggcagaggtcgcatggcccggagattggcctaaggcccaggcaggggaggcacccgcagaggctctcggcgaggcaaatgaggcccgcatggatgaggagatgaccgatttgcttgatttcttgggagggagcggagccacatga

SEQ ID NO: 26407 - DNA, 597 bp, Glycine max
  Peptide Sequence Number=SeqID_118092
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccctgccgttggtctcgatggcgatctcgaagccgcgtgcgtgcagcgcgtcgatcaggggcttatcgagttgcagcagcggctcaggggatcctctagagtcgacctgcaggcatgcaagcttggcactggccgtcgtttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 26408 - DNA, 240 bp, Glycine max
  Peptide Sequence Number=SeqID_118093
atggagagaagtatgatagatgctgccagtggtggagcccttggagacatgactcctgctgaagccaggaatttaattgagaagatggcttccaactcccagcagaatttgatcgaggccgtacccgaatcaaataaacatgaaaatgcagcaccacatacaccagttagcccttcgtccattaagcatgaacgcaagttaggctcagaggcaattaatcgaacacgaagcgtgcattga

SEQ ID NO: 26409 - DNA, 237 bp, Glycine max
  Peptide Sequence Number=SeqID_118094
atgcacgaaacacaatgcggaccactacgggtacatagaatgaatcgaaaagcttggttcgagcaaaataggggaggtggttgccgcccagctcgcccaggcgagctcaactcgcccaggcgagctcagctcgcccaggcgagcagggttgcttcctcagaagcaaccgccttctggaggaatcttctggagggcccaaatgggcctgggtgctatttgcacccccatttttactaa

SEQ ID NO: 26410 - DNA, 204 bp, Glycine max
  Peptide Sequence Number=SeqID_118095
atggctggaagaaaatttgggggcgagggttttcaagagaaagaagagttgcagggacacattgtagttgattatgcaaaaatggtaatcgattaccagagagcaacattgctagaaataactgcttgtaatcgattacattgttatggtaatcgattaccagtgcttattttagccaaaaaacaaaaacaaaaggcttcctag

SEQ ID NO: 26411 - DNA, 405 bp, Glycine max
  Peptide Sequence Number=SeqID_118096
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccctcgggtgagagccgagtatcctaaccaactagactacaacggatttgatgcttacttcagacaatacttaaaatttaatgtcagtataatcccaaagaacaaaaaaggagggattgcttattag

SEQ ID NO: 26412 - DNA, 711 bp, Glycine max
  Peptide Sequence Number=SeqID_118097
atgcgggggtaccatatggttatccgcagcttttgtcatcccgaggcaacgagtccgttgacatgcggggacggcaagtctgatgacatgcgggggtaccgtatggttatctgcacctttggtcatctagagacggcaagtccgatgatatgcagggatggcaagtccgatgacatgcggggggaccgtatggttatctgcacatttggtcatctaaagacgacaagtccgatgacattcatgggtatcgtatggtcatccgcacctttggtcatcgagagatggcaagggtaccgtatggttatcgacaactttggtcatctagagacggcaagtccgatgacatgcggggacggcaagtccgatgacatgcagaggtatcgtatggttatccgcacctttggtcatctagagacggcaagtccgatgacatgcggggacggcaagtccgatgacatgtgggggtaccgtatggttatccacacctttggtcatctagagacggcaagtccgatgacatgcggggacagaaagtccgatgacatgcagggatatcgtatggttatccgcaccttttgtcaccccgagacagcgagtccgatgacatgcggggggactaacgttgtcctctgcacctttcgtcaacccaagggaaacgagcccgttgacgcgcagagactagcatcgtcttctaaacctttggtcatctag

SEQ ID NO: 26413 - DNA, 114 bp, Glycine max
  Peptide Sequence Number=SeqID_118098
atgaaccgaggtgctcggggacgggtacgagcagatgctaggcccgtgatcagcagatcatcatccaacgtcctactccggaagatcaagaatcactactgggaggcagcctag

SEQ ID NO: 26414 - DNA, 681 bp, Glycine max
  Peptide Sequence Number=SeqID_118099
atgactacgttggtctctgcatgcgaccggacccttgagtctgacggtagaaacgagacttttttgcggtctcggccggaagacgctgacatctcagggaaaggtgcagatgactacacccttgagtatgacggtagaaaagagactttttcatggtctcgtccgaaagacgctgatatctccgggaaaggtgcagatgactatatgactacgttggtctctgggtgctaccggacccttgagtttgatggtagaaatgagactttttcgcggtctcggctggaagacgctgatatatccgggaaaagtgcagatgactacgttggtctctggatgactatgttggtctctgcgtgctaccggacccttgagtctgacggtagaaacgagactttttcacggtctcggccggaagacgctgacatctccaggaaaggtgcagatgactaccttggcctctgcttgtcaatcagacttgggactctcggttcacaagatagcaaaaagtgtgcgcggataaccatcggggcgaggatggaaatactcatcccgggtcaaggtttatggtggtttgaggttttggctcaaatggcttgtagaatggttggacatgatatatgtcagggtgttgatttggccagtggttcagggataaaggaatgtctcatattatttccatga

SEQ ID NO: 26415 - DNA, 243 bp, Glycine max
  Peptide Sequence Number=SeqID_118100
atggatgctactgtcctgtcttgcagtaattttcttctcctctcggctctgttccttctcaacgtgtctagtatgaaaagagatgtgtcaactatgcacagtgtcgcaacctacccttgggcgggagggcgacgcgagactcacgggtgcgtcttccaagggaggaaggcgcacagagtcaccaccaacgtttattcgaggaaaacatcgaaaaaatcggatcgtgtggtttacgaactttaa

SEQ ID NO: 26416 - DNA, 640 bp, Glycine max
  Peptide Sequence Number=SeqID_118101
atttgctacatctaatatccagtcgtgtggatttgggatgaccgatcctctcgatgagtcgatctcttgctttctcataagggtgaacccttggggctacccgccctccccttgggtactagttaccctcaccttgagaggactacatgtcctcacaatcagagggctgcacgccctcacctccagaggactacatgtcctcgccttgagagggctacctgccctcaccttgggtactagttaccctcaccttcagaggactacgcgtcctcaccttagaggactgcacgtcctcaccttcagaggactgcgcgtcctcaccttcgtagggctacatgccctcgccatcagaggactacatgtcctaaccttcagagggctacgcgccctcgccttcgtagggctacacgccttcaccttccgaggaatacatgtcctcgccttgagagggctacacgccctcaccttggggctacacgccctcaccttgggtactagttaccctcaccatcagaggactacacgtcctcgccttgagaggactacacgtcctcaccatcagagggctgcacgccctcacctccagaggactacatgtcctcgccttgagagggctacacgccctcaccttgggtactaa

SEQ ID NO: 26417 - DNA, 108 bp, Glycine max
  Peptide Sequence Number=SeqID_118102
atgggtgcaagggataaatcaatcatgcacaagggaaataaaaatcctgatcctgtcaatgatcctgtgcagagtccatggcatgctcattcaagtccagtgcagtag

SEQ ID NO: 26418 - DNA, 558 bp, Glycine max
  Peptide Sequence Number=SeqID_118103
atggctgaatcatcgaaaaagcgaaagggctcatccatttcctccgccgctgctgcccatcgacaacacggaccatctggagcacccacaacaccactgcccccttccttgtcatctctacgatcatctactttattttcttcagatgatcaacgtccatggtacaattctcaattttcttctaggatcatcttagaccttaagtacctagacatagatttctttaatgatgagacatttgaatgttatcaagtgtttcaaaactttggattagttgattttatgtccttaaaattgccttattatcctgaactagttagagtcttttacagtaatttaaaaattcaggatggtacaattcgctttgaggttgatatgacaggtagattgctggccggatcattaacctttgattgtcgcatcatgtactatattatcgttagaattttgcttccccgttcttctaatctggctcaagcctctgaggaggaattgattttgatgtgggctttccttaccggccgtcagatcgactggactcacttggttaggtactaa

SEQ ID NO: 26419 - DNA, 736 bp, Glycine max
  Peptide Sequence Number=SeqID_118104
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccctcacgtttttggctgctgtgctaaatgcttccctgtggctgatatctggattactagccttaattctttgtatttcttccctgcaaccagaatgatgtatatatccaaatggggtaccgagctcgaattcgtaatcatggtcatagctgtttcctgctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaacgctgcgccttatccgg

SEQ ID NO: 26420 - DNA, 740 bp, Glycine max
  Peptide Sequence Number=SeqID_118105
atgaggctactacgtcaccttcctctagtgaaagtgaaaaagcaaaaggggaagaatctagtgaagatatctacccccaagaagaaggacaaccattagtggttaaagagaagtgtaaggaggtaagtgtctcctccaagagtttagctaagaaggaaactcatttgacaatagagacaaacattaaagaagttttccctcttagacaacctccacattttctcttttgtaaaaaggcacttgctagcattgccacacctcttgggcttgagtttattcctcaagtaaagaagttgttggatgagggtttggttcgcaagagcttaaatccttgtgctttgttggtgcccaaaataggtattattacgcaccaagtccctaaaataggtggtatgatgaatgttttgagtggtgcaaccctcttttgtaaaatcactcgtacacctaacatcttcatggtgtgtgtacatagggacccattaggtaggaataatcaatatgaaaatacagaaaaaggggttcccatgaaccctaagagaataaaggtcattaatgaatggcccactccaccaacaccactcattgagttggtgagaaaccatgttccttcatgggaagatgcccaggaaataggtgttgagggaaggagcccagagtatgaagaacctcgggatttgaggtcaaatcctttccaaggtggagggaatgatgcaatcctatcccgcaagggcattgggtag

SEQ ID NO: 26421 - DNA, 549 bp, Glycine max
  Peptide Sequence Number=SeqID_118106
atggcagagccatcaaagaagagaaagggatcatcctccaccgctaccgctgctgcccatcgccgtcacggcccatccggagcacccacaactcctattcctccttctttgtcatctccaagatcatcaacactgttttcatccgatgatcaacgtctacggtacctttctcagttttcttctagaataatcttagatcctaagtacctagatgtagagttctttaatgatgaaacgtttgattgctatcaagtgtttcaaaactctggtcttgttgatttcatgtcattaaaattgccgtattatcctgaacttgttaaggtgcatggtacttctatggtcattgatcagtcacttttcttttctttgactcatttacccagtcaaggtgcaccttttgagggcaccattgttgatgactggaaattcgattattcaagtcatgatgctcgtcgcatggtctgcaatgatcaaactaaaatgaccggtagattgctggccgggtcattaacttttgataaatcgcatcatgcattatatcattgttag

SEQ ID NO: 26422 - DNA, 598 bp, Glycine max
  Peptide Sequence Number=SeqID_118107
atgtcggaaatttcactcgccaaatcgcgcagcggtgtgctcagcggcctgcgctgggggatggagcatccctctctgaccctcggcggcatcatcgtcgccttaatcgtggacctgctgaatattctctccgcgccgtcggccgaccactggctgggcaccgatgactatggccgcgatatcttttcccgcaccatttacggcgccaggatctcgctgattgaagtggtggtcagcgtggcgctgtcgctactgatggggctgcctctgggcattatcgccgccctcgtcctcggcgcagggttgatgaatatgctgctggcgatcgctatcttctcggtgccggtttacgcgcgcctcagccgtaacctgacgttgggcatcaagaatatggagtacatggaagcggcacgggcactgggaattggctatcgccgacagataatccactacatcctgcgaaataccctggggccgattaccgtgcaggcgacattgaccggcggctcggtgatcctcgccgcggcttcgctctccttcctcggcatgggcgtgcaaccgccgatgccggagtgggggacaatgatgagcgatgggc

SEQ ID NO: 26423 - DNA, 211 bp, Glycine max
  Peptide Sequence Number=SeqID_118108
cttttcctctattctttgttctgcactaggctcacgtagtctattcagacctccccttcattctccgcaattcaggcttaaaaagggctttttgtccgtgaagcgccattctcgcgctaagcgcataagagacaatcttctcgctgaacaagctgatgacgcgttaagcgctaagcggctgatgtctagcttagcggttgagtctcactaa

SEQ ID NO: 26424 - DNA, 255 bp, Glycine max
  Peptide Sequence Number=SeqID_118109
atggtcccttttggtaacctggttcagcctcctatagtcgatgcagactctccaactgttctgcacccgagtaggaatcacggtgaggtcggttttctttggaactacctggacgagactcacccattggatgttgaagataggataaatgattccagcttgcaaaagcttggttacctccttcttcactacatcaagaatcaccgggttgagtcttctttgtggctatcttactggtttaaccccatcctctaa

SEQ ID NO: 26425 - DNA, 462 bp, Glycine max
  Peptide Sequence Number=SeqID_118110
caacaacttaaaaggaagtctacttcaaaatcttttggccctcactcttatccaaataaagaccaaggtcaaggcatcttaggggtgacaacttctaagcccaaagatgataaggggaagactatagaaaagcaaccccttaaggctagtatgcaagagaagactagctccataaagtgctttaaatgtcttggaagagggcacattacttctcaatgccccaccaataaaaccatgattatgaggggacaagacatttatagtagccaagatgaggctactacttcaccttcctctagtgaaagtgaagaagcaaaaggagaagaatctagtgaagaaatctacccccaagaagaaggacaacctttaatggttaaggaagagtgtaaggagacacttgttagcactgccacacctcttgggcttgaggttattcctcaaagtacaggagttgttggatga

SEQ ID NO: 26426 - DNA, 633 bp, Glycine max
  Peptide Sequence Number=SeqID_118111
atggtgctcactgtatggtctgtaatgaccggcagattgcttgtcgggtcattaacctttgattgccgcatcatgcactacatcattgttagaattttgttattccgttcgtctaatcttgctcaagcctctgaggaggacttgattttgatgtgggcttttcttaccaatcatcagatcgactgggcccacttggttaagtaccgtatgcataaggcattacgaaccaatgcacctcttctgtatcctcagttagtcactctttttcttcgttactttcaaatttctctcgatgatgaaccttttgttcaagtcaagagatcttttaccattggtgctggagcggtaacttcttttgggtaccgtaaggatattgatggacagtggattaggaaacaagatttaccaccaccaattcctgatgagtgtactccatctcctctgccacagagagatgcttcctttactcttatgcatgaagtcatttctaaattgtgtggccttcaagcattcgtaggtgaccgtttggatgccatggatgctcattttgaaggcatggatacacggattactcagcttaaagacaacatgggtttcattcgctgttgctttgatccaccgactgctccatag

SEQ ID NO: 26427 - DNA, 772 bp, Glycine max
  Peptide Sequence Number=SeqID_118112
atgagcgctttagggcgtcctcaagatatgttttcagatacggctatacaattacaaccggtctttgctcaatggatacaaaatacccatgctttagcaccaggcacaacagccccagtgggcggtaaagttgctttgttacctattccgttaggaactgcggattttttggtccatcatattcatgcatttacaattcatgtaacagtattgatactcctaaagggtgttctatttgctcgtagttcacgattaataccggataaagcaaatctaggttttcgttttccttgtgatggacctggaagaggggggacatgccaagtatccgcttgggatcatgtcttcttaggactattttggatgtacaattccatttcggtagtaatattccatttcagttggaaaatgcagtcagatgtttggggtagtataagtgatcaagggatagtaaatcatatcacaggaggaaattttgcgcagagttccattaccattaatgggtggctccgtgatttcttatgggcacaggcatcccaggtaattcagtcttatggttcttcattatctgcatatggtctttttttcttgggtgcacattttgtatgggcttttagtttaatgtttctattcagcgggcgtggttattggcaagaacttattgaatccattgtttgggctcatcatcacctcaaagttgctcctgctactcagcctagagccttgagcattgtacaaggacgtgctgtaggagtaacacattaccttctag

SEQ ID NO: 26428 - DNA, 552 bp, Glycine max
  Peptide Sequence Number=SeqID_118113
atgaccatgattacgaattcgagctcggtacgcaccgccgctacaaattccggcaagcgaaaccggaaaccgattacagaggctctccgtcggcggtgctcgatcgtcgacgtcttccggcggcggaagaaccctcccgtcggcgaagagcaccctgctgccgttcctctgctggtggccggcgaccactccctcgagctccgccgccgtgccgtagaacgcgccgtcgccgaacctccgctccacctccagaaactccccgagggatcctctagagtcgacctgcaggcatgcaagcttggcactggccgtcgtttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 26429 - DNA, 527 bp, Glycine max
  misc_feature (61)..(61): n is a, c, g, or t
  Peptide Sequence Number=SeqID_118114
tcctgtcgggtttcgccacctctgacttgagcgtcgatttttgtgatgctcgtcagggggncggagcctatggaaaaacgccagcaacgcggcctttgtacggttcctggccttttgctggccttttgctcacatgttctttcctgcgttatcccctgattctgtggataaccgtattaccgcctttgagtgagctgataccgctcgccgcagccgaacgaccgagcgcagcgactggcacgacaggtttcccgactggaaagcgggcagtgagcgcaacgcaattaataaaggattcaaccttttgtaaagaatggacattttgtcctgtgtacacttcttctaggaaaatcactggccatggaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 26430 - DNA, 229 bp, Glycine max
  Peptide Sequence Number=SeqID_118115
atggctgaagatcaaccacagagggttactcttgaagattattccagctcaatcgtgctgcaattcttcacaagcattgcatggccggaagtccaagctcacaacatcacatatcctcattccttgattcagctgattcaaggaaatttgtttcatggttttccaaatgaagacccttatgcacacctagctacttatattgagatttgcaacacagtgaagattgtcg

SEQ ID NO: 26431 - DNA, 142 bp, Glycine max
  Peptide Sequence Number=SeqID_118116
atggcacatcaaaagcccccatacttagccttttgcactcctaggcaaaatgaaacaaagaacaacctccaaggatatcaaagggagacaaaccaaaacattcacatatttctcaacgaacatcaaggaatgaaaggaatgg

SEQ ID NO: 26432 - DNA, 337 bp, Glycine max
  Peptide Sequence Number=SeqID_118117
gaagatactcatcccaagacttatggttgcctttcagaagagcccttaaaaggatggataaagacctattcactacctctgtttgcccatcagtttgtggatgacaagtgcatcatccaccttgtggcatggtataaagtgtgtcatcttgctaaacctatccaccaccacaaagatagagtctacacctctttgggttctaggaagcccaaggacaaagtctatactgatgtctacccaaggtgcagaggggatggggtcttgtctatcccaaagtggcccatgagcccaccctcatggctctctttcacaagtaatttcctaatggatccttggg

SEQ ID NO: 26433 - DNA, 285 bp, Glycine max
  Peptide Sequence Number=SeqID_118118
atggaaatctttattcaattaattgatcctggtgcatggaatgccattgttaaaggtccttttataccaactaaagaagtgaatggtgaacatttttctttttggcaaaagagaatggaaatctttattcaatcaattgatcttggtgcatggaatgtcattgttaaaggtcctttaataccaactaaagaagtgaatggtgaattggtacccaaagaatggaatgagatgaaagatgatgataaaagaaaagtgcaagatgatcaaaaagcaaaaacattttaa

SEQ ID NO: 26434 - DNA, 426 bp, Glycine max
  Peptide Sequence Number=SeqID_118119
gtgatccgaccaccgatcacccgcattttcatagagaagtactgtacagctagacaggcacagggtggcgcccctcaggccccagaggcaccgccgccccctcctcaggatgacccagctgggccatttgacacggagcggtatttacggcatttggttcgccagcaggcggccaaccacagggcgcacgtgcagactcatgactctctctaccaacttagcctcagcctgcagagccagggttttgcttcttttccatgccttactccggatcagttcagggcggaggtcgcatggcctggagattggcctgaggcccaggcaggggaggcacccgcagaggctcccggcgaggcagatgaggcccgcgaggacgaggagatgaccgatttgcttgatttcttgggagggagcggagccatatga

SEQ ID NO: 26435 - DNA, 418 bp, Glycine max
  Peptide Sequence Number=SeqID_118120
acattcttgtgagttgtccttcttctacgccctatgtggaggccacgaaggagtccttggaaatgtcctttcaagcattagaagtggtgagcaatgcttacatggagtctctctcggtacaaccatgctcatctggggccatattgatggtagctcgggtgatgttgggtcatggatatgagcctgaaatgggtttcggccgaaacgacaatggcgtagcgagtttggtagagttcatagggaaccgcggaaggttcggactgggatatgagccaacgtgtgctgacggacgggtctccatgatacacgatgaaacccctcaagagcaaccaaattgggtgcggctatgtactccagagttcaaattggggaattggaaaatcgtcaaacaacccagaattttcgtggcaaactctat

SEQ ID NO: 26436 - DNA, 457 bp, Glycine max
  Peptide Sequence Number=SeqID_118121
agggctacacgccctcgccatcagaggaccacacgtcctcaccttcgtagggctacacgccctcacctttagaggaccacacgtcctcaccttcagagggctacatgccctcgccctcagaggactgcatgtcctcaccttcagagggctacacgccctcgccatcagaggaccacacgtcctcacctttagagggctacacgccctcgccatcagaggaccacacgtcctcaccttcgtagggctacacgccctcacctatagagggcttcacgccctcacctttagaggcctacacgccctcgccatcagaggactacatgtcctcaccttcagagggctgcacgccctcaccttgagaggactacatgtcctcgccatcagagggctgcacgccctcacctccagaggactacacctcctcgccttgagaggggctgcacgccctcacctttag

SEQ ID NO: 26437 - DNA, 369 bp, Glycine max
  Peptide Sequence Number=SeqID_118122
atgatacgcggagataccttatggttattcgcacccttttgtcatccagaggcggcgggcccgatgacaagcagagaccaagtttggtcattctgcacccatgatacgcggagataccttatggttattcgcacccttttgtcatccagaggcggcgggcccgatgacaagcagagaccaaaggctgacacagtcttctgcaccttttgttcctccgggaacaacaagtcatttacatgtggaaatttcatggtcgcccgcgactctcgaggagcgaaattagtgtcatacactgattttcggggacctttgcttgatgacatgcgaccattctttggtccttgtgaggtgcttggcacccatcgttag

SEQ ID NO: 26438 - DNA, 363 bp, Glycine max
  Peptide Sequence Number=SeqID_118123
atgtttgtcctcgcaggaaatggctccgagaaagcttccgcaaagagatctaggaaggatgccgcggctgaagggactagtgccgctcccgagttcgacagccatcgtttcaggagcgctgagcaccaacagtgtttcgccggcgttggacgtcgttggtcactcccatggccaaatgccctcagccagttcctgggaaacccgctagtgttagaggaaggccaggagtgcgagtatagtcaaagaaggaaccgggccgatggatttgacgaggaggccattgcccagctgttatgcataccgggtcaggattttgcccggaccgctgccgggagacagcaacatcctgcccagcgatcataa

SEQ ID NO: 26439 - DNA, 369 bp, Glycine max
  Peptide Sequence Number=SeqID_118124
atgaaggttagtgaaagaaagcaatccaaaaatgtcgaagaactgggtcttgaaaagcataacaagacttccttgattgaagaagaatgctggccagtttatttcggggatgctacccaagcatctattgtagaaaggtacattgtagaagaagccattgaattttgttttgagtacattgaaaaggctaaacctgttaggcttcccgagtgtcgacatgacgaaagagtgggtagtaagggttcaagaggactgcatgttatcactccaagtgtagaagatttgttacaagctcacttgtatgtgttgaaaacagtaatgaaatttttccatacatacttcggcatgaaggttagtgaaagaaagtaa

SEQ ID NO: 26440 - DNA, 387 bp, Glycine max
  Peptide Sequence Number=SeqID_118125
atgctgctgttagccagacggtgctggcggtgcgcagccaagaaaaattgcctgcgctatccgctgctgcacgatggccatcacctgtggccagcgttcctggcgtttatgttccccggccagtcgctgcagcatcagcatcatttgcgctttaaccagaccgcgctggcgctggaagcggcgctgagtggtcagggtatcgcactgaccagcccgcattttgtgcagaacgatctggccagcggtcggctggttcccgcctggcatcgtgagatgcccgttgatgccggctggtatctggtggctccgcgtcgtccgcgtgagcaggcaacggtgagtgcggttcgtgcgtggctactcagtcaggcggagcagagcaaagattga

SEQ ID NO: 26441 - DNA, 228 bp, Glycine max
  Peptide Sequence Number=SeqID_118126
atgaccgtgtcatatcaaggattggctaacgagatgctctccattcgcgttacacggttaccggacttcagtgcgaacgtcaactggggcacgccgttctcattggaaccggattacaaggaatcagagtgggctcaaacacgctatgatcagctcaagcctctggtatttcgacatcaagcgatatgtcgtaagcaaagaatacctgccagagattgccgacaatga

SEQ ID NO: 26442 - DNA, 330 bp, Glycine max
  Peptide Sequence Number=SeqID_118127
atgagaatttgtccttcaaacacgctttacaatttggcatctgaagtttgggagctttgggcagataagtctgctaaagctggaagtggggctgaagtagaagatgcagggatgccagctattggtgcaaaggaaaagagaacatcagttgctatgagcttggtcattcacattccaacagttctgtcgcaacctacccttcggcgggagggcgacgcgagactcgcgggatgcgtgttccacgaaaggaatacgcgcggagtcgccaccaacatttatttgaggaaaacgtcggaaaaaccggaaaagacgcgatctacgaacttttaa

SEQ ID NO: 26443 - DNA, 102 bp, Glycine max
  Peptide Sequence Number=SeqID_118128
atggagaagggtgttgcccttgctcctacgtatcctcaggttccttcatccctaagcaatttgggggcccaggcgagccagaggctagcctgggcgagctag

SEQ ID NO: 26444 - DNA, 185 bp, Glycine max
  Peptide Sequence Number=SeqID_118129
gttctcagtgccctaagatcccaatcccagatcgagttccaatcgcagaagtgttctcaagcgaatggcttttactcaacctcaattcattcacccttttcgggttagttgaaagaccaagaatggcctcaaagaaagaagacgacagacatgctgggaaggaaaaggaaggagatgtggcctaa

SEQ ID NO: 26445 - DNA, 489 bp, Glycine max
  Peptide Sequence Number=SeqID_118130
atgtgctggcggattcctattctggttaaggtggtcgctcgtgccgctgtggttgttgtctctgtctacctcggtcttccagtcttctctgtctacttcttggttcttgtgttgctcctcttgatgtcctttaggccttgctcctttcctggtagtggtctgtacttggttgcgtctgaccctggcctcagagatttcatttggggtagccggacaggtacctccaggtcgaaggcttcctcaagaatcgtggtacgattggccgtcaatggtatacttcattccagaatttggacatttcttctatctggatgtaacccttggctcgttcgtgcggctcatccatgctaccagactggccaaggcagccaaggtcatgcaatgagacctactggtggcgtactgaacactgaatcgttcgatgagggtgtcgaagctatctatggatcttggtgggagtccaccataccatgtcaagggatcctctag

SEQ ID NO: 26446 - DNA, 569 bp, Glycine max
  Peptide Sequence Number=SeqID_118131
ttgaccctaaggtagtcctggagttttatgctaatgcttggcccacagaggagggagtgcgagacatgtgttcatgggagtgtgagttcagtcagaggaggaacagagctgacaggttcaatcaggaggccattacccagctgttatgcacaccggggcaggatttcgctcggaacgctgcagggaggtgggtgcggatcttgcgcaccagcatgaccaccttgacccagatgtggatgacattgctgctcagcaatgtcttgcctagtgatcataacttcgatctccctctgccgaagtgtcagctggtgtatgccatcctgacacggatgagcatccacgtggctcagttgattgctgacgccatctatttgtttgcaggtatgccatacaccaggcaccatctagacccggataagtctaatagggccctgggcaaagtgatccaaccaccaatcacccgagccttcattgagaagtactgcacgcctaggcaggcacagggtgatgcacctcagggcgcgggcgcaccgccaccacctcctcaggccagtcccgctggatcatga

SEQ ID NO: 26447 - DNA, 540 bp, Glycine max
  Peptide Sequence Number=SeqID_118132
atgtcttgttctgaagcaatcaattccatacctgacccccaggaaaagaagggtttcctggaaaaactcaagaaaacattagaggtaaaacctaaacaaaaggattttattacaaacaacaaatttgatgtaagtaacatactcaaaagattagaaaattcttcaaccaaaccaacgacaatccaagatctccaaacagagataaacaatctaaaaagagaggtaaaagaactttgtcaacaacaagaaattcatcagatcattctttctcagcttgaggaggaagatagtgattctgaaagtgccaacaacaaaacgatggccctatttgacacaggggctgatttaaactgcattttagaaggattaattcctacaaaattctttgagaaaacctcagaaaaattaagcctaggatcttcttcatcaatggattcctttgcttcttggaagatgaatggcagcagaatggagaaggaagagagagatgagacgccacttcaaggaaaagatgagtctagaagaagctcaccaccatag

SEQ ID NO: 26448 - DNA, 204 bp, Glycine max
  Peptide Sequence Number=SeqID_118133
atgtatgaatatcctaggagaacccgcgcattaacgcataagcattcctttcaaaattcgtgtggatattcgtgttttgttggaaaaagggaaatggctccgaagaaactctccacgaagaggtctagaagagacgccacaggagagggatctagtgtcatcccagagtttgatagtcatcgtttccggagtgccgagcactag

SEQ ID NO: 26449 - DNA, 2559 bp, Glycine max
  Peptide Sequence Number=SeqID_118134
atggagtcagccgaacatgatgagcatcagcgagccaaccagcaccccgcacaacagcaggctgacgatgcgaaggcgatcgccggtgcgctcgacgctgcttacggtgcgctcaagccaggtggccgcaaagcgcttcagcgacccttcgctgttccgggtctcaaacaggctctgcagtttgacgatggcgcgctcgtcgggaaactcgtagtccgtggcgtccagcgccacgccgaggttcttttcaccggaggaaatggccagctccagcgcgtcaagacgctcgtacagccaggccgaacgggtggacgccttcatcgtggccacggcgcgctccatcggtatcccggctgcgtccattgcgttgacgttcatgatgaacgccgcaccgtgaatgcggcggtaaatcgaccacggcgggaagcggtccagaaagaagcgcaggcgaccggtcagccggggcagcgaccacacgatcagcgaaaccaggacggcgaacagcagcagcagcgcccaccaccagccgttccactggctgagcggcaccgcctgaataatcaccggcacgagcatcatgcagaacatgaccaccacgcccacggtcagcatcgtcaggtacgccgttacggccacggtcgatttcactgtgccgctgatgcgcccggtgccgctggcaatgtccatggcgttaacgaagccgtcttccgggcggccggccaggtcacaggactcgatgatgctgagctcctgatcaggtatccactcgcgcagcgaatcggccaggccaaaaccggcaccgaggttctccgcacactcggtgaggatctgcgccacggcatcgccgggtttcttcccgcgccggctgtagttgtcgataagcttctgataggactctttagcgccgcggccgtccagcaggtcgacccccgctgtcagccgggcgtcccggtccaggttgacgatgcggcgatgcgcccacacaggatccgtgacgccgctgttaatcagccgcagcaggttctggcacagggtcacgccaccgcgatcaatccagtcaagataggcagccatcttgccctgcccgctgtagagccgcataaagcggttatccgtttcaataacttcgaatatgccggtgcggccgtgtattcccgtatgaccacagcactcgcagccgccggggttgcgcagaaatacgccacggacctgagcgtgggtctccaccatgtcctgcattaccgggctgacgctgacgcgtccttcctgccagggaatgcggcagtgcgtgcagagcagcggcaccaggcgcaggccgaccaggcaggaaatgatggtcgggtcgaacagcaggtcttcgtcgacgccaaagcggcgcaggcgctgcggaatgtccgccggcgagttggtgtggatggtggtcagcacgggggcgccggtctgtatggcctcaacgacgccgttggcggtacccgcgtcgcgcacctcaccgttgtagatgcggtccgggtccatacgcagcaggtttttaatggcttctgcaaaggtctgcaggccgagcggcgtctggaacactccctcaatcggcgactcgatcgggtcttccacggacatgatgttttcgcccgggtcctcgcgcgccagaaactcggcggagacctgacacaccgtggacttgccgtggccggtcggcccgctgaagaaggtgccgcccgagctggtcagcgcacgccggagcatggtttcctctgccggcgtcaggcccagctgctcaaagtgcaggctctgcttgcggcggctcaccagacgcagtgccaccgccagccttccctgcccgcccggccggctggcaaagcggatagtgctgaggccgtagccgttcacaaacgtctcgcgtacgcgcgcgtcgcagggctcgttgtacagcgcgttgacgaagcgcgtgccccactctgccgaatgggagtgcatcgggcgcaggttgccgtcaatgcggtagagcacgcgcgtgtatttgtgctcgatgcggatatgaatgtccgaagcgcgcaggccggtcgcctcggctatcatgccgagaatatgattctgaaagtcgctcgcccccgccacgctctcgctgcggtcgctgaactgctgcgaaattttctcgagctcctcgcggttgcaccacattacgcccgggttaagcccctggctgcgcagttgctcgcgcaactcaaagaactcggtgctggcgtccagttccttcagcacgtacaggcagtaagactggctctgctcgtcgcggataaagcggacgctctcgctgatcgccgtggtaaagggacggccgccgggaggcggcgcaagcggcagcagggtatgggttttttcactcaggttcatcatgacgtcacctcagttaagggtaaagacgcgcccgtccggcgcgcgtttgatgaccacgccgcgcatcgaaacggacatcacggtgtagccgccgctgacgctgtcgcccgggcgcacctgcgtgctgctgccgtccgcaaagctcagcgtggcaaccgttcccgccac

SEQ ID NO: 26450 - DNA, 831 bp, Glycine max
  Peptide Sequence Number=SeqID_118135
atgctgagacttgattccgttttctctgattattggttggaaagccttaccgatgatcttcagcgcatcctcagaaaagtcgtgtcttctactaaatctgatgttccggatttcgacttcaggaaaattgacagcctgacggcttcaaaagggtttggtaaaggctataacccatatattaacggcagctggttcagcaacctgtctgcatgggggcgtggtatgttcccgggcaagaatctgcgatcggaaaccctgcaggactggaaggaaaatgtccggcatatagaacgtgaaggatttcgcccggacgcgtcgttgaacgttctgtattacgagtggtacaagcgatacgtggtttcaaacaccggcggctctcatcatgcggcaaaggtcatttatcaggcccaaagagataacctcgtttataacaggcacgccgtaattgaatatctgtccatcaatcaggaagctgtcagcgagctggaagcccgatatgtttcgttcatttaccggccccgaagtaaagaggttacgtggtatgaaagagacactgtcaccggcttctgccagtcactgagcgagctggtcagtgatgacattgagtatctcaaacccgttcactacagcgaaaatatcaggctggcatttattccacgatcaggcctgaaaattgatgaaaagcagcttgatgaatggataaacacagcaatacaggcgggtaaaataatatctctgacggattatctgaaggatcctgagccattccacatcaagccttatatccatgaggttaatgggattctgctacgcagcccttttgaatcctga

SEQ ID NO: 26451 - DNA, 1113 bp, Glycine max
  Peptide Sequence Number=SeqID_118136
atgactatgaccgtttcacgcagagagggcccgttcgtggctgaactcaccggcgagctgctgagtgtccagcgcatcagtactgacgaaggcgcgctgacagggcgcggcctgaccatgctgtttgtctgtactctccggaagatgccgtggtttgtgatgcacggcgacgggctttatgcacagaacgcgcacgacgccctgacgcccctgtatcacggcagcgacgcggcgcagctgctcggctgcctaaagcggctgctgacttctgcagagactgcacgtctgcgcagccgcagacaccggaagtccggctatgccgctgcggcgctgttcctgacggggatactgctcagcatgcctgtcattatccatggcctgatcatgccgggagggagcgggcagctggcgaaggcgaattcgccgctttctgtcccgtctgaccgggcgccggttgctgcgcctcccgccgcgcctgcgccggccatgctgccgtcagacggtgagggcggccgcaccggcagtcaggctcccgcacagccgcagccgccggccacctatcctgacgacggctggaacctgccgctgaacgtgcgcgcagagctgccggcaaaactccgcagcgcggcatcacgcgcactcttcaccgtgccgctgtcttccgggcacgcgcgcaccctctatgttttcgccgatccggagtgtcctaactgccggcgcatggagcgccattatgaaacggccgcgggcatggttaacgtggtgattttcccggtcaccattgaggggcgggaggcgtcactgcagaagctgacgccggtcatgatgctgccggaagatcagcgcgcagccgcctggaagcaattgttcgccgcggatgccggcatgggcgtgccgggcgccgcgccgcgtgcgccggccgcagcggatgacgcgcaggccgagacggcgcgcggggcaatcggcgtcaacgaggtggctttccgggcgtatcgtctgccgggcacgccgtggacgatttcggacgacgggcgctacgtgccgcagggcgtgctgagctcgccggcggcgctcacggactttttaaacggaggtggccatgaccgacagtaa

SEQ ID NO: 26452 - DNA, 633 bp, Glycine max
  Peptide Sequence Number=SeqID_118137
atgcatcagacgcgcgtgcagcagcttgatgaggaggtcaaaaccagacagtacgacgagctgcacaacgccaaaggcgtgccctttatcttcccgatgctggaaaccgccgaccgtgagcagcgtaagtttggcgtgcgcacggtgttgtcctcgcagtacttccgcgacatgcctgaagcgctgcgccagtccgccaactccgtgtacatggtgggcgtggacccggaagatcgcgcgctgcttaaagagcgtttcagggtgccggatgccacgctggaccgctttgagcgcatgggcagcgggccttccgccgacggcagcggcgtgccgtttctcggtattttccgtatcaaaggcggcagcaccatcgcccatatcatgaaaaacacggtgggcccggaggagctgtggggccacagcaccacgccggtggatatgtcgctgcgccggatgctggaaaaagacaccggcgccgatacggcacgccgcattctcggacagttcttccccaacggcagcgccgagaaagtcatcgagcaccgccgccgcaccgccggcgaggcgggcggcgacagcgtcatccgtcagcttgccagtgagcttatcgataaacagggctacgacctctga

SEQ ID NO: 26453 - DNA, 3421 bp, Glycine max
  Peptide Sequence Number=SeqID_118138
gtcgactctagaggatcccgcaattgcgctgcgcccgtcagggtgcttaccggcgtcggcgcgcgcggcgtcacgctggtccggcatgacggcaagccacaccgggtagtctgctgttttcataacgcctcctgtgctgctgtgtcaggacggctactcgccgtcggtgaaccggcggtaccaccacgggcggccgctcaggcttttgccgcgcgccagacgggccgcgcgcgtgagaagttcggtcacgccccagccgaacaggttcagcagccagaacgcggcgataatgccggtgacgatgtagatcgtgtccatgcagacaaagcggaaccagaagagatagagcaggaacagccagacgggaatgccaaaaaagtcgagcctgctgccggcgcgccgccagaatcccggcggctgccaggcctgatccacgatgcgtcgcttctccgagcggaggatcccgtcaacatgctgcccccacttcgaccacggcatgccggcaagcttctcgcgcaggtagtagtcaaaaaggatgaattcgcggaccgccacgcgcttcccgtcggtggtgcgcagcagcgtctgtaccaccacacgcgcaaagacctcgccaggcgagtggatgtgcgtggtggagagcagcagatgaccgagctgaccggcgcgtatgccagcctcgatggtctcaaggtcgcgcatctcccccacgcccatgaccgacggtgcgcgccggaggtcagcgcggatgccggtcgcaaagtcgggaatgtctttacccacctgcgactgcagcggcggcagcacgtcgcccgggcgccccaggatgaactcgatcgggtcttctttggtcgtgaccttacggtcggggtccgtgtccaggcagtggcggttgtccatcagctccggctccagcccgagcgtttcaagcggcggtatctcggagggaataacgcgcagcgtccagccgatggtgctgtcctgacgcccggcggagccctgcagcaggttcacgcgaaagcggatgcgctcgccgcggttcagcccccagcggccggtcatgtccccgtccagttggattgcgcgggccatcgtgtcgtccgctacccggaagggactcgccctgaccagccggccgtagcgccccaccacaaaatggttgtcgccctgcaggtgaatgtcgctcacgtcgttgcgcgcgcaccagaccataaagcctcgcagcgcgtcggcgttcagcccgttgctgaaatcataaagttcaagttccgtggctggcatcagcgcttctccgcgccgttcgcgatcgcccgtcgtcagcttattgctgtcgccggtgaccgtctgctggcgctcggtcaccaccggcgcggtgatgaggttctggcggcgcagcagcacatactgcagcatgccgttgtagtcgcgcgtcaggcggttaacgttggcctccagcgtctcgtctgcgctctgccggccttctgtccagccctcgttaacggccgcctgccagatgtcgcgctggacgccgttctccgggataaggccgccctgcggctcgtccggcggcacggtgctgaggcccgccatcagccagctgcgccacgacggcgggttgctgacgaagcgctccggctgaatgatttcgtacacgtggcttgccgtgcggatctggtcaggggtgacgcgcgccacgtccaccgcttcggtgatgaccggcggcagccagccgcggctgctgatgagcgggcggaagtcataggtcgcatccagctgcttcgcgcgcgcctccaggtcgcgcctgagctcccacgcgcgctgcgccttgccgccgcgaaaccccagcgtgcggccgccctcggtaagcatctgcctgcggttatcggagacgtcagcggtgtcgcgcttctgcggcgacaggtgaaatcccgcgcagcccgccagcagcgcgggcagcagcaggacacaaagccgggctttcatcgtctgcccccttttttatggcggaccggctctgccggcagggatgacataaactgcagcaccatctgccccgggtacgtcacgatcgtggcgcgccaggcgctccaccgcgtcaccgttccagctgaaagtcagcctgtcgctgtcggcgcggatggccatcaccggcagcggcgtgtcacggttgagaatgcagctggcagccgcacagcagcagcgccggcagcgcgggtgccggtcatcagaaaggtgagcaggcggcgccgttcagcggctggccagccagatggaataaacttttcgtgcatacagcatgcggcgcgcctgattgctgtcggcgaatccggcgttgtaactgccgaggcactgccaggtcaggccgcagacctgcaggtgctgcgccagtatccaggcgccggtctgcacgttaaggcagggctgcgtcaggaggtcgcgttcgtcggtgatgacccccatggctttaagttttgccaggtgcgtggaattgatttgcatcagaccaaagtcgcggctggtcacgcggccctgccggtcgcggttatagcccactgcgtgcgggttcataccgctttccacctgcgcaatggcgcgcagcagctgcggcgaaacgtgatagcgggcaccggcttcgcgaaagcaataatcggtgaccgcgctgcgggcttaattacccgtcagttcgatgtatcgcgcatacaccttgcgggcgtagcgcatgcgaaacggctcatttgcatttttaaagccggcgttgtaagcgccgaccgacgtccagttgacgccgttctgcgcaatgtttctggccagtatccaggcgccgacgtgaatgttctggcaggcattagcaagcagcacctcccgcgtgatgcccatcgggcgcagtacgggcagccaggaggagttgatttgcatcatgccgaggtcttcactcagcacccgcccgttctttttgttgagcccgatggcgccgggattcagcccgctttcgacttcggcgatggcctgcagcagtcgccagtcgacgctgaaccgcacgcccgcctcccgaaagcagcgggcggcttccggtggcactgtcgccgcctgcgtcacgcatgccgcgacaagcagcaggccgccaactccgatggccggcagcacgtacaggtcaccggaggccagcgccgggggctgggacctcagccaggtgatgagattcagcagcagcgccggaagcagcataacggctgcgccgcacagtgccggcagggcgtcggtagcacccggcagcagggttgtcagcgcaagccaggagagcaggaaaatgagcaggtccggcacccactgcgtgacgcagtcgatataagcggcgctggccagcagcagcacaaacaggacaaaagccggattgtgcgtcagaaaccaggcgggaaacgcg

SEQ ID NO: 26454 - DNA, 375 bp, Glycine max
  Peptide Sequence Number=SeqID_118139
atgttggtgcgcatgatccgcactcgtctctttgcagcggcacgggtgaaatcttgccccagtatgcatagtagcagtgtgatagcctccctctctagttgtgctcgcacagttggcgctcctccaatatcagggggtggcccaggaaccgttaaaaggaaactactggtgtggatatggagcccactgaaagtgaggatacgtagtcctctaaaggtgagggcgtgcagccctttcaaggcgaggatgtgtagtcctctggaggtgagggcgtgcagccctctgctggtgaggacgtgtagtcctctcaaggcgaggacgtgtagtcctctcaaggcgaggacgtgtagtcctctcaacggtgagggtaactag

SEQ ID NO: 26455 - DNA, 345 bp, Glycine max
  Peptide Sequence Number=SeqID_118140
atggcgccagaggatatggaaaagactaccttgaaattgctggggcaacttcccatcaacgggccagtagcatttgttgaccatatactgatgcaccaagaggatcgaggtcaagtacgtgatctgaataatgccaagtctaccacaggacgaacatcgcccggtggcaatcctgctccgagtttgatacagtttacgtcacccaaaaggctaagaataattaaggaagcgccctggccaagatgtactttggctcagcagcctcttaacgactatcagcccatgcatcccgaattcccggatgaggacatcatggccttgtttgaggaaaatcattggacgtaa

SEQ ID NO: 26456 - DNA, 900 bp, Glycine max
  Peptide Sequence Number=SeqID_118141
ggatcatcctccaccgccgctactgctgcccatcgccgccacggaccatccgaagcacccacaacacctattcatccctctttatcatctccaagatcatccacattgttttcatctgatgatcagcgtctacgatacctttctcaattttcttctaggatcatcttagaccctaagtacctagacgtagagttctttaatgatgaaacatttgattgctatcaagtgtttcaaaattctggccttgttgatttcatgtcattaaaattgccatattatcctgaacttgtaaaggtcttctactgcaatttaaaaattcaggatggcattattacctctgaggtgcatggtattcctatggtcattgaccagtcattattcttttctttaactcatttacccagtcaaggtgcaccttttgagggcaccattgttgatgactggaagtttgattattctagtcatgatgctcgccgtatggcattatgggccaatgcacctctaccttatccacagttgataactttgtttctgcgtcattttcaaattctgcttgatgatgagccatttgttcaagtcaagcgttcctttgcaattggtgctggtgctgtgacttcctttggttaccgtaaggatcggaatggtcaatggctgaagaaagacgcactccctcctcaagatgagcatactccttcgcctcctcctcagcgtgaagattcaacactcctgaatgaagtccttaccgaattacgaggtcttcgttcttatgttggtgaacgtttcgactcattggatacacgctttgccggcatagatattcgcctcacacaagttgaagaagatgtctccttcatccatacttgctttgatccaccaccatcgcctccatcatcctcttag

SEQ ID NO: 26457 - DNA, 225 bp, Glycine max
  Peptide Sequence Number=SeqID_118142
atggaagtttggtacctattggaggctcccaacaaacttccaatgaaagacctttttgttacaaaacttgaaagcaatgaagctcttaaggtggttggcccttttttcttgactcaaattcttcaagggatggcaccaatcctccttccaattccctatatggcaacccacaaacaaggaaacaaagagacaagcaataaccaaagaccaaaaaaaatgaaatga

SEQ ID NO: 26458 - DNA, 411 bp, Glycine max
  Peptide Sequence Number=SeqID_118143
atggtgaaagttggaacctcttacgtgccgatcaacgtctcattttcgccaaaaagttgggccagggcttcccggtgctccagtggcttctgtttctatcagctgtcccctcctgttcagctactgacgggggtggtgcgtaacggcaaaaagccccgccggacatcagcgctggcaagtgtagcggtcccgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 26459 - DNA, 544 bp, Glycine max
  Peptide Sequence Number=SeqID_118144
atgggtggtggtgcatggccgttcttagttggtggagcgatttgtctggttaattccgttaacgaacgagacctcagcctgctaaatagctatgtggagatgttctggggccgcaacgcgcgctacactgatgtattcaacgagtctatagccttggccgacagatcattgcaattgttggtcttcaacgaggaattcctagtaagcgcgagtcatcagctcgcgttgactacgtccctgcccctttgtacacacccgcccgtcgctcctaccgaattgaatggtccggtgaagtgttcggattgcggcgacgtgagcggtttcgctgcccgcgacgttgtgaacctgcggaaggatcattgtcgatgcctcacaatcagattgacccgcgaacttgtttattcatctaccgtcgggagggaagggatgatcacggcgccccgtgcgcccggcctcctcgtcctcgcgacaaacacaaaccccggcgcttcgtgcgccaaggaactcaaatctgttaagtgcgactcccgggggcccggagacg

SEQ ID NO: 26460 - DNA, 159 bp, Glycine max
  Peptide Sequence Number=SeqID_118145
atgaaatatgtgcaatttcagtgggctaagcgtgcatccaccgctaagcgcaacttcagcgtgcttaacgtgacagaagaatctggcagggcatcaatatcaaggccacgtgctaagagcaagatcagtgcactaagtgcagcaggtgtcttcagctag

SEQ ID NO: 26461 - DNA, 444 bp, Glycine max
  Peptide Sequence Number=SeqID_118146
atgcaccctcaactagaactgatccacaagagatgtaccctctcttgttctcagtcaacaacccaagtagatgtaccctctacttgtaccacaaaggatgtaccctccaatgtgttaagacaaagatctcaggcggttaaacctttgatactttgtgaatggggatacaaaagaattctcaggcgggagaagggggacacaaaagaattcaggaggttagtccttcgttcttttagaaaagggagaagagagacacaaaaagaattcaggcggttagtccttggcgaattctttttggcaaagggagaagagatgaaaaaaatgaataacacaagttttcaaggtttagaaaaccagaaaactttggaaagcttttggaacaaagaagatgaagaagaagttcaaagagactcagaaatcaatgtggaaaaattgcttgtataa

SEQ ID NO: 26462 - DNA, 252 bp, Glycine max
  Peptide Sequence Number=SeqID_118147
atgatgctgatgttcgaaaaatgttcaacatttaacctatcactaccatttgtggaggtatttgtcataatttgtgacaataataacccaccaagccaccaatatgactcaacctccaatcttgaggacttatcagatgaataccagacttgttggatcaaaaatcatgatagtgatactgactcctcttccgagcccgaaggaagtaacttgtctccatcccatgaaacaatattcaaacaggattggtaa

SEQ ID NO: 26463 - DNA, 705 bp, Glycine max
  Peptide Sequence Number=SeqID_118148
atcctcggcaagctgcataagctacagtcgccctttgccgctcaggcgcagcagctggtggacgataacgcgaccttcaccccagcgctacatactctgttcttacaacgctggcgcttaagcctcgtggtacagaccaccaccctcaaccagcacctattagacgatgagcgcgatcagctgctcagcgaggtgcaggaacgaatgacgctcagcgggcagctagagccggtgctggtggaaaacgacaacgccgccggccgcctgtgggatatgagcgccggcgagcttaaacgtggcgattatcagctgatcgtgcgctatggcgattttctcagccaacagccggaactgatgcagcttgctgagcagttgggcagatcgcgggaagccaaactggtgccgaagaaagatgcgccgatggagaccttccgcgcgatggttcgtgaaccggcaacggtaccagagcaggtcgatggcctgcagcaaagcgacgatattctacgtctgttgccgccagagttggcaacgctcggcatcaccgaactggagttcgagttctaccgtaagctggtggaaaaacagttgttaacctatcgcctgcatggcgacgcatggcgggagaaaataaccgaacgcccgatacctcaggttcgatgggcggctttaacgagcaatgcgctaaagccttttgtctggcgctga

SEQ ID NO: 26464 - DNA, 806 bp, Glycine max
  Peptide Sequence Number=SeqID_118149
accatgtatgggggctgacgcctgcccagtgccggaaggtcaaggaagttggtgacctgatgacaggggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagtttcctcgggccagacggagattggccctcgagtgcaaaggcagaagggagcttgactgcaagacccacccgtcgagcagggacgaaagtcggccttagtgatccgacggtgcgagtgaagggccgtcgctcaacggataaaagttactctagggataacaggctgatcttccccaagagctcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggtgtgggcgttagagcattgagaggacctttccctagtacgagaggaccgggaaggacgcacctctggtgtgccagttatcgtgcccacgagcctccggtagcacagccgagacagcgatgggttctctgccccagcggggatggagcgaaagaagttttgagaattcaagagaag

SEQ ID NO: 26465 - DNA, 213 bp, Glycine max
  Peptide Sequence Number=SeqID_118150
atgcatcttgcttatcaactttcacggaatgtggtgcaagccattggtttgtttgctcaagcaacctgtgctcctgagtttggacttccaagaccgttcaatcagagattactcgtcttgcacgttggtgggggtgccgtaaaacaacgaggacaacccttcccttgtgttcaacaagaggcccacggtctcttaatcccttttcataaataa

SEQ ID NO: 26466 - DNA, 273 bp, Glycine max
  Peptide Sequence Number=SeqID_118151
atggctgctaatccgtcgagtagagaactggatgtagggatttcggggatgacgttaaggataggtatggcaggacgtggtagggatcagaaccgtgatgtccttgtggatgtgaacctttacggggcggatcacttgatacaggctgtgagtttttggatgacgccacttccaacgaaggaagatgcaaatcagggtagacgccactcacggaaggaagataagtcggtagccccgagggagatggcgattagcggaggctcttcatcctag

SEQ ID NO: 26467 - DNA, 297 bp, Glycine max
  Peptide Sequence Number=SeqID_118152
atgtcgctgcctgttctctatctttatgcgttttctagatttcccccccggggatttccggggcaggatcaccttgggctaccttctggagtggagacaaaacatgaacggcagaaaccaatcaaggtacttaaggatgaacgcaagcggggatggggtcacgaccgaccgatcgttgcccttctctgtgcgaacaagcagggaatgtcgctgcaaggcagccccgtatcctttccattttgcagctttcttttactatttgtttgttttaaaaggaaaagagtaataataagataa

SEQ ID NO: 26468 - DNA, 132 bp, Glycine max
  Peptide Sequence Number=SeqID_118153
atgaagaagatcctaggcctacaagctccaatggagcttacatcagtggtaatggtaaccctcaccattaaagataggtggcctatggatggactttcccctcaggaaacagagaatttgaggagaccatga

SEQ ID NO: 26469 - DNA, 996 bp, Glycine max
  Peptide Sequence Number=SeqID_118154
atgcctaatatttacaacgctctgatagttaagggtcgagatactgttggtcaacaaattaatgtgacttgtgaagtacagcaattattaggaaataatcgaattagagctgtagctatgagtgcgacagaaggtctaatgagaggaatggaagtgattgacacaggagctgccctaagtgttccagtaggtggagcaactctaggacgaattttcaacgtgcttggagagcccattgataatttaggacttttcggtggagctggagtgggtaaaacggtactgattatggaattgatcaataacattgccaaagctcatggaggtgtatctgtatttggcggagtaggtgaacgtactcgtgagggaaatgatctttatatggaaatgaaagaatctggagtaattaatgaacaaaatattgcagaatcaaaagtagctctagtatatggtcaaatgaatgaaccgcccggagctcgtatgagagttggtttaactgccctgactatggcggaatattttcgagatgtcaatgaacaagatgtacttctatttatcgacaatatctttcgcttcgtccaagcaggatctgaagtatctgccttattgggtcgaatgccttctgctgtgggttatcaacccactcttagtactgaaatgggttctttacaagaaagaatcacttctaccaaagaggggtccataacttctattcaagcagtttatgtacccgcagacgatttaaccgatcctgcgcctgctacgacatttgcacatttagatgctactactgtactatcaagaggattagcggccaaaggtatctatccagcagtagatcctttagattcaacctcaactatgcttccaacctcgaatcgttgggaagaacattatgagactgcgcaaagagttaaacaaactttacacgttacaagaactttcagacattatagctatccttggttggacgaatattctgaagagatcgcttaa

SEQ ID NO: 26470 - DNA, 288 bp, Glycine max
  Peptide Sequence Number=SeqID_118155
atgggttacatagaatctgatcatgtacaacatgatgtgccttaccaagttgaggaaatgtcacatgtaaacgaagtcattgaagttgaaagtatttgtgcattgcaagatttagtaggaggtgtagaagaagtagaccctactaatttgttgagaaatgaagaagattcaaataatttaaatggagaatcaaagaatattgaacaagacaatgaaggggaattagaagatgaatttgaagtttacaattctgaagatgaggattatacattgatgttgtggagctaa

SEQ ID NO: 26471 - DNA, 660 bp, Glycine max
  Peptide Sequence Number=SeqID_118156
atgagtcttcattcttcatctagtgttaatggtgagggttctactcctaaggaccccttgtataagatattagatgagttgagatcccttaagttgtggaaagaaaaacaagagagaaaagaaaaaggaaggcataggtcacatcttagacctcactcccatagaagagaaaaggaaagaaagcctcaagaggctaacattaacctcccatacttccatgggaaggacaatgtagaggttaacttagtttgggaaataagggtagagcaaaaacttaaaaagaagtctacatcaaaatcttatggctctcactcttatccaaagaaagaccaaggtcaaggcatcttaggggtgacaccttctaagcccaaagatgataaggggaagacaatacaaaagcaagctcctaaggctagtatgcaagagaaaactagctctataaagtgctttaaatgtcttggaagaagacacattacttttcaatgccccaccataaaaactatgattatgaggggccaagatatttatagtagccaagataaggctactacttcaccttcctctagtgaaagtgaaaaagcaaaaggggaagaatctagtgaagaaatctacccccaagaagaaggacaaccattagtggttaaagagaagtgtaaggag

SEQ ID NO: 26472 - DNA, 163 bp, Glycine max
  Peptide Sequence Number=SeqID_118157
atgactcataactcaactatggaggagttgataaacaaaatacaactctctcccaaaataatgccaacgtcgtcacgtcagcttggctcctcaccagaatcttactccctgcaccctgctactgtcattctgctcccacgaacaatgttcgcgatcatcacag

SEQ ID NO: 26473 - DNA, 237 bp, Glycine max
  Peptide Sequence Number=SeqID_118158
atgagttgtacaggatcgctaagtgcaccacttcatctcactaagcgcaccgcttcagttcatccgctaagcgagaaaggcgcgctaagccaaaaatcactaatgtgcgctaagcggtccataaatctacagagaccaaagcttgaagcaagagccgatttgagagctagagatgagtttgtgagtgattgtgagatcctagaggtgaaggagacatcctcaccacttgtattttag

SEQ ID NO: 26474 - DNA, 306 bp, Glycine max
  Peptide Sequence Number=SeqID_118159
atggttttctcaaaaaccataactcttccaatgagaattcaagggactaaccgcctaagaattctttgtctcaacacattggagggtacatcctttgtggtacaagtagagggtacatctacttgggttataatactgagaacaagagagggtacatctcttgtggatcagttcaagtggagggtacatccacttggtttctcaaagagaacaagggagggtactggggatggtccacgtgcatcaaccgaggatggagatggtgtgaatgctggtaccgtggatggtccaggtgcatcaacatga

SEQ ID NO: 26475 - DNA, 522 bp, Glycine max
  Peptide Sequence Number=SeqID_118160
atgttgtggctggccagtttgaacgtggactattggttggaggttgtcttccggcaagtttcaggaaaaggtagaagggtagtcttcaaattaaaggacttaagccagcaattgctatcttgcactttgtgggatgattattgcttgcagtttttgaagttcttagatgattatgaaggatcttatcccgcatcgatcaacaattttttcaaggcttcaaagttaattattaaccagcccgtgatggagattcaagaattcaatgaacgatattttttgcttgcagagttgggcattgatgcccggttaggttttaaatcccatggtgaagggagtacacaactttcaggttctatgcaattatcatcaaaagaatcattctttggcaaggctgaggcaaagactattgctgacattaacaccatctctaaagaaattgtttgtgtcactgttggcacaattactaggattgttctggacaatcattcatggtgttatacagcttgcattcagtgccattaa

SEQ ID NO: 26476 - DNA, 405 bp, Glycine max
  Peptide Sequence Number=SeqID_118161
atgggtgaagcagaggaggtgcaagagaagatgaaggccgacatggaggccatgaaagagcaaatggccacaatgatggaggccatgatgagcatgaagaagataatggaagccaatgcagttatagttgccgctactagcgctgtcgctaaaggtgaacccgatgctcccatctggcctcaagcaaatgaatcatccaacctcaaatatgccagcttcgagccttgcctcggatatgctgctgaagggcaagcagttggtggtatacccctgcaaaacactttggagggccctcaatatcatccacaaccacaaccctcacgttccacagcggttaaaaaccctcatgactatggcaggaatgggaaagttggatcatctagaggaaaggctcagggccattga

SEQ ID NO: 26477 - DNA, 546 bp, Glycine max
  Peptide Sequence Number=SeqID_118162
atgtctcctatagtagtcataactcttgcaaagcctagtaaagaacttcgtgactattatgaaggaaggcataggtcacatcttagacctcactcctatagaagagaaaaggaaagaaagcctcaagaggctaacattaacctcccatacttccatgggaaggacaataagtctaggtcaaaatcttatggctctcactcttatccaaagaaagaccaaggtcaaggcatcttaggggtgacaccttctaagcccaaagttgataaggggaagacaatagaaaagcaagcccctaaggctagtatgcaagagaaaaccagctctataaagtgctttaaatgtcttggaagaggacacattacttctcaataccccaccataaaaaccatgattatgaggggccaagacatttatagtagccaagataaggctactacttcaccttcctctagtgaaagtgaagaagcaaaaggggaagaatctagtgaagaaatctaccccaaagaagaaggacaaccattagtggttaaaaagaagtgtaaggag

SEQ ID NO: 26478 - DNA, 306 bp, Glycine max
  Peptide Sequence Number=SeqID_118163
atgaccaaccctctcaatgagtcaatctcatgctttctcataagggtggacccttgggtactagaacctattgcctttagaggactacacgtcctcgccatcagagggttgcacgccctcaccatcagaggactacacgtcctcgccatcagagggcttcacgccctcaccttcagaggactacacatcctcgccatcaaaggactacacgtcctcgcctttagaggactacacgtcctcgccatcagagggctgcacgccctcgccatcagaggactacacgtcctcgctttcagaggacttcac

SEQ ID NO: 26479 - DNA, 415 bp, Glycine max
  Peptide Sequence Number=SeqID_118164
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 26480 - DNA, 354 bp, Glycine max
  Peptide Sequence Number=SeqID_118165
atggaggagttgattaacaaaacaaaactctctcccaaaataatcccaatgccatcacgtcggctcgatggctcctcaacagaatctcacttcctgcaccctactgctatcattctgctcccacgaacaagtttcgcgatcatcacaggcaaagtatgcggtaattatcgaggccacccaatcgtgcaccacaagggggttccttaccaggtgacgcaccccctagtacaaagtacatactgccatagtttatactattttccatgtcatataaggcatgaaacatgggcaccatcaagtacaatgaccatggatgtgttaaagatcctaagccatcccctcagagatgcttaa

SEQ ID NO: 26481 - DNA, 261 bp, Glycine max
  Peptide Sequence Number=SeqID_118166
atggggggtgcaaatagcacccaggcccacttgggccctccagaagattcctccagaaggctgttgcttctggaggaagcaaccttggctcgcctgggcgagctgggcggcaagcatctcccctattttgctataaataggggaggaaccgaggcgcttccgaaacgttttcgtaacgttttccgtgaagaatttcgcaaaggtttcaaccgttcttcgacgttcttcattcgttcttcatcgttcttcgatcttcaacgg

SEQ ID NO: 26482 - DNA, 276 bp, Glycine max
  Peptide Sequence Number=SeqID_118167
gtctgagttcctcgttggaggatacgtaggagcaagagcctcgctaatgtcgaccacaccaccttttgttgccatgacccaagagctggtaacccgcggagacaccttacagttatccgcacctcgtcattcagtgacccccagtgtgattgataagcagaggccaatgtggtctgagttcctcgttggaggatacgtaggagcaagagccttgcttttgtccgaggccggcggggccccacgcgaaaattgtcatactgacccctttgaggccat

SEQ ID NO: 26483 - DNA, 312 bp, Glycine max
  Peptide Sequence Number=SeqID_118168
atgatgacattcaagaatgagttcaagattgagtcaagaacacttcaaggatcaagaggaaatttgatttcaagaatcaagattcaagactcaaagattcaagaatcaagagaagacttaatcaagataaattgtaatcgattaccagtgacgtattttcgaaaaatgagagtcaccttcccaaaaagcttggggaaatttgattcctctagaatcgaccgcacatcaagttcaagattcaagttccaagaatcaagatcaagattcagactcaagattctagaatcagagagactcaatcagaaagtataa

SEQ ID NO: 26484 - DNA, 785 bp, Glycine max
  Peptide Sequence Number=SeqID_118169
atggtgaaagttggaacctcttacgtgccgatcaacgtctcattttcgccaaaagttggcccaagagcttccccggtgctccagtggcttctgtttctatcagctgtccctcctgttcagctactgacggggtggtgcgtaacggcaaaagcacccgccggacatcagcgctggcaagctgcgcaactgttgggaagggcgatcggtgcgggcctcttcgctattacgccagctggcgaaagggggatgtgctgcaaggcgattaagttgggtaacgccagggttttcccatcatcagaagagagtccattgcctatgtatcatggaactgtgcaatcactatggaatagttccatgatacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 26485 - DNA, 225 bp, Glycine max
  Peptide Sequence Number=SeqID_118170
atgtattgtcggaagatgggggcatatgcaaaagatgaggaattgctgatacattccttccaaagaaagtcttactggggtagctattacctggatgcaactacagaacatgtgcaaaaaggagggagatctttcaagagaagcccagaaggcgacatggaggatcctaaaagagcaaatgtgttccacaatgatgaagaagaaataatacatgatgtagcatga

SEQ ID NO: 26486 - DNA, 718 bp, Glycine max
  Peptide Sequence Number=SeqID_118171
gtggacccttgggtactagtacctatcacctttagaggaccatatgtcctcaccatcagaggactgcacatcctcgcctgcacagggctgcacaccctcgccgttagagggctacgcgtcctcattttcattcctgggctatcccctgatattagagggcgaccaactgtgcgagcacatctagagagggaggctatcacgcatctactatgcataccggggcaagatttcacccgtgccgctgcaaaaagacgagtgtggatcatgcgcaccaacatgaccacttttacatggatatggatgacgttgctatttagtaacattctgcccggcgaccacaatgccaatctccccctgcagatgtatcgggatcgcgcccacaagacacccagtgggcccgaagaagtccaacagggccctagggttttcagctctggttacgggcctctgtcagtcctacagggtgcccgtacccccaggcaagggatcgcgcccgcaagacacccagtggacccaaagaagtccaacaggttctacggagtgcctgtcacctccagcaagggcatcaggccccccactaatcgagctttcatcaagaagtactgcgtccccaggcaggcgcagggcgaaacaccacagcagcctagggatggccggcagcgggcaatagacgcaccgccatcacctctagagttcacctcagctcatccacaaaaag

SEQ ID NO: 26487 - DNA, 312 bp, Glycine max
  Peptide Sequence Number=SeqID_118172
atgttttatcaacaagcagctgtgtcttcagcaaaacctccagaaagcccagatgaagaggtcgatgatcccctgtacctgatgacattgactatcccacaactgtttttgaagccactccaggttatgtgggatgctaccatattcggggtgtttaatcaaaacttcccattccatctgactgagacaagtgtgcgagcggagaattctgatgtgtatggattcctcgagccacagtccattcagagatctggacaatcacaatttgaatccgaaagttacatcaagagttggatacagagttcaaaatga

SEQ ID NO: 26488 - DNA, 52 bp, Glycine max
  Peptide Sequence Number=SeqID_118173
atggcggcggggacgctattggtggcgatggcggcagtggccacggtggaga

SEQ ID NO: 26489 - DNA, 555 bp, Glycine max
  Peptide Sequence Number=SeqID_118174
atggctttcctttcacatccttatttctttgcagctttatctgcacctttgactcttttggtggtccaaattctgttcagaaaactgaacaaaaggcataatagaaagaagtaccaccctgttgctgacaccatcttcaatcagatgctaaacttcaacaggctgcaccattatatgactgatcttgctgccaagcacaaggcttacaggctgctcaaccctttcagatatgaggtttacaccactgagccaactaatgttgagtatatactcaaaaccaattttgagaattatggaaaggtaggtgctggatttggatctaagagaaaatatatgtttcggaaagtgaccatccagctcaagcttgtggagggtgactctgctggaactggaccatttctatctcaatgcattgagcttttctcaagtgcagacaacccgatttgcatcaatgaattgaatattaccagtttaggcatcatggagattcctatttgcttaggtggctccatttcatccactggctccactttatatgtgctcatgttttcctga

SEQ ID NO: 26490 - DNA, 390 bp, Glycine max
  Peptide Sequence Number=SeqID_118175
atgagaagcaaatcagaagctagggacagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggttgcttttgccgtacgcaccaccccgtcagtag

SEQ ID NO: 26491 - DNA, 653 bp, Glycine max
  Peptide Sequence Number=SeqID_118176
accacctggggaagagagactggtggtccacgtcgatcctgcgatcgggaaggtcgatggttcccacaagaagaaattaagaacttatttggggattgtcgctcgtgataaggtcgacatgacatacaagacttggaaggaagtccctgctgctcagaaggatttgatatgggaggatattcagattgtcggcgagcgatggagacaatttaaatctgatttgacgaggaaatgggcgcttgcagccaataaggacagtgtggacgacattgtttgtgaaaaatacgacattagcaaggagaaatgggcccagttttgtcagacccacagagacctctcctgggaggccatccagaagcaaaacaccgccccccacttgttgtctcgtgggggttatgaatatttagaacagaagctgatggctgagaagacaaagaaaaaactagaggaagctgctcaatctggaagcattgagggcatgattgacccttcatctcccatcagacaacacatgaagtgcaagatggcccacaccaagaaaactgggcagatgacgtttgaggcaacaaaggaaattgctgacaagattgatctcctgactgctgccattgggagaccagaacaccctggccgtgtgcgtgctactggagccg

SEQ ID NO: 26492 - DNA, 308 bp, Glycine max
  Peptide Sequence Number=SeqID_118177
aaaagcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgatggtaggagccttcattcctaacggattcaagtag

SEQ ID NO: 26493 - DNA, 324 bp, Glycine max
  Peptide Sequence Number=SeqID_118178
cgggtcaccatgtataggactaactggggtattggtcacagtataaaagacattttagaggctcataaaggtccatttacgggccagggtcataaagctcaccatatgtattctatgcccccttatccatacctagctactgactatggtacacaactgtcattgtttacacatcatacgtggattggtggatttctcatagtcggtgctgctgcgcatgcagctatttttatggtaagagattatgatccgactattcgatacaacgatctattagatcgtgtccttagacatcgcgatgcaatcatatcacatcttaactgg

SEQ ID NO: 26494 - DNA, 587 bp, Glycine max
  Peptide Sequence Number=SeqID_118179
ttggccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgccttagatcagacagattcttctgacaaagaatcttcagcttctccaatccacatcttctctatacaagaagaacagtctatcaggccagtgattcctcaaccattcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 26495 - DNA, 288 bp, Glycine max
  Peptide Sequence Number=SeqID_118180
atgtgtgtgtgtgtgtgtggctgtgtgtgggtgtggctgtgtggctgtgtatgtgtgtgtgtgtgtgcgggtgtgggtgtgtggtcgtatgcagcaagatctcagctgcagcaaggacttaaaataaattatgggaagagcagctttggggtgttgggccaatctgaacaatggaaattgcaggctgccagttatctgaattgcagaatcatgcctctgcctttctcttatttgggaataccaatcggggctaatccagaggaggttcctatagggtggtggccttga

SEQ ID NO: 26496 - DNA, 228 bp, Glycine max
  Peptide Sequence Number=SeqID_118181
atgatgacaaaggtgatgaacaaaaagctcaaaagatcaaagaacaactcacgtgaatcaaagaacatctcaagtgaatcaagaacaagtcaagagttcaagaatcaagaagaattcaagactcaagaaaaaagcctacaaacaagaatctggattcaagattcaagatcaagattcaagactcaagattcaagaataaagaaaggactcaatcaagataagtattaa

SEQ ID NO: 26497 - DNA, 411 bp, Glycine max
  Peptide Sequence Number=SeqID_118182
atgatgtttgtctttacttctgctggtattaagtttgacaaatcaattaatcattcaagaggacctcctacaataagaattcaaggccaaccatgtcacagaatatgcagcatgttaccaatgcttgggaaagaacctaaatttgtacaattgtatatctttgacacagaaaatgaagtgcataataggattaatgcaataagtccacataatcaaattcaagggcacattgtttcacaacttagtgagatgctggatgaatacaacatgcatgcaaaaactttcaggatgacaagagatagattgcaagatggtcaagtggataatatcaagttgaaattgattgctaaccgtgaaaaagatggtcatacatataatgtacctactattccagaagttgcagtgataatt

SEQ ID NO: 26498 - DNA, 627 bp, Glycine max
  Peptide Sequence Number=SeqID_118183
atgttggatcaatttgcgccattcattcaaggtttcattcgtgacgttgtggatgtgaatgcagatggtaactgtggatatcggtcctttgccgctttattaggtacgggggaagatttgtggtcgttagtgcataacgaattgattaaagaacttggcaggtggtcgcatgagtacatgaacctcttcggtggcacagagagatttgaacaattaaagttgtccctacttgttgatgggttttccaagtttaaatcagagtcttttgaggttgcaccacgtattcgcaagaatctttttcttgtccggtttattgaaagcacgcacggtcttccttgtgcataccaagggttatgtgagacggaagtcaccatcaaggaagagatagaggtcatatctaaaaggtttgatgaacttgatgtgactggcaaagtaactctgaagagtaaacttcgagaaattgcataccctgatcataactctatgtgccctcctccgtcaaaggtcaacaataaaggtgcaccgaagaaaccgatgaaaagaagtcaaacatccacaaagcgtgatccgtcttactgggagtatgttgatgcttttcattctgttcaaagcagcaactctcagtga

SEQ ID NO: 26499 - DNA, 291 bp, Glycine max
  Peptide Sequence Number=SeqID_118184
atgtcgttgcagtcacagaagcgcaacccagtttgtgacaaagacgaactcaggcagaaggagaaagaagaagaacaccctgggagtcttaaggcgaaccacaatggacttccaaaatcgattcccaccctttccgggactctttcctttcctagttttcttcgagctgcgaaaggtgtacctcaatcgataagtggtagagacgaactccacaaacacgaactccacaatgtggttgcagtcacgaaagctgtaacgacccgcctcgtcgctacggtatccacactctaa

SEQ ID NO: 26500 - DNA, 300 bp, Glycine max
  Peptide Sequence Number=SeqID_118185
gattcaacaagcgattctcctcaaatttcagccagcccgtatcaattagaccttgcaccttacgcttcagagccctacaatgctcaatggaacgccccggggcttctccgtgacaagcacacgttgcgttcgagtcgtattcttcggagaaatggaggtggtgttcgtcattggaagtgcggtagacaggctttgtggttgattttagggatggcctttgtggataactgggtggtgggtaaggaggagatccacttcgatcctttcactggcgaagaccaaatccgcaaagctttgagg

SEQ ID NO: 26501 - DNA, 405 bp, Glycine max
  Peptide Sequence Number=SeqID_118186
atggtgcggtatgcaccttcaagctttgcggatttggtcttcgctgacaaaaggatcgaagcgggtctgaaaagaggaaaatttgatcatcttgctttgatgaatgagaaaactggggcaaatgaagaggatgagaatgaggaaggaacccatgttgaggttgccattcctacatggccaaatttcccatcagcccaacaatgtcattactcagccaatatcaacccttctcattacccaccacctagtcatccacaaaggctatcccttaaatcaaccacaaagcctgcccgccgcacatccgatgccaaaacatcaaccaaaaaggaattttgtagcaaaaagcctgtaggattcactccaaattccggtgtgatatgctatcttgctcccatatctacttga

SEQ ID NO: 26502 - DNA, 108 bp, Glycine max
  Peptide Sequence Number=SeqID_118187
atggctactagtggtggtctactagttgagctcactaaccaactggaggctcggtccggcaactacgatcgtgtcccgactactaatgggggtgctactactagctcg

SEQ ID NO: 26503 - DNA, 493 bp, Glycine max
  Peptide Sequence Number=SeqID_118188
atgggtgaagtagagaagacacaagagaatatgaaggccgacatggaggccattaaagagaaaatggccacaatgatggaggccatgatgagcgtgaagaagataatggaagccaatgcggttgcaattgccgctaccagcgttgttgctaaggtgaacccgacatccccatccggcatcaaccaaatgaatcatccaacctcagatatggtaggcaaagatttgggaagtacgggcggcccccataatgtgcaaattcaaaacgagcacgccttcccgccatatggcttgcctctcaactatacgccacccaatgtggcgtacactcccaatgaaatctcaataactccactcccatactcattaagagccaacaacctcaatctgatcatgcacatgtctctcatggaggagacacatgaaattccccaccacaatctagctgacttcgagccttggctcggatatgccactgaagggcaagcagttggtg

SEQ ID NO: 26504 - DNA, 837 bp, Glycine max
  Peptide Sequence Number=SeqID_118189
atggtggctgacggacgtttaccgtcacgcttaaagagatcgctggatgcggcaaagcgtccggcaaattcccccagcgacagattccgctccagcccagaagcggcgcacggcatcgcgataatgatcgttccactcggcaaacagcggcgggaaattcccgacctgatagccgccttcaccgatgtcccacggctccgcgatgagcttgacctgcgagagcaccggacaattttttatcgcctcaaacagcggcgcctgctggctgaacgccggcgtgcgccccatgacgggcgcgaggtcgaaacgaaaaccgtcgacgtggaacgtgtctacccagtatttcaggcattcatacgcaaaatgcgtgaccgccggatggctgagattgagggtgttaccgcagccggtccagttctcataatcgccatcctgcctgatccaataatagctacggttatcaattccgcgcatggagagcgtcgggccgtcgagatcgctttccgcactgtggttcagcaccacgtccagaatgacctcaatacccgccgcatggagcgccttcaccgcgtcgcgaaactcgtcccgcgccttgtcaggatggacggcataacgcggctcaagcgcgaacatcgccagggggttgtagccccagtagttgctcagccccagccgctgcaggcgaggctcgctggcgaaatgggcgacgggcagcagttccagggcggtaatgccaaaggtgtttcaggtaggcgaccatcgtcggatgcccaagcgccttataggtgccgcgcatctctttggggatcgacggtgcaggtagggtcagccctttga

SEQ ID NO: 26505 - DNA, 102 bp, Glycine max
  Peptide Sequence Number=SeqID_118190
atggagctggaacgcctgatcaaaagactctcagacagtggcattgatgatgctgatagaagatgcagtaagagcatggagacagggggagcaaaaagctga

SEQ ID NO: 26506 - DNA, 1582 bp, Glycine max
  Peptide Sequence Number=SeqID_118191
atggggcaagctgcttatttttctagacatcatgatgttgagcaagagtaccactttggcttttatgtatctgtaccagagaagttgagatggcctgttcttgtgatagccatacttgctgcggttgtgggaagccaatccatcatcactggaactttctcaatcatcaggcaatgctctgcattaagttgctttcctagagttaaagtggttcacacttcatccaaaatccatggacaagtatatatccctgagatcaactggttgttgatgctcttgtgtttggctgtaactattggttttagagacacaaagcttatgggtaatgcatcaggtttggcagtagtctcagtgatgctggtcacctcatgtttgatgtcactggttattgtaatctgctggcacaagaatgttatgcttgcaattgggtttgttctcttctttggcaccattgaggccctcttcttctcagcttctgtgatcaagttcttcgaaggagcgtgggtgccggttgctttggcatttgtgtttctgtcagtcatgtgtgtgtggcactatggcactctcaagaagtatgaatttgatgtccaaaacaaggtttcacttagctggttactcagccttggccctaccttaggctttgcaagagtacgcgggattggccttgtgcacactgagctagtgtctggaatccctgccattttctcccactttgtgaccaacctaccagcattccaccaaatccttgtcttcctatgcatcaaacatgtgccagttccacatgttaggcctgaggaaaggttcctagttggtcgtgtcggtccaagagacttcagagtttacaggtgcatagtgaggtatggataccatgatgtccacaaagatgatgatgagtttgagaaagaccttgtgtgcagcatagcgaagttcattcaagcaggaagtggtggtggatgcaataactcgtcaaatgatgagcctgaaaagggtggtggcaaaatgacagttgttggaacctgttctagtactagccaccaccccattttggttagtgagaatgctcatgagattaatcatgtggacaaagctgagacatcatctgagtcacacaaggtggtcaaaccaaagaaaaaggttaggtttattgtgcctgagagtccaaagattgacactggtgcaatggaggagttgaaagaattaatgcaagccagggaagttggggtggcctacattataggacagtcctacatgagagccaaaccagggtccagcatgttgaagaagttggccattaatttagggtatgaattcttaagaaagaatagtagagagccctcctatgaacttagtgctccccatgcatcctctttggagcaaggattagctttccgtggtcatgatgaatcaaccaattctgctaaccaagatattgttaatgctgctgcattggaaaccactaatgctattattactgatcttggagatgaattatttgttatcattgttgatgaagcacgtgacatatcaaacaaggagcaaatggctattgctttgtgttatgttaacaaaaagggaagtattg

SEQ ID NO: 26507 - DNA, 553 bp, Glycine max
  Peptide Sequence Number=SeqID_118192
atggcttggctaggagaccaaccttctccttttgaagcagatgtacacatggctcaggagaaggggacttccacagaccagattccagagccatctccagcacccatacctgacgattccatgccatctgcaccagcatctgagctagagcagcttatctctcaggattcaccaactgctcaatcattagaagagaatgagcatgcgattggaagtatgactgaaaatgttagtcaatttgtcaaattgattgtgaaggaatgcattaaccgtatcccggccatgtttgattgtgatagccacttagccaaaaatctgaccacgtgcttgaatgatttatcccttgcacctagagagcatcatccacagaagcttggttcaaagcaaatttgtcccaaatttgagggagcaattatcaagctcaacagttgggctaagcgcgcatccatcgctaagcacaacttcaacgtgcttagcgtggcagaagaatctggtagagcatcaatatcaaggtcgcgcgttaagcgcgagatcagtgcgctaagcgcagcgg

SEQ ID NO: 26508 - DNA, 285 bp, Glycine max
  Peptide Sequence Number=SeqID_118193
atgctttgtgtaatcgattacaatgatttgggtacatcctttgtggtacaagtagagggtacatctacttgggttgttgtaactgagaacaagagagggtacatctcttgtggatcagttcaagtggagggtacatccacttggttgttcaaagagaacaagggagggtacatcccttgtggatctttgcttgtaaaggtttttacaaggttgaaaagaaatctcaaggaccgtaggtcgcttaggaactggatgttggcacgggttgttgccgaaccagtataa

SEQ ID NO: 26509 - DNA, 300 bp, Glycine max
  Peptide Sequence Number=SeqID_118194
atgtcagatatgcctttgagaggcttgaaaagtgcaagaaaacgaactatgttttatgcgttttttggaaaacgcgatgaactcgctaagcgagttcatcagtactcattgtatatggcttccagaaagagaaagagtattggtacaaggcccatagctcaatatgatacaaagaggttccattcctttgaggcctggacccgatacacagataatgttctaggaagacatatactgtctaagaggaaggtagaaatataccatactgagctggacgagtttaagggtgggatcctctag

SEQ ID NO: 26510 - DNA, 755 bp, Glycine max
  Peptide Sequence Number=SeqID_118195
tgctgcaaatgttgttgttcaagtgaattctatcccaatgttgaataggactaactttaaggtttggaaggaagccatagaaattgttcttagctgtatggatttagacttggcactaaggatggaacaacccatttccactacgaaaacctctaatgaggcaaaaattgggaaggtcaaggtcaaagtgcaatggaatttcttgagaaaattgaacattactttgccaaaaatggaaagatggagacgagtaacctttttggctaaactcatctccatgaagtataagggcaaaggaaatatcaaagaagacattatggaaatgtttaatcttgcatcaaaactcatgtcacttaagcccgattggtggtttttagtgcttttgtgtgggggtgacaacaatgatgatgatggtgtgagtagtaatgacggtagagataccagtggtgttgagtttgggaagaaagagaacataaagaatattgcctttgagaaagaatttgttattgacaatgacccagttctcacacctattattgttcaagatacaactcccataatagaaaacaatgttcaaacaattgttgatgacactattctagaacatgacaacaatgtggttctccctcaaatacctatagagaaacctcaacaacaaaatgaggatggtgttggtttaatagaggaagatcaaatcaacttctgtcaagctatgtgcaattcaaactctcaaaaatggattgatgccatgaagg

SEQ ID NO: 26511 - DNA, 213 bp, Glycine max
  Peptide Sequence Number=SeqID_118196
atgaagaaggaacgaagatacttgatgtacaccgctccaccgcccaatgatgaagaattgatgcaagcggcaagccgcagtgtgataacatcacagctagagtttgcactttgcaggaagcaggtcgatgatccattccgtttgcatcttgttgacaaccacagacgcgtggcagtcgcactggcaggacacggtggggcccatagtggttga

SEQ ID NO: 26512 - DNA, 159 bp, Glycine max
  Peptide Sequence Number=SeqID_118197
atgaatgaaggatcactttgggtgatggtcaggaccacaccgatttggatctgctcgcaatcaaggaagggagttagggaagatgggatggcgaagcctcgaccatcaccccgagtccagctaaagacgttaaagaagcactctaaggaggcaacctag

SEQ ID NO: 26513 - DNA, 297 bp, Glycine max
  Peptide Sequence Number=SeqID_118198
atgcagaaaaagctgtcaaattgtgcagcaaattttgccaattatgcagaaaaatggttgtgcagtgctagtcacgcgaaagcttggagggttgatggggacccggtgctgagaggaacgaggagaaggctatgtatgtgcacagtggtacctggagatatgtcgcgggagtcaggagaccttggggacgtcaggtggggtgctattgcccaaaaccaagcttggccaatcccaacccaacccgggcatagtcagtcagtgagaacctgtgacgtacctatgcaggcgagctcctag

SEQ ID NO: 26514 - DNA, 432 bp, Glycine max
  Peptide Sequence Number=SeqID_118199
atggcaaacaatgaagctgaaagtgatgatgatgataactatgatcagctactagatgttttcaatgaaatgcatcaagaagcacaaaagatgtatgttttagaagtaaaggttgaatgcttgctaaaacctttatccaagttcactatgtggagaaacaatttggaagcattacttgcacaacaacaatatgctattgaaaagggtacatcctttatggtacaagtagagggtacatctacttgggttattgtgactgagaacaagagagggtacatctcttgtggattagttctagtggagggtacatccactaggttgttcaaagagaacaagggagggtacatcccttgtggatctttgcttgtaaaggattttacaaggttgaaaagaaatctcaaggaccacaggtcgcttggggactggatgtag

SEQ ID NO: 26515 - DNA, 1920 bp, Glycine max
  Peptide Sequence Number=SeqID_118200
atgcgatgcttcacttttagagatttccagctagtactcatgcttgaggagtttgaaaagattgttaaatgccctctgagaggaactaagcctttcttccctttgggacactctccgtccatgcctagattatccaaagtgatgggaatttcagtgactgaactcagagagaaggaggtgaataggaatggagttaggagcttcccaaagaaattcatggagcataaggcacgagaatgtgcaagtaaaagagagtggaggtatttcatgagtattctagctctcttaatatatggagtggtccttttccctagcatgattgaccggattgatctggcaacagttgacacattcttagcctattattatcgatgtgaaagtcctgtggttgccatccttgctgatgtgtactatactctggacttgagttgggaaaagaaaagcactagagtcatctgttgtttgcccacactctatgtatggatggtatctcattttgtgatgcataatggtaggcctacttctccattagaagatttttgcatggcacctgataagagcaagattaattgggaggagcttttggctagcatgataggttcaacaatttgttggttcctaaggtgggaggaggtgcctaatgtgttatgtcgatgtggagctttccctaacatccctctgatgggaacaaagggttgtgtcaactataaccctatgctagggatcaagcagttaggatacccaatcaacggaccaccctcgaatggagctatccaaccattcattgctcgaggattgaacaaagaacatctcggtctgcaccaacaaattaggaaggcgtgggactcaccaaataggagggacaaggagttaaggaagaaagatgaagatgtcaaggtgcctaagaagaaaaatgatgaaagggtcgagatagatgtacctattgagacggaggaggcattggagcaagaaatgagaagggataaaggggaagaaacgaacaaaaaaaggtaccaaggagctttgtcaggaaatagtaatgaactcaaactgagaagggcagagagggaccaagcaataacaaaaaaagtgacactgagagataagttgaaagattgttgggagtcaaaggaaagcttgaaggagtggctaggcatgatggaaaagaatatgctagtaattgttgatcaatacgagggtgaaagagaagcaagggaggaagtgatagagctactacatcaggaaagaaggaaatggatgaataggtttgtgatcacactaaatgaaagtcaagagctcccaaaactgcttgctagagccaaggcgagggctgatatatactctgctcctgacgaaattcatagtcttttttattactaccaacacatggaacaaatgaaggctgacatggagaccatgaaggggaaaatgacaataatgatggaggcggtgatggatatgaggaagataatggaggttagtgctgttgtagttgttgctgccaataccgctactgagagggacccaactcactcgcccattgttaatcaagaaagtcacctagtgttagatgtgaaaggtcaaggaggtgtgacggggaatgttactaatcctatccctgtttgtactgagaatcatcaaactcaacccgatcatactcatgcctataactctaatgccagggaggaggcacgagaagctcccatagaccacactgtaactagttttaggccccatccaggatataccgctaaagggaaggcattttttggcatccctgtgctgaacgctcctggagcctctcaatattgcacgttgtcacaacccttgcatttcctaaggggggaaggacctcccttagtatttgagaaggaaaagattgagcatatagaggagaggttgcacaccatcgaaggatag

SEQ ID NO: 26516 - DNA, 135 bp, Glycine max
  Peptide Sequence Number=SeqID_118201
atgacattgcttgattcaagtgcatgcatcaacctgatgcctctatctacactgatgagagttggagatgtagagggagattcaaactcaaagtgtaggatgaggatgtatctttcaatgagtttgactctatga

SEQ ID NO: 26517 - DNA, 147 bp, Glycine max
  Peptide Sequence Number=SeqID_118202
atgttgaatgaaaatgctgagttcaaagcgcttgctctaaaagaaattcgcacagcatctgatggaataagaaagaaacagttgtcatactttgtgacagaggtaggactactgtgtgtgtttcaagtcaagttggatgtgccatga

SEQ ID NO: 26518 - DNA, 483 bp, Glycine max
  Peptide Sequence Number=SeqID_118203
atggtgtgctggtgcgaggtgccacgtcactggtgcgtggtgttggtgttttcgtcgcattggagttcgtcgtcatcgtcgtcgcgctggagttcttgtggtgccgctggtcgcactggagtttgcgtgttgttgttcatgcttgcgctgctaatccccttttgtatgcgaaaatcgggtttgggtcgggtcggtgatgaggatgtagagaggcttatcgagcttgtgaagggaatttcttgcaagattaatctaatctcattcaatccgcacagtggatcattcttcaaaccaaccaaatatgaaaggatgattgaattccgaaatacattggctggggcaggattgatagtatttttaagacttagtagaggtgatgatcaattggcttcctgtggtcaattgggtaagcctggcaccattcaagctccattgcttcgtgtaccagagcaattccaaatggcaattggaagttcaacttga

SEQ ID NO: 26519 - DNA, 273 bp, Glycine max
  Peptide Sequence Number=SeqID_118204
atgattcttgatgcctcaactggaggtactatgctgtcaaagagccctaaggaagcagttgtaatcattgactccatagcaaccagtgattatcagagtcaccatgatagggctccagttcaaaggaaaggtatagtggagctggatactcaaaatgcaattctagctcagaataaactcttgactgtagaagcaagcttcatgatgatgaatcaagttgattcaagtagttttgatgatgacaaagatgatgaaaaaaaacccaaagaatga

SEQ ID NO: 26520 - DNA, 540 bp, Glycine max
  Peptide Sequence Number=SeqID_118205
atgccgaaactcctccctgttggcacgctcactctcgatctcgctatcgctcttagtctcgctctcactatcactcacaactctccgtggcagcgacgaggttacaaaaggttagcattccttctctcgaaatcctttgctttatatgaaaaacaatccttctcaaatgctttgttgggtgacacgatgaagggtggtggtggtgttagggggaaccgggacacgacgacgtacaccaccatactcgaccacaacattcagtcaacgatgcaagttatggctcaggcccttcgcgccggcgagcaccaccgtgtgataagcagcaacggctgctcccttgactggcgggataaggattctgctcttgaagatgaaaccaaagttgaaaagcttgaacaaagaaatgaaatcactaccacacctcctaaagacctcactagagaatggagaactcaaaaagacctctccttggacaacattattggagaaatatcaaagggcgtttctactcgctctagactcagaaatgttatgcaatag

SEQ ID NO: 26521 - DNA, 243 bp, Glycine max
  Peptide Sequence Number=SeqID_118206
atgggtgccaaatacctcgaagtggtcaaacgagggtcgcatcccaacaacggatggtccccggacgaaattagggttgcattgagaaagtggatgatggacatagatacactggtgtgtaatgggaaaagaggttcagaggacctagggaaattagtgaatggtgactgcacgacatttggtgcactcatttggtgtggtaaagttcacaggcctcactttgctattcctgattggctttga

SEQ ID NO: 26522 - DNA, 252 bp, Glycine max
  Peptide Sequence Number=SeqID_118207
atgggtgaaatagaggaggtgcaagagaaaatgaaggctgacatggaggccatgaaagagaaaatggccacaatgatggaggccatgttgagcatgaagaagataatggaggtcaatgtggttgtagttaccgctaccagcgccgttgctgagatggacccgactcccccatctggcctcaaccaaataaatcatccaacctcggatatggtaaatcaaggaggcaaagagttgggaagtgtcataccctaa

SEQ ID NO: 26523 - DNA, 93 bp, Glycine max
  Peptide Sequence Number=SeqID_118208
gaggtgaacttagctattagagaggtatgtgtagctgatggaagcttgcttgtgggggcttctatggaggctggatctttaagcttcaatggg

SEQ ID NO: 26524 - DNA, 186 bp, Glycine max
  Peptide Sequence Number=SeqID_118209
atggcacttctatggggtattagcggagggaaatcttgtgaacaagatcaagaaacaacatctgaatcacaagctccactatctgtgaagaagaaagagaaaagttttttcatctgtatagagaactttgtaagaaagcaagtcactccttatcacaagatcactttagacgatgagaaaaactaa

SEQ ID NO: 26525 - DNA, 369 bp, Glycine max
  Peptide Sequence Number=SeqID_118210
atggttattggagatggtattctaaccccagcaatagcagtgatgcctgccataagtggtctgcaagatcaaatagatgaatttggtacagaaagggtgttcacttccgcaagtagtgccgtgacacgaatctcgaagtcggagcggacctcgtggttcaccgaggacagcaccgaccgcagcggcgacactggtacacttcgcgtgttggaagatccggtcgcaggggtccgtcgccttgcgagcggcgcgctccgcaccctcgtacagtggattcgttcctccgtcgccatcggaatcagagaggagcacggcggaggcgacgatgacggagatggaaatggcggagagatggaatcgacaatatga

SEQ ID NO: 26526 - DNA, 411 bp, Glycine max
  Peptide Sequence Number=SeqID_118211
atgaaaagtagcagtggtgggagcaacaagtcaaggtgggttgatggaagtgaaatggactgggatgaggttcctatatggtcaaagcatgatgatggtagagaagggattgactcatttgatgttgaagccatggagattgctggaactcgtgctcaccactccaaggacctttccctctggcccactattgcattggcatttaagactcttggtgtggtatatggtgacatgggaacaagtcctctatatgtttttgctgatgtcttcagcaaggttccaattggatcaaatgatgatatcttgggggcattatcattagtaatgtctacaatatcacttattccattagcgaaatatgtttttgtagtcctcaaagcaaatgacagcggagaaggtatgcaaatgtga

SEQ ID NO: 26527 - DNA, 315 bp, Glycine max
  Peptide Sequence Number=SeqID_118212
atgaaggagaaacctcaactgtcaagtaaatttgtattccgacgcctaggctaccatcaccatggaaacaataattcacctaaaggtaatactctacctatgaggagacatgtaatagggcaagggaaatctcctaatgaaagacaggtagtcaaggtcaatgtcaaagaagagttagaagactttgaattggatgtcctgttatcagatgatgctcttattcctacaacagtttttggcatcctccctatggagtttgctagtcaggattggctaaaggctaccttagaagatgatgttttagtcgatgaatga

SEQ ID NO: 26528 - DNA, 936 bp, Glycine max
  Peptide Sequence Number=SeqID_118213
atggcctctaggaaaaagaaagcaactcttctcgacctcaggaaccatatgacactacaagattcatctctgaggtcgcatgggaacacttcgagcagaacgttcactcccagaacattcttccaaagaggaacattactttatatgtcacggagtacgatgaattccgataggagctcgagaggcgcagaggataagtccccgaggcaagtcaaagtgcggggcaaattgataaagtttgatggggagtcactgaacacattcctggagaccccggtggttctggagccaagggagcactactccgctttctccagattttgtcacacacacccagaccctcaggagcttgcttccaagctctatattccagggcacggttttgttctgaacgctgaaagagcaccctggaagctcctgaggaaggatttgactaccctggcacagacctggagcgtcttgtcatactctaacctcacccccacttctcacacgtctgatttgaacatggatagggaaaggttagtctacaggctaggggacctaacgcttctgctccttcttcttttgctaccccctgctccagtgcctccagcaccaccagttccagtaccctctgacacctccgctcagagcttagacgctatggtgccgatactgcagagccttcaccagggcttatgtctggtgatgcagagcattcataacttggctcagcaccagcccatcatcattaaggaggagtttattgcccaggtggcctggccaggagtccaaccttctcctgtggaggaaggtgaggctcctacagcccaggggctgcagccaaagccgaaggcaacacccgaggccacatcggaggagactccagagatcacacctgctgccacgcctgctgaggacacaaattatgcagtagatatggcagtagcatag

SEQ ID NO: 26529 - DNA, 102 bp, Glycine max
  Peptide Sequence Number=SeqID_118214
atggctaagtatccagattggttgccttatatagttccaataaaaagaacgacaaggactatggaagtatacattgatgacgtggtggttaaatcgacttag

SEQ ID NO: 26530 - DNA, 447 bp, Glycine max
  Peptide Sequence Number=SeqID_118215
atgcccaagtacaacaaaacttcagggaaacggcagagaggtttgacatcccattgtagcaatgatgatgatgataaatcaaaatcggtcaaggagtctcagaaggaagtttaccaggctaaaaatcttgtcacagagaggaataggaggaacaagataaagaaagggctttttactctgcggtatctagtcccaaggataaccaagatggatagagctgcaattcttgccgacgcggttgaccatataaaggaattgcaaatgcaagtaagagaacttaaagatgaggtcagggaattggaagaacaggaatgcgagaagaacacaccacaattgaggataacaaaagccaaaaaacaagaaggaaccggaagtaaccctcctcttaatcaaagttcttctggttgcactaaaaagatgcaaatggaggtacaagagtttgcataa

SEQ ID NO: 26531 - DNA, 825 bp, Glycine max
  Peptide Sequence Number=SeqID_118216
atggagagaaccatcatccacattaataatgaaccttcaatccatgtagagcacttctttgatattcaagaacttgaaaaagacaaggcattttacccaaaacccattagagtgttcttgaggaatgttgtgttgcgaaacaacaaagtgatagtatccatggttgtaggagtccaggtaaccttgtccaatgactccatttctaaggccactagataccttcatgaaggaaacacttatcatgagggatgggagaaggcttatgactcccatataaccagggctctgtacaaagacaatactgagaagactggtgcgtcctaccctgcttgtcgaactagagaaaagatagctcctcagaggttgaaagacctcaatgaaactgatgatgatgaagaggacaatgttatcaaggttgttgtagacaagctggttaaagctttagatgcctttgacgccaaaatcttatggattcagattgtgtgggttgacacattgaaagcctcctcatccggttatgatggaagtgacaattttcaacaccatgatttcattcaagtgttgaatctggttaggacgtatcatttcgatgatgcttatgcgtgcttcaccaaggatgctgacagccactccttctataatgttgatggagagagaaaagtgaatctcatgaagacagtacaaaatgaaggctttaatctcttctccttctctctaacacttggaaaccctatcagagcaaatcagaggaaaagcttgaggaatctcaggaaattgctagagatcctgctatcgctgtcagaatacacacatgagcctacttag

SEQ ID NO: 26532 - DNA, 123 bp, Glycine max
  Peptide Sequence Number=SeqID_118217
atggcgcgccttctcatggagaaaacgcgtggagtcgccaccaacatttatttgaggaaaatattagaaaaaccagaaatgacgaagggtgttgcccttgctcctacatatcctcaggtgtga

SEQ ID NO: 26533 - DNA, 780 bp, Glycine max
  Peptide Sequence Number=SeqID_118218
atgatattagaggacaagttgaaggcttgtcaaaggtcaaagaggatcttgaacgaacagttgagtaggacggaagagaacatgtgggctatcattgaccagttcgctttcactttgaatggaagtcaagagcttccaaaactgttagtcaaagccaaggcaatggtggacatttatagtctacaagtagacaccataaccaaaaaagacaaacacgttttacggcacccctatcaaacccatgctaaaactaaaatcatgagtgagatagaagaagtgcaagagcaaataaaggctgatatggagaccatgaaggatcagatgacctccatgatggaggccatgttaagtatgaaaggaatgatggagaacaatgcggccgtagttaccactaccagcgccgtcgtcgaggcggatccgacccatccatctgccataaaccaagtgaaccagcctatcctagacatgcctgtggcggaagcctgcgaagagcctcgagatcaagctctgggtgactttgaaccataccctatgttcgccactaagggaccggcgtgtagtggtatgcctcagcccaacactgtgggggctcctcaacaccggccgctacaagctctgcatttctcaatagggagactgcctccagcagtggaaggaagggagaaattggatctcattgaggagaggctaagggccatcgaagggattggtgattacccattcgccgacatggaagagttgtgtttagtgcctaacgttgtcatcccctcgaagttctag

SEQ ID NO: 26534 - DNA, 76 bp, Glycine max
  Peptide Sequence Number=SeqID_118219
atgggggtgagcttagctattatagggaatcttcttaaggaagtttctcaaggaggtgagcttagttatgagacgg

SEQ ID NO: 26535 - DNA, 315 bp, Glycine max
  Peptide Sequence Number=SeqID_118220
atgaaggcgctaagcacgcctgttgcacttagcttgttcatcgtaactgctaaaattttggatttccagatgaacgcgttcacatctcaagaagcttgggagaggtatactgatattgtggtgcctaggaaactactaccagagaggaatgtggtagtttattacactgagttcaatgagttcaaggaggaactcgagagaagacactgggatgaggagttgactgattttactgacagcaacatagatgtcgccattgtgaaggaattttacgcgaacctctatgaccccgaggataaatcacctaagaggtga

SEQ ID NO: 26536 - DNA, 360 bp, Glycine max
  Peptide Sequence Number=SeqID_118221
atggatgagtttgacgctcaggtggcctggccaggagcccagccttctccttctagagggggtggggcctccgcaacccaggggcctgaaccagaggagccaacaacagcagcagagggggaggatgagctcactcctcctgagcccttctattttgatgcaggtgtacacatggcacaagaggaggagacttccacagaccagatcccagagccatccctagtatccatacctaatgattccatgccatctgcaccagcatctgagttaaagcagcctatccctcaggattcaccagccgctcaggtgttggatctcaatgagcatgcacaggagaaaccacaggagcaggacatttaa

SEQ ID NO: 26537 - DNA, 357 bp, Glycine max
  Peptide Sequence Number=SeqID_118222
atgacacagggtagttttgttccccatggttgggacgacatactcaatactgccattgggcgaccggagcatccaggtcgtgttcatgtagtgggatctgtaaggaatgagattgaagaagaaaacaagcgtagtttggagaaattgaagcaggagttgaagggtgccataaaaattgagttttcccaaatgggattgcagtactcatcccttattgaggtagatttacatgcattaggtgcacgtgttaacaccaaagggagcaatgatgagactattgtgaacccatcaggcgaggaacatgatggttgtgtaacaccgactgatgcaatcctactccgcaagggcattggatag

SEQ ID NO: 26538 - DNA, 366 bp, Glycine max
  Peptide Sequence Number=SeqID_118223
atggcggcaatggatcttagccttgggaatcctttgtatcgaaagtcttcctggtggtgggtccaggcagcgtgtcccgcagatggggcagcgtgtcaagttcccttatgtggtagctcgtggtccatcgatgtaaatctatccggtgtttactcccctcgaattccacaacaacttcttggtatcaagagcttttgtttagaggaggcagtgggagtaatggcattagaagaagggaatgtgaagatcgagaactttgatggcagagatttcaacttttggaagatgcaggattatctatatcaaaagaagttgtatcaacccttatcaggggataagccaaacgacatgaagcaagaagaatga

SEQ ID NO: 26539 - DNA, 144 bp, Glycine max
  Peptide Sequence Number=SeqID_118224
atgaagaaacaacaatggaagagaagcgaaaggcaaaggagaagaggagaggggaggcaccatccactagggaataagccaaggaagaaggagcttcaccaccaagaattgccttggataagaagcttgaagaggatgctttaa

SEQ ID NO: 26540 - DNA, 788 bp, Glycine max
  Peptide Sequence Number=SeqID_118225
atggggattcaaatagcaaccagacccacttgggccttccaggatgttcctccagaaggcggttgcttctggaggaaccaacctagctcgcctgggcaagctggaaaatccaagccgaggcacttccgtaacgtttccatgggtgatttcgcaaagattttcaaccgttcttcgacgttcttcgttcgttcttcgtcgttcttcggtcttcaaccgttgacctcaagaaacagagttaaagtgggtttagaggatctgaagaaaggagtgagagagaggatattaagggatgatgaaaggtggctatccttttttaaaggattcgggatggaaatgcagaaaggattttcccatgcactagtgaagaaagaagcatattctcaactcaactacccaacaaaagggataagagactgtccgttgagacttgaaaagatgcaagacatcttactgccttccggcacaaatggtgttaaagacctactcatttctacttctcatagtagtagcctagctctctttgcttctctaggaaagaaattatcagtgctcagcttggacagcaacaaccttgttgtcaattatgacctacaggctgtccaagctagtcctagtaatgttgctcgtgggctttcctccttgtacaaagaaatcatagatactgttcgtaaagaagctacaacaatcacgaccgtattcccttcaccaatggcatatgaaaagacccaagagctagcaagagatctacaagttgtaggatgtggtgacttggatgttgatagtgtaat

SEQ ID NO: 26541 - DNA, 309 bp, Glycine max
  Peptide Sequence Number=SeqID_118226
atgaaagccaacgaaacaagaaatgaattgaaagtctcggattcaaaaacttatcggttgaagaacgaagagcggatgaagaacggtgaagaacggcgaaaaaccttcatggatttgctcacggaaacgtcttggaagtgttacggaagcacctcggcttggattttcttcacggaaacaattttttcacccaaaacagctggaatgcatagccaaggggggttagggatcatttggaacagcctcccttcgcctatttataagaaaatgggggaggaggttgccgcccagctcgcccaggcgagctag

SEQ ID NO: 26542 - DNA, 1203 bp, Glycine max
  Peptide Sequence Number=SeqID_118227
atgaaggttaaggaggagaagctggagatgaagcctggtttcattgcgacggaggtggaagatgaagaaaccctagtgcagaaatgcgagagtggcgatagtgacaatggtaatagtgatagtaacaacaacggtagcaatgacagtgatgatgatgacgttaaagtggttgtgacaatggtgataatgatgatgatgttggtgataatgataacgatggtggtggtgacaacaatgaaagtggcgatgacgaatatttttgtcttttggagggcgagccctggtgcagcggtaaagttgtgccttggtgacttgttggtcatgggttcgaatccggaaacagcctctttgcatatgcaaggcactccagctctcacatttctgaaacactcaagctctcacatttttaaaacactcaagctctcatgccaaaatcctcaaacctctcttgctctcgtcgttgtggtgcagtcatcgctgtcatgttctcatcaccatcgtgccgccatcgacgtcgaagttgtgaacccctccaccaatgtgctctcatcattagaaggggacagatgtcgtaccggatgtcacgacatcacgcttcagaacatgcagattagatgcgtccggaggaaatccactctcaatagtgttagttcaaggtctaacagcccctgtttacaaccttctcacctaaccactaccctcaaagacacaccagagatcaactctgaacaaaagagatcaactctacacactagagatcaactctacacactagagatcaactctacacacataggtccaacacttgatgacatcgtgtccgacatcgtggatcctgcagcttcacttctgcacttgacttttatcttgcattgtacagcaactccagtattctcgggcaggatgtcaggacattgtattcgacatcgtggatcctgcagcttcacttctgcacttgtcttttatcttgcattgtacagcaactccagtattctcgggcaggatgacattgatgacattgaggtttggggtgcggcgaaaggagcattgggggtttgtggttatggtccaggccacaacaaaggagcgttggggtttggggttggggttcatgggtatgccttggctgtttcattttttctaatcaccttcttagtagcctcactactgacagacccttcagaagtccaagttggaaaatag

SEQ ID NO: 26543 - DNA, 741 bp, Glycine max
  Peptide Sequence Number=SeqID_118228
atggaccaagaggtcatctctattggcggttcctcgttggaggatactcgttgtggtgcctttgacagcgagtcatcctcttcagaaaggctgactggcaagattgattttgtctccttgaacaacgtttccaagaagctgtttgagtttgactcaaacatatttcgccgttttaaggaccattttattaaggtcctgtctattgatgttgtggatgatggtttgccactgatgtttaatagggacgaggagccccacttcccattctactggcaatctgaccctactagagaaggtcgaaaaaactattttggagtagctgcggtctcgctggacgtgcgaacaattttgtctcttccttcggtgagcgatccccttgttgccttagatggtattatgggtggcttcgcctataggccacttgtgaagcaggtcggacatgcgggtagggatgttccactgtctgctattgctactgttgttggagaagggggtcaacctattagtgaagttggccctattgctattgttgttgaggtcacccccaacgctctttcctctattttggaaaagaggaagcgggatgaggtgttgggtcgtctagtcgccacaaggttgacgcccgatacgggtcgtctttcgatcgtgcaggaagtccctctgactccatcggtcgtcgagtcttttgttgctactcctgctacttttgttctttcacctccttctgttgttgctgtttag

SEQ ID NO: 26544 - DNA, 246 bp, Glycine max
  Peptide Sequence Number=SeqID_118229
atgcagagtagacatggcaagaaaattcgtacccgtgggtacccgcccgaatccgtcccgactttaacgggtaatacccgagttgaccgggtatgggtacgggttcgggttttccccgataaccaaaagtcggatacgggtacagtgagtggaatgggtcattttgcggagttatcacggagtggaagagtcaaggtcgacgatgacgatggcacaggagctatcgcggagttcattttgcggtga

SEQ ID NO: 26545 - DNA, 1020 bp, Glycine max
  Peptide Sequence Number=SeqID_118230
atgggtgccaagtacctcgaagtagtcaaacgagggtcgcatcccaacaacggatggtccctggacgaaattagggttggacttgttggtgatgacgtgcctcattttgctatcgagcctcctataggagaagagggtcaacatgttactagggttggccttaatgatggtgaagttgttgaggtcactcctaacgtgcctccttttgtcctatctaagaggaatcatgataacggggctactactattgttgctcctgctcctccgacacctccttccttgcctgctcaggaggtatttatctccctatttactgtggttgttgcacaagtccctttggtcgctcctatcatggctcttccatctatcactgttatgcctttgctttgtgctagtgtggcgactgttattacttcggtggaagctttaagcaaggttgcctctttggagactgaggtttcaaagtggagggccactgctcagacaatgtggagagtggagagtgaaggatcccaaggtggtggagatactgttgcagagaaggaagagcttgctattgagtctgctaaagaggttagtatagagcttgaagaggagttgttgacgttcaagaaggaagctgtggagcggcacgagaagggcttttataaggacgttaggaagctcgagttcttcaccaaaggtcttgagttaggtctttttgacccatttaaggacggctacttacttgagggcagaaggctcaccaaggatagaccttgggtttttcgagccttgaagatttgtcaaggcttaccaaaggaggaccttgggtttgttgagccttggagatttgttgaggctcaccaagggaggaccttgggtttgtcgagccttggagatttgtcgaggctcaccaaggatggaccttggcctttgaagattcaatcgaggatagttcatcatgggtttggtgagactcaccaagggaagaccttgggtttgacaagccttggtagggtcgacacaagaaagttataa

SEQ ID NO: 26546 - DNA, 174 bp, Glycine max
  Peptide Sequence Number=SeqID_118231
atggagctttcacttaaaattgaaatgttgcattttaaagttagtgatatcatagcgacgaggcgggtcattacaatagtggaagtgatggctggacggaatgatcgttcgatagctgatgtcctccaagccttagcccaggctatgggaaatcagaatagaggagaaacttaa

SEQ ID NO: 26547 - DNA, 837 bp, Glycine max
  Peptide Sequence Number=SeqID_118232
atgtgtagcttagagataattgaatacctaccacgtgataaggggattgcaatatattcaaataataaagtgattagagataacctatcagttgagagcttgattgataaggggagattgccatgtgtcgaggccttaacaaatatgagggtcacgagtatatcgagccccaagcatagacaagagttgttctgtgctgagagtggtaaccttgacaaatgcaagagttgcaggcgaaatcaggtgtgtcaggtgagggatgtccctgtatctgatgattttgtccttttcctaattgttggagagtgcattgaagacaaaagttttgtttgtctttttgttgtagacgaatgcagtgcaccgcgttgctcttgcatacatgtcactcatggagtgggcacatactggagacgtggaacgtgggtattctcttcgacattgtcttctttcatctctaacttcgccataggtataggcgatagtgattctgggagtttgattcagcaacctttggtggaccaaaaggtcatctccatcaacggttcctcgaaggaggaggctcgtcatggggcttctgatagtgagtcaccttccttggagtggttgacggtctcgtgccgtgctagtggcacttctcacccccgtgggaaggcgcaaccttccgctacttctccgatcgaggaacttgttccgatcaccatgattcttccctcttatatttttgggggagcaaggaagagtggtggcgggggcgttagagcgtcccctcgtgcgcggtgtagccatagtgctaggtcgtcatcatccctactaccgttgctggttttgaataggtga

SEQ ID NO: 26548 - DNA, 500 bp, Glycine max
  Peptide Sequence Number=SeqID_118233
atgggtgctccagagatgtcgcctcctccctcttcagctccaccggttccttccacgaccgtgttgactgtgaagtccccttcctcctcttttcaccctcatgtgtcgttggatcacatctattcctccaacaatgcttattctctgtggggtatgaggtataagcctgaacaaaagaccttgattggctttgtgttggcctttgataaaaatttgattcggtcagctggggtccaacatgccatgaattctgctaagcgccctaactgtaaagtcgaaccaccatctgtcttccaaggagaaaaaggacttggttggccaggtggagggcatggaggtggagaaaggcgagcttgccaaggtggtggagaacctcatgtagaagcaaagcttcatgggtacatctacttgggtttgactgagaacaagagagggtacatctcttgtggatcagttctagtggagggtacatccactaggttcaaagagaacaagggagg

SEQ ID NO: 26549 - DNA, 321 bp, Glycine max
  Peptide Sequence Number=SeqID_118234
atgttgttgacaaaaggatgtcaacagacagtctgcgccattggacagtgcatgtgggagagacttaggtcgtctgcaatgttgcctatgggttgggggtgtgattccccttggatgcgtttaggcaagagtgtctgtgtctatcatagttgtcggacgagcatgggagtctgtgaggggggttcacgtatgaggccagaccgagtgttaaccatggatggatgtaagaagattgatgagaggccacgggatatgttttaccacgaccccatggtgtgcaccaaatgttctttaccaaaatctggaaccatgacacgttag

SEQ ID NO: 26550 - DNA, 467 bp, Glycine max
  Peptide Sequence Number=SeqID_118235
tgtttgcacaatgtctcgacaggattcccagttgtgcacaatgttggcacgatgatccggcaggactcttgatgtgcacaatgttcacacagtgttccagcaggattcttgatgtgcacaatgatccaacgggattcttaacgcgcattgttgttgcacaatgtctcggtaggattcctgacgtgcacaatgtttgcataatgtctcgggttcctgacacgcacagtgatccggtaggattcctgatgcgcacagtgtttgcacaaccaaagatccacagttttcatcttcctgttggggaatgcacaattacactcgaggatgtagcactacaacttggaagaagggttgacggtaggccagtaatgggtgcaacgtactatgactgggaggatatgtgtcaacaatatttgggtgtggttccgtcaaagggagaagcactagtcgactttgccattaaaatttag

SEQ ID NO: 26551 - DNA, 294 bp, Glycine max
  Peptide Sequence Number=SeqID_118236
atgtctcacaacgggcaagtcaggtcactctcattgagtgaaattatagggagactagtcagggtcgtcgctctccctccgattccatttttggctcctcctctcgctcctcttccccctccgactcccgttcctcctctcacccacgcaccctttctcggtcccgctctccctcgtgctccaaatcctcttcccccttatcctcttcttcgtcccgaagctcacgcagccgcaatcctcccccgcagaggcgtcgaaggtaccgctaatttcctcgattggagagcaatttga

SEQ ID NO: 26552 - DNA, 219 bp, Glycine max
  Peptide Sequence Number=SeqID_118237
atgtaccctctacctcacaaaggatgtaccctccaatgtgttaagacaaagttctcaggcgcttgcttctacaccaagtccttcgatgagttgattgtcaagcctagactgaagcaaggtggcatatttgtaacacaggcaggaccagctggaatatttagtcacaccgaagtcttctcatgtatctacaacaccttaagacatggaaaatattactga

SEQ ID NO: 26553 - DNA, 330 bp, Glycine max
  Peptide Sequence Number=SeqID_118238
atggggcagatggctactcagttgaaccaagctcaatcccagaattctgataaattgccttcacaaactgtgcagaattcgaaaaatgtgagtgccatcaccttgaggtctggcaagcaaattgaagtgcctccaccagtagcagcacctgcacctgaacctgtcaagcttcattctacacctgaaaaagaggatgatttagctgcacaaaagagaaagcttcctgatcatgaaggagctaacaaaaattttcatgcaggtggaccttcttctagtagttctgacatgcagcaacctcctatccctcttccaaacaaaggactaacataa

SEQ ID NO: 26554 - DNA, 1413 bp, Glycine max
  Peptide Sequence Number=SeqID_118239
atggtggtgagcttgttcttgaagtggcatctccaatcacctttcctccttctccattccactgccatgatcttcaagaagcaaaggactccattgatgaagaagatcaaaggcctacaagctccacatggagctacatcgcttaacaagagtgttctccttaagaatttgccctttgatcttcctcatagcatctacaccaacattctaagaaacttgaagggcttatgtggtttggacgacatctattatgctactgtcatcaataagttgctctgggatcaaggcatgtatcatgtcttcaacaaaatggatgatgattctaaggacaacctagtagtcaaggatgccataaacaaaaggaagcagaaaaagcttgccaaagctatcactgatgaagatcgagttgaaacatcagtaccacaaaggctaaagaacctgagtaagactaatgaaaatgacgagggacgcattaaaacaagggctacaaatgccaatcccaagattggtgaaaatgaatggatagtctccttcattagaaataaggaggattatgcttcatcctcctcagatattgagtctactgatgaaactcatatctttcatctcaacaaacgtcaagctacctcaacacaaccgtgtccacctccatcatttatcaatctcgagaagttttctttagcattcattaatggtaattcactatctgaatcttcattttccaaatccatctccattgaacctcttcataaggaaaccatcattgtccaagccttagcatggacgaggtatgactatgagcacacaccatctgaggccttcaaggctcttccaacagataatatttggaagaagcttgttcgtgctcctgatgcttacaataccaagaccttcaggaatcaaatcgtgtggatgggcactctaaaagcctccacctctaattatgatggaagtgacaacactgcgcatcatgatgatgcttgcaagatgactgaagagcagatgataactcatgtgactcagatccatgatgctcagaaaaagaagaaagctgaaaaagaagaagaagccttagttgttgcttctatgaaagagaaagatgcctctgtccaagctaaagatgtagatggtaccattgtacatggggtcattaatgatcttaccaacatcagtatcatggacaaaacacctaaggcatccaatgctgccataactattgaggttgttcaccacgtccaagaacttattgttacaagggatcatgtgcaagacatgattgggcaagctatggagtcatttgttgaacgccaacaccaagaaaatgagcaatttaggctcttcgtgcagaattccatcacaactgaagtctccaaccttattgatatccttatgcaaaaccttcaacaagcttag

SEQ ID NO: 26555 - DNA, 1385 bp, Glycine max
  Peptide Sequence Number=SeqID_118240
atggaattgagggtggtggcgagggagagcactaccacgaggtgctaccgtggaaaacgaggagatccatggctgaagaagaggccacgagcaacgcctctctgatattggctcagaaaagaaccacaaggaaggaccctttggataacttcaaccgttacaccggtggttggaacatcagcaatcgccactacattgcttcagttgttttcaccgcggttcccttctttgttgttgctgcggtctggtttgtggtttttggactcagtttatccttaatctgcttgtgttactgctgttgtccaagagagccttatggttattcacgtttggcctatgctttgtccttgatcttcctcattctcttcacccttgcagcaatagtcggatgtgttcttctatacactgctcaggggaagtttcatgggagcaccacaagcacacttaaatatgtggtgagtcaggctgacttcactgctgaaaacctcaggaatgtttcacattatcttgatgcagctcagaagattggagtcgatgcggtttttttaccaggtgatgttcagaagaacattgatgaagttcagacaaagattaattcttctgctgcagaactttccagcaagactaaagaaaattcagagacaattaaagatgtcatagatgcaatgcgactggctctggttattgttgctgctgttatgctctttcttgcatttctcggattctatacatgtgttgccatggatggctgggtgcagaaccctactgcacatacagccttggatgaaattcttccatgtgtggataatgcaactgcccaagaaaccttgttacgaaccagggatgtgacacaccaacttgttaacttagttgacaacattgtttccaatgtcacaaatagaaatctcccgcctgctgctgtacccttgtattacaatcaatcaggccccttgatgcctcgtctgtgcaatccatttaacagtgatctcacaaatcggtcatgtgcagatggggaagtttcattggacaacgctgctgaggtgtggaagaactatacttgtgaggtttcttcctcaggcatttgcaagacgcctggtcggatgaccccgaccatttatggccaaatggaggctgcagtgaatgtaagctatggcttatatcattatggtccattcttggttgatctacaagactgcactttcgtgcggaaaacattcacagacatcagcaatgatcactgccctggtctgcagagaaacagtcaattgatttatattggattggttttggtatcagctgctgtaatgctgtctttgatcttttgggtcatctacgcaagagagcggcggcaccgtgtttatactaaacagttcattgagggctaa

SEQ ID NO: 26556 - DNA, 514 bp, Glycine max
  Peptide Sequence Number=SeqID_118241
ggtcggaacaggagagcgcacgagggagcttccagggggaaacgctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgcgaaacagctatgaccatgattacgaattcgagctcggtaccctgacccttcaaccaatgagctctttgaaattgcaaaagatggtgttcttctttggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 26557 - DNA, 765 bp, Glycine max
  Peptide Sequence Number=SeqID_118242
atgggattgaaccaaacaccctattttaagaaaaggttctatcatgtcaaaatcaagagcctagaggtagccagtttgcaagagctagggcagtggatggaccaactccaatgtaaagccttccgcaagacatatgggaaaatctgggacttggctatgatagaagtttccgtggaagccatcgcatccctcacccagtactatgaccaaccgctaaggtgcttcacatttggggactttcagttggtaccaaccgtagaagaatttgaagggatcttgggatgcctgctaggaggaaggaagccgtatctattttctgggttatacccctccatggcgagagttgctaaggtggtcaagatctcggcgcaagaattggaccgagtgaaacaaaatagaaatggggtggttgggataccaaagaagcacttggaagagaaagcgaaagctttggcggatcaaggagagtggactttattcaatgatgttttagcactgttggtgttcagggtcgtcctctttctaaatgtggatgggctagtggatctagcggcgatcgatgcttttcttgcttatcaccatagcaaggaaagttcggccattgctattttggtcgatgcctatgacacgttcaaccgaagatgcaagaagagcagcgcgaggatcgtttgttgcacacccgctctttatgggcgttcgttaattggttccccctatggaaggaaggaagggtcggagtattgtcctcatgtgaagggttcctaa

SEQ ID NO: 26558 - DNA, 132 bp, Glycine max
  Peptide Sequence Number=SeqID_118243
atggcggtggtgaaccccgggaagatctaccaatctcccttccctcgatggtacaaccccaatgcaacctgtgcctatcatgtgggtgtcccgggacattcgatagagcaatgcgtggccttcaaacacaag

SEQ ID NO: 26559 - DNA, 579 bp, Glycine max
  Peptide Sequence Number=SeqID_118244
atggataatgaagagggcgtgcaggaacagatgaaggtcgatctatcggccttaaaagatcaaatggcttccatctcggaggtcatgttaaaactccagaaaactatagaggataaagccacggcaaccgcctccagtatagttcgggaagcggagccggtgctgcagcccgccttaaatccgggccgagatagaaacacggaagtgtttggtcgaaggtatagcccgcaagcttatccttatggcttgcttccggacttcactccccgtgccaccccggaagatttaagccaagcccctactttcgaggggcaactcccaccttatgacgactatcccgggcaagacgatgaggaaggagatacccatctcggtcccctgctccacctcaaagatccgttcccccatgaactaccccaaccaaacatagtccgccatatcccgacttcacccacacccgtaaaagaatctgttcccttcatggaagataagggaaagattgaggcacttgaagagaggttgagagcagtcgagggcctcggcaattacccattctcggatctagtggacttatgtctc

SEQ ID NO: 26560 - DNA, 476 bp, Glycine max
  Peptide Sequence Number=SeqID_118245
tactgcacgcctaggcaggcgcagggtgatgcacatcaggccgcagacgcaccaccaccacctcggcaggccgatcccactggatcactaggcatggagcattatctacagcacttggttcgccagcaggcggccaaccaccgtgggcaggtgcagatacataagtgtctctaccggttcagcctcagtcagcaggggcagggttccgctccttttgcatgccctactccggagcagtttggggctgaggtcgcatggcccggagactggcccgaggcccaggcaggggaggagcctgcaggatcccccggtgaggcagaggaggcccatatggatgaagatatgactgacttgctcggtttcttgggaggaagcggagccacggtgaatgctgtgtatgccctgacatttatcatgtctagccattctacaagccttgagccaaaatcccaacttaccataaaccttgacccagg

SEQ ID NO: 26561 - DNA, 435 bp, Glycine max
  Peptide Sequence Number=SeqID_118246
atggccacagttgaagccttggaacgagaaaccaagaaggctcgaaaggaagagctaaaggtttgccttaggtcgaaaagaaatttgtcccaacagttaagggagactgaagggaatatgtgggccatcatcgataagtgcaaagagaagctaaatctagcggcgactcatgagcaaaggctagaggatgagtacgccaagatatcagcagaaagggaagcaagggaaagggtaattgattcattgcaccaagaggcaacaatgtggacagtccgatttgctcttactttgaacaggagtcaagaacttccccgattgctagccaaggccaaagcagtggcggacacctactccgcccccgaggagatccacggacttctcagctattgtcagcatatgatagacttaatggaccatatgattggaaaccgctag

SEQ ID NO: 26562 - DNA, 213 bp, Glycine max
  Peptide Sequence Number=SeqID_118247
atgggagggttggggattagagatcttccaagtcttaacaaggctctgttgtttaaatggaagtggctgatgttccaccaaccagaccagctttggaccagaattctgatctctatgtacaatggctggaggggattggagtatggtcctcgaaagcagtatttctctacttggtgggctgatttaagggccatctttcaacagcaaaatgtg

SEQ ID NO: 26563 - DNA, 540 bp, Glycine max
  Peptide Sequence Number=SeqID_118248
atgggtgaccaagaggagatacaggaacagatgaaagctgacatgtcggctttgaaagagaaactgtcttccatgatggatgccatgctaggaatgagacaactcatggagaaaaacgtggccaccgctgccgctgagcacactgggcacaccagcaacccccatttgggatacaaccgggtggcttacccttatggattaccacctaattacacgtttccagacatgcatgatgacacgggtcatgtcctttcccccatccttgaaggggagcctcctcgacatcccgatgagatccacaaagatcatcgagagtatgcccaaggggatgtcaatttctaccccccggtccccgtcgaggggtcggtacccaacacattgcctcaacacaacctcacagcacaaccaatattcttgtccacagagggaccacgcctggcggcggaagaaagaaggaaactcgatctcatcgaggagagattgagagctgttgaaggctttggtgactatccgttcacgaacatgacggatctttgcttg

SEQ ID NO: 26564 - DNA, 429 bp, Glycine max
  Peptide Sequence Number=SeqID_118249
atgcaaggttgcctaagctaccggaagctaatagattctgaaagatggatatatggtggatatgcttcctatggtgaatcctttaatgcaaaattacgtggtactaagcgtagaattgataatacaaactcaggagcattatggcataagtgcttaggtcacatttctaagaacaaaattaaacgacttatgtcaaacagaatcttggattccattgatttcacaagctttgatgtttgtgttgaatgcattaaaggtgaacatcgtccgaggccttttgccagctacttagaggaatatggaatcgtcccacaatacaccatgtcggggtcacttggcatgaacagtgtgactgaaagacgaaacataactcttaaggatatgataagaagcatgatttgtcattctaacttaccagagtcactctag

SEQ ID NO: 26565 - DNA, 481 bp, Glycine max
  Peptide Sequence Number=SeqID_118250
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagcatgcaagcttggcactggccgtcgtttacaacgtcgtgactgggaaaaccctggcgttaccaacttaatcgccttgcagcacatccccctttcgccagctggcgtaatagcgaagaggcccgcaccgatcgcccttcccaacagttgcgcagcctga

SEQ ID NO: 26566 - DNA, 324 bp, Glycine max
  Peptide Sequence Number=SeqID_118251
atggtaaataggtcacagattcccatgatgatgaatgttgcgaaggttagcagccggtttcttcctgagtggaggtatcctgatgtaagctccattggagcttgtaggcctaggatcttcttcatcaatggattccattgcttcatggaagatgaatggcagcagaatgaagaaaggaagagagagaggagacgccacttcaaggagaagatgagtctagaagaagctcaccaccataggaggccatggataagagcttggaggaagaaggagatgaatgacgggagaggaagagaagagcacgaaattttgtgctctaaatga

SEQ ID NO: 26567 - DNA, 492 bp, Glycine max
  Peptide Sequence Number=SeqID_118252
atgggaacattagaattaggaccacatatacccactatagtatatgtaagcacaagcactacaacccaaaaactgagagatcaatggacagaagaagataggagaaaaatccagtatgatctcaaagccaaaaatatcatcacttcagtcctagggatagaagaatactttagagtatcaaattgtactaatgccaaagatatgtgggatactctccagttaacccatgaaagaaccacagatgaacacgagatggaacttcaacgcatcaatcagaatgaagaaaatgacaaaaagaagagaagcatagcccttaaagcctcatcttcaatgcaagaagaaaacgaagaagaagattcagatgatgaagaagatttttctttctttgttaagaaatttcagaaattcatcaagaaaagaagaattgacaggcgtcaggatttcaataatggaagaaaatcacaagatgattctcaagtccttaggtgctag

SEQ ID NO: 26568 - DNA, 450 bp, Glycine max
  Peptide Sequence Number=SeqID_118253
atgaaaagatggtgggctacgcatcctcaaagctttgcagatttggtcttcgccagtgaaaggatcaatgtgggtccgaaaagaggcaaatttgatcatcctactaggatgactgagaaaactggggcaaatgaagagggtgagaaagagggagaaacccatgctgtgactgccattcctatacagccaagtttcccaccaacccaacaatgtcattactcagccaataaccaaccttctccttacccaccacccagttatccacaaaggccatccctaaatcaaccacaaagtctgtctaccgcacttccaatgacgaagaccacctttagcacaaaccaaaaaacagcaacaaaaaggaattttgcagcaaaaagccccgtaggggttcaccccaaattccgttgtcctatgctaaacttgatcccatatccattcgattattcaatg

SEQ ID NO: 26569 - DNA, 324 bp, Glycine max
  Peptide Sequence Number=SeqID_118254
gaggaagaaccacggattggcgctgattgttctagtgcaacctttaataaatctgagatttataaggaggaagcagggaatgcagcacaaaagcataaagcaaagagggtggcgagtgtcaatgttgatgcagaagcctttggtgatcactgggaaagttcagtttgctctatgcattctgaagctgaagcactagaacatatgaagaaaagagatacaggccatcaaagtgagtcattggagaataagacaggagattcaactgtgctgaagataggagattcgactaaagttgtgataaaacaatacatgaagggaggatag

SEQ ID NO: 26570 - DNA, 441 bp, Glycine max
  misc_feature (328)..(328): n is a, c, g, or t
  Peptide Sequence Number=SeqID_118255
atggaaaaacgccaagcaacgcggccttttaacggttcctggccttttgctggccttttgctcacatgttctttcctgcgttatcccctgattctgtggataaccgtattaccgcctttgagtgagctgataccgctcgccgcagccgaacgaccgagcgcagcgagtcagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacaagttgcgcagnctgaatggcgaatggcgcctgatgcggtattttctccttacgcatctgtgcggtatttcaacaccgcatatggtgcactctcagtacaatctgctctgatgccgcatagttaa

SEQ ID NO: 26571 - DNA, 597 bp, Glycine max
  Peptide Sequence Number=SeqID_118256
atgtttgatcaacaggcagttgtttctccatcaaaaactccacaaagcccggatcttgaggtcgatgatctgctatatctgatgacattgaccatcccagatcttttcttgaaacctttccaggttaactgggatgctactgtgttcgaggtatttaatccagacttcccactgtacataaagcacgaagatctctctgaaatcacacacggtggtcaatgtctcaatatatttgtcttacaattatggattttgcatctgactgaaacaagtatgcgagcgaggaatttcgatgtgtatggattcctcaagccacagtctattcagagatctgggcaatcacagtttgacactgaaagttacatcaagagttggatgcagagttcaaaacgcgatgtctaccttggagcctacttaaatggcagacactggcaaatggtggtcattctccccaaggaaaaccttgttgtctggttttgttccttgcataacaggccagacaactaccttaagggaataactaacagtacattgaaaggacttgatgacactccacagcctaaatccaaggctgctgctaggtggattgttgttaag

SEQ ID NO: 26572 - DNA, 300 bp, Glycine max
  Peptide Sequence Number=SeqID_118257
atgttatatatacagaatggtaggcaaaaagtatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggggacgcgccctgtag

SEQ ID NO: 26573 - DNA, 414 bp, Glycine max
  Peptide Sequence Number=SeqID_118258
atgtatgcattacacgtggggaactcaagacacaacaacttaagcaacgttaagggacgtttgggtatagtggcacgctcacaggggactacgtatgagttgatgacacgctttgtggtttcggtatgtttgtcgggtgcaagtgcaaagacttgtgcttcgattggaacactatctttttatgtaaattgcttagtaatggatgacaggacaaaggaatcagcaacaaaacacaaaacgagggtgtatttagtaaaaaggggggtgcaaatagcaactaggcccacttgggccttacaggggttccaacagaaggcagtgcattctggtggaagcaaccctgctcgcctggcgagctgggtggcaaccacctccctcttttctcctataaataggggaaagaggacggagtaa

SEQ ID NO: 26574 - DNA, 268 bp, Glycine max
  Peptide Sequence Number=SeqID_118259
atggataacgaagagggagtgcaagaacagatgaaggccgacctatcggccttaaaagatcagatggcttctatcacggaggccatgctaaagcttcaaaaaactatagaagataatgctacagcggccgcttccaatacagctagggaagcggaaccagtgctacaacccgcaataaacttgggccgagatagaaatgtgacgggttttaatcggagctatagtcctaaagcatacccttatggtttgcctccagacttcactccac

SEQ ID NO: 26575 - DNA, 243 bp, Glycine max
  Peptide Sequence Number=SeqID_118260
atgaaggcccaagtggagaaggatgaagatccagaggcagagacactatcaagacaattaattacttatcaaggtaatccttgtggcgtctaccctgacttatcttccttcaccggaagtggcgtctaccctgacttatcttccttcactggaagtggcgtcatccaaatctctgtaacctgtatcaaacgatccgcccctgctcaggttcacatcatctggtatcagagcttcggctcttga

SEQ ID NO: 26576 - DNA, 228 bp, Glycine max
  Peptide Sequence Number=SeqID_118261
atgattcatttggttgatgccgaatggggcatcggattcaccttagcaacagtgctggtagcggcaactgcaaccgcgttggcttccattatcttcttcacgctcatcatggcctccatcattgcggccatttgctctttcatggcctccatgtcggcctccatctactcttgtacctcctccgctttacccattactctagctctagcacaggaaagaatgcaatga

SEQ ID NO: 26577 - DNA, 303 bp, Glycine max
  Peptide Sequence Number=SeqID_118262
atgggtgatcaagaggagacacaggaacagatgaaagccgacatgtcggctctgaaagaacaaatggcttccatgttggaggccatgttaggaatgaggcaactcatggagaaaaacgtggccaccgctgccgctgttagttcggctgccgaagcagacccaactctcctagctaccgcgcaccatcctcccccaaatgcggtaggacaaggaaggagcacactggggcaatttagcaacccccatttgggatacaaccgggcggcttacccttatggattgccaccttattacacaccgtga

SEQ ID NO: 26578 - DNA, 263 bp, Glycine max
  Peptide Sequence Number=SeqID_118263
gggcgccatcggaagagggtatcgcgcctttcatcgcacgaggctttagtgacctcaatgcaaaaatgcttcaaagagtccgaaaagcatggaatgcagtgcaaaggaatgataaagagcttagaggaagcaacaacggtgttattggtggatttcaagtgaggaagaggctgaaatccctgagcaacaacaaactcaagcttcgaagggctgaaagggacgagtcgagactggaaagtatgatattagaggacaagttaaag

SEQ ID NO: 26579 - DNA, 363 bp, Glycine max
  Peptide Sequence Number=SeqID_118264
atgtgcatgatcatattgaggttgttggctctcaatgagtataggagtggagttattgacattctcattgggagtgtacgccacattgggtggcgtatagttgggaggcaagccatatggtccccctcagcaatggagctgggagcggctattacagccgcattgacctccattatctcctttatgctcatcatggcccccatcattggggccatttgctctttcaaggcctccgtgttggccttcatctactcttgcacctcctctacttcacccattactctagctctagcacggggaaagaatgcaatgagcaatgcaaccaatgaagagcatggatgtatgcgaatgatgcacagttga

SEQ ID NO: 26580 - DNA, 432 bp, Glycine max
  Peptide Sequence Number=SeqID_118265
atgactgggctaaggtgctcaaaagtaaggctatcagagacaacccctctggctctacatagggcggtgatcagagcaggaaacccaagtctagaagagttagactgggctatagaagtcatctggccagaaatgagagctcctacgttcatgtccatgcgagaggctaggccaaagatcaacccagctctgtccactatcagatcagaggtatatgatgtgggggccaagttggagtatgaaagaacactccacgactgggctaaagcagccaaatctttcttgagaatcctcctaggatggccctcagcattcaagatgaaccctcgtcctgcctgcagtatctggagtatatgggcaaagtctcaccttctgccaacaccccagtgtctccaggaatgtgttgaggctgtcagcgtcgatcttcactag

SEQ ID NO: 26581 - DNA, 180 bp, Glycine max
  Peptide Sequence Number=SeqID_118266
atgtgtgttcaagaagaggagagattgataatggaagagggtgagaagaatgaagctttagatgcctttaaagtttttaaggctgaagttgagaaacaatgtggaaaacaaattaagatcgtgagatcagatagaggtggggagtactatggtagattttacacagaggatggactttaa

SEQ ID NO: 26582 - DNA, 281 bp, Glycine max
  Peptide Sequence Number=SeqID_118267
tcattattttggggacgccacaagatgaggctactacttcaccttcctttagtgaaagtgaagaagcaaaaggggaagaatctagtgaagaaatctacccccaagaagaaggacaacctttaatggttaaggaggagtgtaaggaaatacttgttagcactgccacacctcttgggcttgaggttattcctcaagtaacggagttattggatgaaggtttagttcataagatcttaaatccttgtgctttatgttggatcaagtggcctcggaataattaa

SEQ ID NO: 26583 - DNA, 411 bp, Glycine max
  Peptide Sequence Number=SeqID_118268
atggctaagtttgaccctgaggtagtcctggagttttatgctaatgcttggcccatagaggagggagtgcgagacatgcattcattggtgagggtgttggaggaaggccaggagttcgagttcagtcaaaggaggaacagggtcgacgggtttgacgaggaggccattgcccagctgttatgcacaccggggcaggatttcgctcagatcgctgtagggaggcgggtgcggatcaagcgcaccagcatgaccaccttgacccagacgtggatgacattgctgctcagcaatgtcttgcctagggatcataattccgatttccctctgccgaagtgtcaactggtgtatgccatcctgacgcggatgagcgtccatgtggcccaggcatgccacccaccaggcaccctctag

SEQ ID NO: 26584 - DNA, 500 bp, Glycine max
  Peptide Sequence Number=SeqID_118269
tctctgcgtgctatcaggcttttcgtcttacagacatcaaaaaagaatgtttatacggataaccactcgggtatttccgcccgtcagcatgactcaaatgtcagtatgacagatcttgtgagcgccgaagatgacacatcaaaaaagaatgtttgtacggataaccactcgggtatttctgccggtcagcgtgactcaaatgtgagtatgacagatcttgtgagcgcggaagatgacgtaaatctccgcgtgtcaacgggcttgtcggccgcgattgacgaaggcgcagaagacgacacagcaaaaaagaatgtttatacggataaccactcgggtatatccgcctgtcagcgtgactcaaatgtcagtatgacagatcctgtgagcacggaagatgacatatcaaaaaagaatgtttgtacggataaccactcgggtatttccgccggacagcgtgactcaaatgtgagtatgacagatcttgtgagcacggaagagac

SEQ ID NO: 26585 - DNA, 71 bp, Glycine max
  Peptide Sequence Number=SeqID_118270
ggtttttgagagtatctccgttttggaaatcttctgttattggctggcttatgatcggttcttcctcagag

SEQ ID NO: 26586 - DNA, 249 bp, Glycine max
  Peptide Sequence Number=SeqID_118271
atggcagacttcatggaataccaagctagctctaaaggttattattattctatgcaacagcagggaactcaatttgaaagggactattcttctgcagattatcaagagggaccagagttacaaccttactatcaaaatgaagcagaaagagaggttgaagctcaaaaggaaagccctgtaaaagaacatgagtcaagagaaaagatgagaaacatgcacaacaacaatgggagaagtactcaacagtag

SEQ ID NO: 26587 - DNA, 741 bp, Glycine max
  Peptide Sequence Number=SeqID_118272
atgttcatgcaactcggcctgtcatcgcttgcgctgttctgggcctactccacctggatatcgggaaagcgcacactgccacttttcaccgaggtgacacacgcactaaccgccgttccgatcacgatcacgctttttcaggccatgcgaaaacctttcggacgccccttcaaggtcacggaaaagggcggagacaggtcacaggtgcgcgttcacggcccgacggcgctattctttgcccttgtaaccctcacttcggccatctccgtgctgattgccgtttatggatgggacgcacccgtggaattttcggcgcgcgattgtctcaaccttatctggtcggccgtcgccatgatgattgccttcatcagccttatctgctgcatcgaattgccgcgtttcgacagggaggagccgatcagcgtaaaccttggcggacaattacggcagggcaatgcggtgacaggggtgaagatcgtggcactgtcgactgaaaccgtgacgcttgcgggtttcacttcttctacagaagcgcaggccatattcgtgccggaggtgggctggttgcagatcgatgcaacaaaagaccagctaatacccggaaaattctgccttgctgcaaccgccgagcagcatcgggctatcctgcggctgcttttccgcactgcaccggaaaatgtggcggaacagggcgacctgataaaatccatgcagatgttgctcgcaagggccttcagctaa

SEQ ID NO: 26588 - DNA, 324 bp, Glycine max
  Peptide Sequence Number=SeqID_118273
gggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccccaagttcaaggtaccaaactttgacaaatacaaggggactacctacccccaagaaccacatgaagatgtactgtcggaatatgggggcatacacgaaggatga

SEQ ID NO: 26589 - DNA, 297 bp, Glycine max
  Peptide Sequence Number=SeqID_118274
atgagggatggcaaaagatcttcgtacatcattaggagtggggtgaattccggaaatggcctcggagggaagttccttgtcgtgttggaattaccggccggtcgagtcgtgttcggagttggaatttggggagcttccctctgggtgggtgccttaggctgcacgggtgttgaactagaggcgttcccgggtttgacccacgcgggtgttgaagagacggcatgggcatctccttccttcctttttgcccctgttgccccgattcttttggcattcgcatttgtggaggaaacataa

SEQ ID NO: 26590 - DNA, 273 bp, Glycine max
  Peptide Sequence Number=SeqID_118275
atgggattccggggcttccaggatacccaatgtttttttgaagctggaggaagcaacccagcttgcctgggcgagctgggcagcaacctcctccccctttttcctataaattggctgaaggggactgttctaaggatcccggatgcccctgatgtgaaaatccaagccgaggtgcttccagaacgcttccgagaggtttccgtaagcaaatccgtgaaggttttcctccgttattcagcattcttcatccgttcttcgttcttcaacgggtaa

SEQ ID NO: 26591 - DNA, 153 bp, Glycine max
  Peptide Sequence Number=SeqID_118276
atgtttgcttacagtcctttcgctaagcgcaagcctcgtgctaagcgcatctctgttcatgcgctaagctacaagtctcaagcgcttagcgcccaacccttgcatctgaggctgatttggtccgctaagctggccaaggttgagctaagctaa

SEQ ID NO: 26592 - DNA, 834 bp, Glycine max
  Peptide Sequence Number=SeqID_118277
acgatcccacttaacgtccttgcctttagaggactacacgtcctcgccttcagagggctgcacatcctcgctatgagaggactacacgtccacgccttcagagggctacacgccctcaccttcagaggactacaagtcctagccttcagagggggatacacgccctcgccttcagatgaatacacgcccttctcttcagaaggctacacgccctctccttcagagcactacacgtcctcaccttcagagggctacacgcccacaccttcacaagtctacacgtcctcacctttagaggactacatgtcctcgcctttaaaggacctcacgtcttccccttcagaggactacacagggctacacgtcctctcctttagtgggctacacgtcctcaccttcagagggatgcacgtcctcgccttcggaggggtccacgcccttgccatcagagaactacacgtgctcgccttcagaggggctacacgctctcgccctcagaggactacacatcctaacattcagaggactgcacgccttcaccttcagagggctacaagccctcgccttcagagggctacatgccctcaccttcagagaactacacctcctccccttcagagggctacatgtcctaaccttcagagggctacacgccctcgccttctgaggactagacatcctcgcctacagagggctgcaggccctcgccttcagagggccacatgtcctcgccttcagagggcttcacgtcctcaccttcaacgggctacatgccttcgccatcagtgggctacacgccatcaccttcagaggactatatgcactcacctttag

SEQ ID NO: 26593 - DNA, 586 bp, Glycine max
  Peptide Sequence Number=SeqID_118278
atgaattcctccatttatattcttgtctttgtccagctttggttgttcagcttaccatgcagagagagtgtgtgcatcccaagtgagcgtgagacacttttgaagattaagaataatctcatagatccttcaaataggctttggtcttggaatcataataataccaactgttgccactggtatggagtcctctgccacaacgtcacttcccatgttcttcagcttcacctcaacacttcagattctgctttctatcatgaccatgatggctatctctactcagacttcgatgaggaagcttatgagaaatcccagtttggtggagtgataagtccttgtttggctgatttaaagcatttgaattacttggacttgagcggcaatgaattccttggagaaggtatgtcaattccttctttccttgggacaatgacttccttgactcacctcaacctctcttatactggattcacggggaagattcctcctcagattgggaatctctccaatttggtctaccttgacctcggaggttatttgactgatctcggatttctgtttgctgaaaatgtagaatgggtatcaa

SEQ ID NO: 26594 - DNA, 488 bp, Glycine max
  Peptide Sequence Number=SeqID_118279
ctcccggagacggtcacagcttgtctgtaagcggatgccgggagcgacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccaactgggttggtttttgacaaggtgcagcggtgtggttggatacttgttgaacgtggtatctgggtggaagtatctaccatcaatattagccgttaa

SEQ ID NO: 26595 - DNA, 1081 bp, Glycine max
  misc_feature (73)..(73): n is a, c, g, or t
  Peptide Sequence Number=SeqID_118280
atgatataccggccatgctgggtcacacgatcgcggtccacgacggacgtaagcacatccctgtgttcgtgtncgagaccatggtcggtcacaagctgggcgagttcgcgcccacccgcaccttccgcggccatgagaaggacgacaagaagggccgtcgccgctgacgcggggacgatagaggagagagaaatggtggagtccatcgcacgcgtgcgacacatccgcgtgacccctcagaaggctcgtcgtgtcgtcgcgctcatcaagggcaagcaggcccaggaggctctggcgatcctgaagttcgcacagcagagcgccagtgagccgatctacaagcttgtcgcgtcggctatggccaacgcgcaggtcaaggcggatcgtgacggcgaatacctcgacgagcaggacctgtacgtgaagaacgcgtacgtggacgagggcacgacgctcaagcatcaagaagcgcacgagccacatcacggtcgtgctctcgacgccggaggtggccccggccgctgctggcgacagcaacaagaaggcgagcaagtaatgggacagaaggtaaacccgtacggcttccgcctcggtatcacgacggaccacgtctcgcgctggttctctgactcgacgaagccgggtcagcgttacgccgactacgtcgccgaggacatcaagatccgcaacctgctcaagacgcagctcgaccgcgccggtgtctcgaacatcgagatcgagcgcacccgtgaccgcgtccgcgtcgacatccacaccgcccgcccgggcatcgtgatcggtcgtcgtggagccgaggccgagcgcatccgtggcgacctcgagaagctctcgggcaagcagatccagctgaacatcctcgaggtcaagaaccccgaggccgacgctcagctcgtcgcgcagggcatcgccgagcagctctctgctcgtgtggcgttccgtcgtgcgatgcgcaagggtctgcagggcgctcagcgcgccggcgccaagggcatccgcatccaggtctccggccgtctcggcggcgccgagatgagccgctcggagttctaccgcgagggtc

SEQ ID NO: 26596 - DNA, 264 bp, Glycine max
  Peptide Sequence Number=SeqID_118281
atggctagtttgtcgtattttcatgaggaatcggggtatggagagcatcaccaggacaattgctatttttattctataaataactttgatcggaggcaggaaccggccatgtacaactattatgagaaagggagagcacctgatcttgaaagtgtattggcagacttcatgacataccaagatacctctaaaggcgattgttattccatgcaacagcaaggaactcagtttgaaagggactattcttctacagattatcaatag

SEQ ID NO: 26597 - DNA, 243 bp, Glycine max
  Peptide Sequence Number=SeqID_118282
ggctttttccggaggagccctggtgcttaccaacatggatggcgaagagctaccttcacccgtgaactctgatgtcgggcaggatcatcttgggctaccttctggggtagagacaaaacatgaacggcagaaaccaatcaaggtacttaaggacggatgcaagtggggatggggtcacgaccgaccgatcgatgccccttctctgcgcgaaacaagcagagaatgtcgctgcaaggcagcccc

SEQ ID NO: 26598 - DNA, 279 bp, Glycine max
  Peptide Sequence Number=SeqID_118283
atggagtcaggtgacatgcaggggtaccatatggttatctgcaccattcatcaaccaggggcaaacgagcccgttgacgtgcagagactaacatgtagatgcaattgcctttggtgttttgatgatgatcatgatgatatgatgcaattgatgcaaatgggcttttcaagattaaattcaagacaatacttcaagattacaagtcacaacatcaagatgatcactagtatattaggaagggaattcctaattgaattagcaaaaggtttggccaagtaa

SEQ ID NO: 26599 - DNA, 545 bp, Glycine max
  Peptide Sequence Number=SeqID_118284
gcagagatagagctgctgacgaggatgctggcgatgttcccgagaggcgtaggcctactgcctcagcccgtaggctacgcgttcatcagatgactacggagggacgtgatatggctgaggacgtcgctgacatgactgatgatgtccctgagcagcctacggaggcacctgagatgcgtgcggacgcacagggtgctgatagtggtgaggggtcagatggtgatgatgctgcaaagggattccctggtggtccacgtgacccgtcagtgctcacatcatttgccgagcatgttgcacatgccgtgtggagtggacaggaacgtcctgatttgaagttagtgtcacatgggaggaaggtgacactgattgggaggccagtgcctgagattgaaggcctggtggctgccacaggattaagtccactgatagattgttcagttattactggcgatcctggacttatatccgcatttgtggagaggtggcacagtgagactagcaccttccaccttcctgtaggagagctgacgatcacatttggatga

SEQ ID NO: 26600 - DNA, 213 bp, Glycine max
  Peptide Sequence Number=SeqID_118285
atgttttacgagaatgctccaaccatatgggatcagcataagcttaaaggagaactcaaacccagtgaccccaaggcctacactctgaagagtctgtcatggcctctccctgttgatttagttttactcaatctcaataataatattataatctcaaggcaacatattattccacaattcatcacatatttcatttataagcactgctcatga

SEQ ID NO: 26601 - DNA, 310 bp, Glycine max
  Peptide Sequence Number=SeqID_118286
atgacttacaccaagaaaactgaccaaatgatgtttgaggcggcaaaggaaattgctaacaagattggaaaacaccctggtcgtgtgcgtgctgctggagccaatgtcacgatcaaacaatactttggaccgactccaagaacctcccacacatcttcgtccattgctccgaaagacatggagcagttgacgcaaaaaatcagggaccagctggaggagtcgatcacagaaaaagtactcgcactacctcctgagcctgtggatggtcgttcagctactcatgtcagcacaaaggccatgtcgtcatctg

SEQ ID NO: 26602 - DNA, 219 bp, Glycine max
  Peptide Sequence Number=SeqID_118287
atgcttgtttcgagggttccgaagggagcaaacaaggttcaaggaccgaccgcaaggatttggtgcccaataatacctatttcgggcacctgtggaagcaatgccttccaagattattttgatgatgccaaaaaatcaagagtcaaacaagtttccagaatcaagattcaagattcaagaataatcaagatcaagattcaagattcaatattcaagtaa

SEQ ID NO: 26603 - DNA, 618 bp, Glycine max
  Peptide Sequence Number=SeqID_118288
atggctttgtgttcagtttttctcaatcttcatcttctgctttttgtttgtttgaccatagaagcgttaggtgtggcaaagccttcagtagctacttaccttagccaggagatactggcagagcaagaagttgatagagtgcatggattacctgtgcagcctccggtgaagttcaagaatatggtggttatatcactgtcaatgaaactcaaggaagaacattgttctattggtttttcgaggccactcacaaaccagaacaaaaacccgttctcttatggctcaatgcagttatttcacaagctcccttccttcttcctccctctccccccaagctcctttcctccttcgcctccgcctccgccgctccctttcctttcctctcctttcccttcaaacgaatgtttcttcatgtcggactcagccaacaagttgcgattggtgcgtttcccaaagtgtcaaaatcttcttctcgaactcgctgattactctgtctatcaatgtggtggctgtggtgccgttcttcgagcaaagcataaaggttatgtgagtggtagcttgtcggatgaggggaaggttggacttggaggagattctggtaaattagaaagttcttag

SEQ ID NO: 26604 - DNA, 350 bp, Glycine max
  Peptide Sequence Number=SeqID_118289
gtttctatgttcgtccaactttttttgtcagattgctcctgtttgccactgtttgcaaaaccgaaaagggttcaaaaattggagctactctctggcaagaactcttcactgaattgcgggacaagttacagtgtggttcttcgtatttgattcagaacctgaggattgttgacaaccaatctgaatacagagtcaacccagctccatatttggtttatttcctaaaaactacatctgtcaaggaaattcaccgtccagaaattccttctaatgtttatctcataactccttttactgatataatctctggcctcgcaccacgccatactttagtgggtgagtttgtttag

SEQ ID NO: 26605 - DNA, 604 bp, Glycine max
  Peptide Sequence Number=SeqID_118290
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctgcctcagtttgtgcttctccttcaatatgcacttccacctgcaatggctatagagtcgacctgcaggcatgcaagcttggcactggccgtcgtttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 26606 - DNA, 366 bp, Glycine max
  Peptide Sequence Number=SeqID_118291
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatccccgaggaagtcatatcggcatctgaggcagattctatagaggatagtggcccgggggagatggcgatcagcggaggctcttcatcatag

SEQ ID NO: 26607 - DNA, 786 bp, Glycine max
  Peptide Sequence Number=SeqID_118292
atgggtcagctccagcggcaagcttttcgcaaagcttacggtaaaatctgggacttagccatggtagaagtctccacagaggccattgcctcccatgcccagtattatgatcagccgatgaggtgcttcacctttggggacttccagctatcacctatggtagaagaatttgaagagatcctaggatgccctctagggggaaggaaaccatacctcttctcagggttctatccctcattagctagaatttccaagatagtccaaatctcggcgcaggaattagaccataggaagcaagtcgaaaatggggtggttggaatattgagaaaatatttggaggaaaaagcaacaatcttggcaggtaaaggcgagtgggccccgttcatagatattctcgcattgttgatcttcagaggagtcctctttctgaatgtggatggattggtggacctagcagtgatcgacgcttttcttgcctatcataaccaaaaggaaagcacgattgtcgctatgctagccgacctatatgacgcctttgaccgaagatgtgaaaagagaaatacaaggattgtttgctatactccagctctttatgaaggaagaaccggagttcttatttcatgcggaggatttccaaatgttcccttgatggggatgaggggttgcatcagctacaatcccgttcttcctataagacaacttggctaccctatgagaggggcgccactagaggatgagctcgtgatgcaatcctatcccgcaagggcattgggtagaagactccaa

SEQ ID NO: 26608 - DNA, 386 bp, Glycine max
  Peptide Sequence Number=SeqID_118293
gggtgaaatgaatatctggacagcacacgatcaagggtgggaacaggagttaagtccttacaatcaatatgaagaagaaagaactcctaatcttgaaagtgggtttgtggaattcatggcataccatgtgccataccctaatttcgtccgaggaccattgtttgttggcatgtttctttcgcttgaccacctcaaaatttttaacacccatcattgtggaatccgtaaagttccgagatgttttgagaagaaactggtcaaaaacacgaaaatgagagtgtatttagcaaagtggggaggaagcaactgggcggcaagctcctccacgttgttgaaaaatggtttccggggcttccgtggcttccgtaaaatttccgaaaaccttg

SEQ ID NO: 26609 - DNA, 489 bp, Glycine max
  Peptide Sequence Number=SeqID_118294
atgccgcctactaggcaccctctagacccagataagtctaatagggccctgggttttccagcattgatcacgagtctctgccagtcgttcgggtttcccgtcacacctagaaaggtgattcgaccgccgatcacccgggctttcgtagagaagtattgcacgcctagacaggcgcagggtggtgacccgcaggccccagacgcaccgccgccacctcatcaggctgatccaactgggtcatttgacacggagcggtatttacggcatttggtttgccagcaggcggccaaccacagggcgcacggtttcgctccttttccatgccctactccagatcagttcagggcaaaggtcgcatggcccagagattggcctgaggcccaggtaggggaggtgcccgcagaggctcccggcgatgcagatgaggcctgcatggacgaggagatgacagacttactcgatttcttgggagggagcggagccacatga

SEQ ID NO: 26610 - DNA, 270 bp, Glycine max
  Peptide Sequence Number=SeqID_118295
atggcgatgagggatggcaagaggtcttcgtacgtcattgggatcggaacttggggagcttccctctgggtgggtgccttaggctgcacgggtgctgaactagaggcgttcccgacggcatggccatctccttccttcctttttgcccctgttgccctgatggaagcttgcttgtggggcttctatggaggctggatctttgagcttcaatggggtcctttaatggtgattttccaccatggagatgcagcggaagacaaaggaaaatag

SEQ ID NO: 26611 - DNA, 657 bp, Glycine max
  Peptide Sequence Number=SeqID_118296
atgaccactcttacgtggatatggcagacgttgctagttagcaacattctgcctagcgaccacaatgccaatctccccctgcagatgtatcaattgggatcgcgcccacaagacgcccaatggacccgaagaagtccaacagggccctggggtttccagctctggttacgggcctctgacagtcctacagggtacccgttcccccagcgaggaatcgcacccacaaagacacccagtggacccggagaagtccaacagggccctggggtttccagctctggttacgggccttctgtagtcctacagggtgcccgttccccccggcaagagatcgtgcccgcaagacacccagtggacccgaagaagtccaacagggtcttgaagtttccaagctctaattatgggcctctgtcagttctacggagtgcctgtcgccccagcaagatcatcaggtcccctactaatcaagctttcatcaagaagtactgcgtccccaagcaggcgcagggcgaaacaccacagcagcctagggatggccggcagcgggcgacaaacgtaccgccatcacctctagagttcacctcagctcatcctcaaaaggttagagcgttgcttacaacccatggccgaccaataggtgaccaagtccaaagctaa

SEQ ID NO: 26612 - DNA, 144 bp, Glycine max
  Peptide Sequence Number=SeqID_118297
atggtgattttccaccatggagatgcagcggaagacaaaggagaagaggatgattcaatggaggaaaagaaagagggagagaaagagagatggggggagcacgaaattgaaggaaaaaaagagggagagaagtggaactttgaa

SEQ ID NO: 26613 - DNA, 771 bp, Glycine max
  Peptide Sequence Number=SeqID_118298
atggcattattggtggttaacatgaatgctgaaagtcatacacgaggtttagattggctcgccaagttaaaggttgtcagcgaagagagtttcgaagcgccggaagaggacgaagaagtccaagctctcaaaaacgagttaggaaaggcgagacttgccaaggagaagttcaagttagccgctacagacatccggaaagagtgtgtcggattacgagaagagaatgcaactaccgcaagagcccttgaacaagagaccaagagggctcgcaaggaagagtatggtcgtaacaaatttcgcggagctttgtggggtagcaacagtgaactcaagctgcgaagggaagaaagagaccagtcgcgagcacatggcatggtcttgaaagaggagttagttgcttgttcaaggtccagaagaaacttgtctcagcgtttgtgcaagacggagaccaacatgctagctatcatcgccaagtaccaagaagagctaagtctagccacggcccacgagcatagggtcgcggacgagtatgcccaagtatacgcggaaaaagaggctagaggaagggtgatcgactctttacaccaagaggcaaccatgtggatggaccggtttgctcttaccttgaacgggagtcaagaacttccccgattgctagccaaggccaaggcaatggcggacacctactccgcccccgaagaaatccacgggcttctcggctattgtcagcatatgatagacttaatgacccatataattagaaaccgctag

SEQ ID NO: 26614 - DNA, 126 bp, Glycine max
  Peptide Sequence Number=SeqID_118299
atggggggggggggggtttggttgtttgggaaaactgccaggaaaccacattgcaagcgaaacctcaaagagagttgggctttgtcctcaaaaggaacaacaccagaaaatctagccttccattaa

SEQ ID NO: 26615 - DNA, 834 bp, Glycine max
  Peptide Sequence Number=SeqID_118300
atggccacgttcacgggcctacggaagtccgaaatattcggtctcgcctggtcctgcgttaacctgggaggccgctacttctggatagacacgacaaaaaacggcgacccgcttgaactgcccatcacccgtaccttactggcgttgttccgccgacgcgctgcggcgcggcgcgaagagcatcctctggtctttccgggcataaagaccaccatcaaagaataccgccacgtcaccgggcgcataagccggtcaacggttcctgaacccaatccggataatctgcagcctatcccgttcaagtggcatgacgcgaggcgaacttacggtaccgtggctgagctggccggggtgggaagctatatcctcaagcggctgatgaatcacagaacgctgcgcagtgccgatgtgacccaggggtatctgcactttggtgcagatgaactgcaggcaccggcagcaaaaattgagcatgccatcctgggctacagcgggagagcagataagcctgaaggcctggatgcccggctgaaagaagcgctggagcacctcagtgatgatgagaaacgaagactgcttttttcactctcggaaaaggtcaatgagaccgcaggacgtatatcaccgaaatttcagacccgctctggtgtatggacctcgcgaaaggcagctatgaccgtgcccggctggccctgctcaaatcctatctgctgcttctgcttgaacagcactaccacacagccatttcacttcttctgttctgagtctttcgacatcctggacagaccgatactgcacgtttatgatgtcggcatgatagctgcgtcagtctga

SEQ ID NO: 26616 - DNA, 366 bp, Glycine max
  Peptide Sequence Number=SeqID_118301
atgtcgtggcagcctgccataggccgaatgaggttgctcacaaaatttcaagtcatttggatatcatttgagggtagcaatccatctgacttacaaccctttgatcctgagatagataggacatttcatagattagttaggcatcattttataccttttgatcatcctgagcattccattactggtgaatatgtgcattctgttattggtgattttgaacatcctgattttgagcattctaattttgaacattccgagaacatggcacaacctccaccccgtgagaggactctaagggagatggctgcacctgatttcacctatgaaatcttgtgcatccaataccctgatgaggatgtcccatat

SEQ ID NO: 26617 - DNA, 384 bp, Glycine max
  Peptide Sequence Number=SeqID_118302
agacaggcccagggggatgctccgcaggtcgcagacgtgccgccacctcatcaggctggtccagccggatcgtttgatacggagcagtatttgcagcatttggttcgccagcaggcggccaaccaccgggctcatgtacagacccatgattgtctttacaagatgagccttagcctgcagagccagggttttacttcgtttccgtgccttactccagaccagttcagggcagaggtcgcatggcctggagattggcctgaggcccgggcgggagaggcacatgcggaggcaccagcagaggctcccgacgaggcagatgaggcccgcgaggacgaggagatgaccgatttacttgatttcttaggagggagcggagccacatga

SEQ ID NO: 26618 - DNA, 483 bp, Glycine max
  Peptide Sequence Number=SeqID_118303
atgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccgaatctcatggagagttcgatcctggctcaggatgaacgctggcggcatgccttacacatgcaagtcggacgggaagtggtgtttccagtggcggacgggtga

SEQ ID NO: 26619 - DNA, 303 bp, Glycine max
  Peptide Sequence Number=SeqID_118304
atggttaaacattcttttggtattggagctgctattgttgccttctttggttatcagaatgatatggatggtcagtgggtgtggaaacacgaccttccaccaactgttcctgatgaatgtacaccctcaccaccaccacaaagggattcctcctcttcattgttgcatgatgttctaagtgaacttcaggatccacgggcctttgtaggtgatcgttttgacgctatggattcatgcatcacacgtcttgaggatgatatgagcttcattcaccgatgctttgaccctccggtagattcgtag

SEQ ID NO: 26620 - DNA, 135 bp, Glycine max
  Peptide Sequence Number=SeqID_118305
atggaagaaaactatcccaacttccctttggctctaagacacatgccctcaaaaggtcctccagcgactgattggtccgttcagtttgtccatcagtctgaggatggaaggtcaacttctccaaagaaaatctaa

SEQ ID NO: 26621 - DNA, 648 bp, Glycine max
  Peptide Sequence Number=SeqID_118306
atgagatatcggagttttgatttgcaccagcttttgtctcactttagtaagcatgggaacaaatcaaaccggcaagaggttctaccaagtcaaggtcaaaagcctagataccaccagcatcaaggaattagggcggttgatggaaccctctccaaatgcaaagccttccgcaagacttacggaaagatctttagagttgaccatagcggaggtatccatagaagccattgcatcactcaccccaatactacgaccagccttttgagatgcttcacgttcggagacttccaattagtaccaaccattgaagaatttgaggaaattctagggtgtcctctcgggggaagaaaaccatatctttcctccgggtgtctcccctctttgagtagaattgcaactatggtcaaagattcagcgagaggtttggaccgcatgaaacagactcgaaacggcatagcgggcctaccacggaggtacctagaagacaaggcaaggggtatggccaatcaaggagattgggtcccgtttatggatgtgttagctttgctaatttttggggtcgtcctctttccaaacgtggatggtttggtagacctagcagcaatcgacgctttccttgcataccaccatagcaaggaaagtccggtg

SEQ ID NO: 26622 - DNA, 465 bp, Glycine max
  Peptide Sequence Number=SeqID_118307
atgctcaccttcagagggctacacgccctcaccttcagaggactacacatcctcaccgtcggggggctacacgccctcgcctttagtgggctacacgccctcgcctttagaggacttcacgtcctcaccttcaaagggctgcacaccctcatctttagaggactatacgtcctccccttgagaggactatacgtcgtccccttgataggactacacgtcctcgccttcagagggctacacatcctccatttcagaggactacacgtcctccccttcagagggctacacgctctcgccttcattcctgggccaccccctgatattggaggagggccaactgtgcgagcacaaccagagaaggaggctatcacgcagctactatgcataccggggcaagatttgacccatgccgctgcaaagagacaagtgcggatcatgtgcaccaacatgaccactcttacatag

SEQ ID NO: 26623 - DNA, 597 bp, Glycine max
  Peptide Sequence Number=SeqID_118308
atggctcacgaaatggttctccgaattgaaagtggatgctctggatctcgaaatggaaggtatgctgctatacgaactgtaagagatgctaggcaaggtgggaagcttctggctctagcttactctgctacaactactgtgacttccactgccgctacttgctttgctactttaggatttggaactaggccttatgctgctggtggaggtagtggtggggaagctgaatcgccggaatcaaccggctctactgaagcaactactcactctggatctgctactggaagatatgaatataggcatagagccggagtagattcactcatagcagatacattggttattgatatggatgagactgatctccctaacgcgctacaccatcactacactatagataggaatgccctgcgatcagcctcaaggctaggttcagggatcaccacaacctggagctttataagggggttctataaggttcacgccccgtctaaggctcgaccgagctggtgctgttacgttaaggtaaggcttgagaaggtcagggactacggtaatggaccgctggctcttgttcatcaagtcgatccggaagaa

SEQ ID NO: 26624 - DNA, 411 bp, Glycine max
  Peptide Sequence Number=SeqID_118309
atgattatgaggggccaagacatttgtagtagccaagatcaggctactacttcaccttcctctagtgaaagtgaagaagcaaaagcggaagaatctagtgaagaaatctacccccaaaaagaaggacaaccattagtggttaaagagaagtgtaaggaggtaagtgtttcctccaagaggttagctaagaaggaaactcattttacaataaaaacaaacattaaagaaactttccctcttagacaacctccacattttctcttttgtaaaaagacacttgctagcattgccacacctcttgggtttgagtttattcctcaagtaaagaagttgttggatgagggtttggacatagaagctagcaagcaagctccacaagcaagctttcatcatgtggtctacgaactttaa

SEQ ID NO: 26625 - DNA, 489 bp, Glycine max
  Peptide Sequence Number=SeqID_118310
atggtgaaagttggacctcttacgtgccgatcaacgtctcattttcgccaaaagttggcccagggcttcccggtatcaacagggacaccaggatttatttatctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatctccaccttcgagtttggagctatgtttcatgattgcctaattgcggaccctcaaggaaatcctccattctccccctttttcggagccccatga

SEQ ID NO: 26626 - DNA, 221 bp, Glycine max
  Peptide Sequence Number=SeqID_118311
ggatcgcgcccacaagacacccagtggacccgaagaagtccaacagggccctggggtttccagctctggttacgggcctctgtcagtcctacaggatgcccattcccccaacaaggtcatgccatcgtgacataggaatcgcacccacaaaaacacccagtggactcagagaactccaacagggccctggggtttccagctctggttacgggcctctgtag

SEQ ID NO: 26627 - DNA, 225 bp, Glycine max
  Peptide Sequence Number=SeqID_118312
atggtcattgcacttgatggtgcccatgttcgatacgttggatgttgtgtatgttcgtggggggcgaagtgcattgaccttgtcggatggcccattcatgggggacaagtgtggttaaagaatctaagcatttctgaggggatgcttaggcgctttaattggtccatggtcattggcacttgcttatggccacgttcatacgtcgtgtatagtgtatgttcatga

SEQ ID NO: 26628 - DNA, 546 bp, Glycine max
  Peptide Sequence Number=SeqID_118313
ggatcgcacccacaaagacacccagtggacctgaagaagtccaacagggccctggggtttccagctctggttacgggcctctatcggccctatagggcgctcgtccccccagcaagctcatgccatcatgacataggtaaggattgtgcccgcaagacacctagtggacccgaagaaggccaacagtgtcttggagttgccagctctaaatacgggtctctatcagttcaagggagtgcctgttgcccccagcagggtcatcaggccccctaccaatcgagttttcatctagaagtgttgcgcccccaggcaggcgcagggcgagacaccacagcagcattgggatggccggtagcgggcaatagacacaccgccaccacctctagagttaacctcagctcatccacaaaaaggttagagcgttgcctacgacacatggccgaccagcaggcgaccaaatccaaagccaaaggtaagcaaagtactaggtccgtgacctacaagccatcatgcgtccagctaaagacgttaaagaagcgctactag

SEQ ID NO: 26629 - DNA, 318 bp, Glycine max
  Peptide Sequence Number=SeqID_118314
atgaaggctaacatagaggccatgaaatggaacaaatggccatcaatgatggaggccatgagttccatgaagaagataatggagttaatgcgctgcagttgccactgtcatcactccttttctggggtggacccgactcccataccatctaggcctcacctaaatcatccacgaaagagaaactctagtcctatactcattgagagccaacaacttcaatatgatcatgcacatgtctctcaacccatgggggagacacatgaaatgccccaccacaatctagctgacttcaaagccttgcctcggatatgccactga

SEQ ID NO: 26630 - DNA, 505 bp, Glycine max
  Peptide Sequence Number=SeqID_118315
cgctgttgctgaggtggacccgactcccccatctggcctcaatcaaataagtcatcctatctcggatatggtagggaagagaggcaaagaattgggaagtacgggtggcccccattttgtgcaagttcaaaacaagcatgccttcctgccatatggcttacctactaattatatgccacccaatgtggtgcacacacttgatgagaatgtcaataactccactcccatactcgttgagggccaacaacctcaatttgatcattcacatggacaagaaattggtggtgtacccctgccaaacactttgaagggccctcagttttgcccacaaccacaacccttgcattttgctgtgggaagagcccttcttgctatggctgaaaaggaaaagttggatcagatagaggaaaggctaagggtcattgaaggaggcggagatcatgcctttgctgacatggaagatttgtgcctagtacccaacgtggtcattcctccgaagttcaag

SEQ ID NO: 26631 - DNA, 312 bp, Glycine max
  Peptide Sequence Number=SeqID_118316
atgaggtcacatgaacgtctatatttttacttgaaaacacagtcaatcaaatgcctttttgatcgttgctttgatggccttgtaggagggaacctattgggtgagaacttcaatctgcccctaggttcgcttgagggcttagaggtactcaagtgttgtcttgttttcacgacctcagtgaggaagatgaaagaagcagttgatcttgcaaaaagaattttccaaggacgagaaatagttgaaggctttcagttgaggattaagtcaaatgactcctatgtagaagcaagatttttgagtcttgatgactaa

SEQ ID NO: 26632 - DNA, 117 bp, Glycine max
  Peptide Sequence Number=SeqID_118317
atggatatcaatgcaagcacaatcttcacagcgaaacacccaagactgaaacaggggaaacacttaaaggggaaaactgaaacagaacacacattaaacaaaataccaagacactaa

SEQ ID NO: 26633 - DNA, 78 bp, Glycine max
  Peptide Sequence Number=SeqID_118318
atggctcctccagaacggaacccagttcttccgctgcgtgacgcagcacacgaagctggtcgcggacagtttcatatg

SEQ ID NO: 26634 - DNA, 468 bp, Glycine max
  Peptide Sequence Number=SeqID_118319
atgggacctctccaaaggaaagcctttcgcaaagtgtacagaaagattctagatttgaccgcggcggaggtgcttcacgtttgggacttccaaatggtaccgactattgaagagtttgaggaaatactaggatgccctcttggggggagaaaaccgtatcttttctccgggtttcttccctccttgagcaagattgcagctgtggttggagattcggcaaaagagatggatcccatgaagcaaactcagaaatacttggaaggcaaggcaagggatatggcgagccaagagaagtggggcccatttgcccccacacctttgaccggaggtgtgacaacaacagtgcacggattgtctgttgtttacacctattccaacaagacacaagacactcgtgtccgcatcaaagttatcgctcatgcgccgaaaaaggaagagtcgattgggaccaacatttggctgggatag

SEQ ID NO: 26635 - DNA, 195 bp, Glycine max
  Peptide Sequence Number=SeqID_118320
atgtatcctctacttgtaccacaaaggaccctccaatgtgttgggacaaagaattctcaggcggttagtcctttgaatctttgtaaggggaaacaaaagatatctcaggcgggagaagagagacacaaaagaattcaggcggttagtcattctgttcttttggcaaagggagaagagaatgaaaaagacgaatag

SEQ ID NO: 26636 - DNA, 66 bp, Glycine max
  Peptide Sequence Number=SeqID_118321
ccttgggattcgtgcaagactattctgttatgttattcattattcagagctttgttgaggttttag

SEQ ID NO: 26637 - DNA, 696 bp, Glycine max
  Peptide Sequence Number=SeqID_118322
atggctgaaaagaattttgaagctccggaagaagatgaagaagtctgggctctgaaaaccgaactaggaaaagcgagactcgccaaagaaaaattcaagttggttgctacagacgtccgaaaagagtgtgtcgagttacgagaagaaaatgcagctaccgcaaaatcccttgaacaagaaaccaagagggctcgcaaggaagagcatggtcatgacaaattccgtggagcattgtggggcagcaacagtgagctcaagcttcgaagggaagagagagaccgatcacgagcacatagcattgtcttaaaagaagagttagccgcttgctcaaggtccaaaaggaacttgactcagcatttgtgcgagatagagaccaacatgttagctatcatcaccaagtatcaagaagaactaagcctagccacaacccacgagcatagggtggcagacgagtatgcccaagtgtatgcagaaaaggaggctagaggaagggtgatcaactcgttacaccaaggggcaaccatgtggatggaccgatttgctcttaccttgaacgggagtcaagaacttccccgattactagccaaggccaaagcaatggcggacacctactccgcccccgaggagatccacggacttctcgactattgtcagcatatgatagatttaatggcccatataattaggaaccgctag

SEQ ID NO: 26638 - DNA, 765 bp, Glycine max
  Peptide Sequence Number=SeqID_118323
atggccaagtttgatccagacatagtccttgaattttatgccaatgcttggcctacggaggaagacgtgcgagatatgaggtcttgggtaaggggtcagtggatcctgtttgatgccgatgctatcggccagctcttgggatatcctttagtgctggaagagggccaggagtgcgagtatggccagaggaggaaccgggccgatggttttgatgaggaggccatcgcccagttgctgtgtataccggggcaggattttgcccggactgctgcagggaggcgagtgcgaatcatgcgcaccaacatgaccaccctgacccagatatggatgacgttgctgctcagcaacatcctgcccagcaatcataattccaacctccctctgccgaagtgtcagctggtgtacgctgatgccatctatctatttgcaggtatggcgccgaccaggcaccctttggacccagataagtccaacagggccctgggttttcccgcactgatcacaggactctgccagtcgtttggagtccccgttgcacctaccaaggtgattcggccgccatcacccgggcttttattgagaagtactgcacctagagacaggctcagggtgatgctccacaggccgcaggcgcgccgccaccacctcatcaggctagcccggctgggtcgtttgacatggagcagtatttacggcatgtggttcgccaggaggcggccaaccacagggcccatgtgcggaccaatgagaccctttaccagctga

SEQ ID NO: 26639 - DNA, 240 bp, Glycine max
  Peptide Sequence Number=SeqID_118324
atggatagacatagacacaggccttacttcttactcttacccaggccggggaaaagatgctctatctttcccgatcgacattgcaaaggcccaaccaacaaaggcattagtatcagattcaaggttttcagccggatcgagctgcattctattctggttgggaaagcggcgaaagttccattcatccgggattacaatctccatcagccaatgcagaaggtaagcaagacgggaatgtag

SEQ ID NO: 26640 - DNA, 433 bp, Glycine max
  Peptide Sequence Number=SeqID_118325
atgggtgaagtagaggaggtacaagagaagatgaaggccgacatggaggccatgaaagagaaaatggccacgatgatggccatgatgagcatgaggaagataatggaagccaatgcggttacaattgccgctaccagcactgttgctaaggtgaacccgatgcccccatctggcctcaaccaaatgaatcatccaaccttagatatggcacatgaaattccccgccacaatctagccgacttcgagccttgcctaggatgtgccactgaagggaaagcagttggtggtatacccctacaaaaccctttggagggccctcagtatcacccacaactacacctcttgcattccacgacaagtaaaaaccctcatgctatggcagaaatgggaaagttggatcatctagaggaaaggctcagggccattgaaggag

SEQ ID NO: 26641 - DNA, 333 bp, Glycine max
  Peptide Sequence Number=SeqID_118326
atgatgacattcaataatgagttcaagattgagtcaagaacacttcaaggatcaagaggaaatttgatttcaagaatcaagattcaagattcaagaataatcaagatcaagattcaagaatcaagagaagacttaatcaatataagtattaaaaagtttttcaaaacattgagtagcacaagaagttttcacaaaatcattaccaaagagttttactctctgactgagaacaagagaggttacatctcttgtggatcagttctagtggagggtacatccactaggttgttcaaagagaacaagggagggtacatcccttgtggatctttgctt

SEQ ID NO: 26642 - DNA, 285 bp, Glycine max
  Peptide Sequence Number=SeqID_118327
atggcggaagcctctggtaatcgattaccagcctctgtaatcgattacacagaggaatgggtcactgatgaacctgcacggacgcttcagcgcactgtggagtggatactacccacgcctacaccatatcgtctagtggagcccgtcccaagtgatcgagagggtgatgaggatccacttcttgaggtggattctcccgaggaagtcatgtcggcatctgaggcagattctatggaggatagtggcccaggggagatggcgatcagcggaggctcttcatcctag

SEQ ID NO: 26643 - DNA, 267 bp, Glycine max
  Peptide Sequence Number=SeqID_118328
atgggccagttttgtcaaacccgtagagacccctcgtgggaggattctttggaagagcaggcgtcacagggttcgtttgtcccccatggacgtcaagatctcctgactgctgccattgggcgaccagaacaccttggccgtgtgcgtgctactggagccggtgtcaccatcaagcaatacttcggatcggctccacaaagctcctgcagttcctcctccatgcctcccgaaaaactcaagcagctgactcaacaaatcagggactag

SEQ ID NO: 26644 - DNA, 537 bp, Glycine max
  Peptide Sequence Number=SeqID_118329
atgacaagcagagaccaaatttggtcattctgcacccttgtatcatccagaggcggcgggcccgatgatacgcggaaatacccgagtggttatccgtataaacattcttttgctatctcatgcctttggcattttagtggagaaaacaacgagactttttcaagtctcacaagttatccagaactacgtaggtctgagttcctcattggaggatacgtaggagcaagagcctcgcttttgtcgaccgcaccgctttctgttgccatgactcaagagctggtagcccgcggagacaccttacgattatccgcacctcgtcattcagtcaccccaagtgtgattgacgagcagaagccaatatggtcatctgcgccctttccggagatgtcagcattttccgatggagacttttcaagtctcaccaattatccagaactacgtaggtctgagttcctcattggaggatacgtagagcaagagccttgcttttgtcggccgccccataatctttgtcatactgaccctgaggtcatgtga

SEQ ID NO: 26645 - DNA, 234 bp, Glycine max
  Peptide Sequence Number=SeqID_118330
atgtctgagtactgcaactctttttttcttatttcatttatctattattccatcctccataacgtcccaccattctccccatgcttaccaactactcccacgactgccaggctgcaccaccctccagagcttagacagccatgcactactactacgactcatgagggcagcactctagcactgaaggactactggaggagggaacacgtggggaggaaagtgcttgctagatag

SEQ ID NO: 26646 - DNA, 204 bp, Glycine max
  Peptide Sequence Number=SeqID_118331
atgaatagaaaagagatagtgatagagacatgccacttcccactagctagtactccacttaactgtgacactttatatgaaaatgggcattcaactcaagctagacaaggatatgatgaagaagacatgtacctccctgatattagagatgtaggtctatcccccggggggggggggggggaaattgatagagaccgattgtaa

SEQ ID NO: 26647 - DNA, 222 bp, Glycine max
  Peptide Sequence Number=SeqID_118332
atggtggctcctcaaaatcacagtgaagcattgaagcctcaggatccaagctgtcgatcaaacgatgcctgggaacatctgccaaatactggacacagaaggaaaccatctattttcaggaagaagatagatctcctccagcatcaagaacttgcagcccagaatcgtacacggctatataatcatggaggctgcacgagttctgtaccaagtccgggatga

SEQ ID NO: 26648 - DNA, 153 bp, Glycine max
  Peptide Sequence Number=SeqID_118333
atggaggttgatgaaccttggctagggttatggctaccattgaattatcaagtagatatgggatcaagtttagcatcccccaacggaatttgggactttgtggttgatttagggatggcctttgtggataactgggtggtgggtaaggaggag

SEQ ID NO: 26649 - DNA, 393 bp, Glycine max
  Peptide Sequence Number=SeqID_118334
atgatgacaaagttgatgacaaaaagctcaaaggtcaataaaaggatgagttcaagatgttcaagaaggaatcaagaagaattcaagactcaagaggaaaagttgaagaacacttcaagattcaagaagaaggatgaattcaatgggttacaggttgtaccatctgcggtgaggctcatgaaacaggccaatgtactcccactgaagaaaacactcaagaaattcattatatgggaaatcaacagcgacaagggtatacttgatatgaatggcagtggaatggagaaggaagagagagaggagacgccacttcaaggagaagatgagtctagaagaagctcaccatcacaggaggccatggataagagcttggaggaagaaggagatgaatga

SEQ ID NO: 26650 - DNA, 222 bp, Glycine max
  Peptide Sequence Number=SeqID_118335
atgtctatgtctccttcacaatccccatggccttttatgcttttgagaagacagttcccaataatgctttcttatgcaatgacaattaacaagtcccaaggtcaatcactatcctcagtgaggctttatttacctaaacctgtcttttcacatggacaattatatgtggcattgtcaagggaaaaaaagagctcaagccagaagttcaagatgtcgacataa

SEQ ID NO: 26651 - DNA, 557 bp, Glycine max
  Peptide Sequence Number=SeqID_118336
ccttaacttttggagcaatcatatttggaactaacaatgttcaagctcaaaatacaactgcaactacaaccgtaaacattaccctgaacgacgtaatatctattgacgcaggaagtacagccattggtaacacggttgattttaactatgttactgcagcagactataattctgatcagacgattactaaagccaactctttaaaagtaacttcaacgaagaactttaatgttaaagtaaaagcagggggtgctaatttcatgaatggaacgaacttaatccctgtcaatgttttgaccatcaaagcagctacagctgccggaaccatggggggaacaaaaaatgctgtagttttatctgcaacggatcagaatttagttacaaatgccccactaggaagcgcattaacactgaatttggattacactattccagctgcaaaatcatcatcttctgatattttaggcttcctcaggaggcctttgattttatatgtattgtaccggtataaatacaattcaaaatccgggaataagtatctgtcatatgtaaggtag

SEQ ID NO: 26652 - DNA, 49 bp, Glycine max
  Peptide Sequence Number=SeqID_118337
gaggaagaaattaccaaacgttagcattcctcacgcttggcgccaatga

SEQ ID NO: 26653 - DNA, 1071 bp, Glycine max
  Peptide Sequence Number=SeqID_118338
atggaaaagaggtacaacaagaggacaaggtggggaggtgctttgcatgctgtaattggaaaaagaaaggaatgtggttacacagaagttatcatttatctaagactgagtcagtatctgacagaggggatgcatgaggtgacttggagctcggttggcctactttcgatgggcgaggacaccatggccaacaacaacgaagaggaagaggaagcagtgacgccaatggtgaagttgggttcttacggtgctgaggttcggttggtggttggtggggaggaatccgccgctgaagagaccatgctgctttggggtattcagcagcccacactttccaaacccaatgccttcgtctctcaagcttccttgcaactctccctcgactcttgtggccactctctctccattcttcaatccccttcctcattgggaacgcctggagtaactggagcagtgatgtgggacagtggagttgtactgggaaagtttctagagcatgctgttgactcagggatgcttgtccttcagggaaagaagattgttgaattgggttctggttgtggattggttggttgcattgcagcccttttgggtagtgaggtcattgtcactgatctgcgagataggctgaggctactgagaaaaaacattgagaccaacatgaaacgtgtttctctacggggttctgtaacagcaactgagctcatatggggagaagatcctgacccagaactcattgaccccacacctgattttggttataattctctccctcaactccttcaaggggcagttgtggatcttctagagacacttatgcagctctctggatctgatacaacaatatttttggccggagaactccgaaatgatgccattcttgagtacttcttagaagctgcaatggataatttcactattgggcgcgtggaacaaacgctctggcaccctgattattgcagcaatcttccaaacaaaagtttgccatattgtgacattttaatgggacggaatgctgatttagctgggaattggaactctgtacaccaagacttagctaagctgtgctaa

SEQ ID NO: 26654 - DNA, 345 bp, Glycine max
  Peptide Sequence Number=SeqID_118339
atgaattccgaccgttcggtcgtgcccccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcggggtgtggtggttacgcgcagcgtgaccgctacacttgccagcgctga

SEQ ID NO: 26655 - DNA, 651 bp, Glycine max
  Peptide Sequence Number=SeqID_118340
atggcagaaccatcaaagcagcgcaaaggttcttcgagtagaagtcaacgacattccgaggttcaggatactccaattccttcctccatttcctcctcctcattgttctcattagaagaacaacgtatacgatacacaaaccttttctcctcttgttctatcatagaccctaagttcatagatatggatttcttttcagatgagagtttcaaatgcattcaagcatttcagaactcaaatctcattccctttatgcctctaaaattacctgtgtattctgaattggtaaaagctttttattctaatcttgaaattcaagaaagtaccttgatttcagaagtttatgggataaagatggtcattgaccaatccctcttctatgatttgacccaattgtctaatgacggtgtaccatttgaaggtgcactggacgatgattggaagtttgatttttctgtgcatgatgcccgccggttggtctgcaccaaccaagtggatatgatcggaaggcttcttgccggttcattggctcttgaaacccgcatccttcattatcttattgtttgtgaaattctgataccaatgccagatgtcgtaccggatgtcacgacatcatgcttcagaacatgcagattatatttgagagtatga

SEQ ID NO: 26656 - DNA, 372 bp, Glycine max
  Peptide Sequence Number=SeqID_118341
atgtcccccattttcaaagggcgacatgccctcacctttagaggactgcacgtcctcgccattataggactacactccctcgtcttcaaaaggcggcacgtcctgaacttcagagggctgcacgccctcgcctttagagggctacgcgtcctcatattcagggccagtagtttccttttatcagttcctggggcaccccctgatattggagggcgaccaactgtgcgagcacatccagaaagggaggctaccacgcatctagtatgcatactgaggcaagatttcacccgtgccgctgcaaaaagacgagtgcggatcttgctgcgcaaacatgagcacattttcatggatatggatgacgttactatttag

SEQ ID NO: 26657 - DNA, 586 bp, Glycine max
  Peptide Sequence Number=SeqID_118342
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctttcgctccaagctggactgtatgcacgaaccccccgttcagtccgaccgctgcgccttatccggtaactatcgtcttgagtccaacccggaaagacatgcaaaagcaccactggcagcagccactggacaagttttggtgactgcgctcctccaagccagttacctcggtcaaagagttggtagctcagagaacctttcgaaaaccgcccttgcaaggcg

SEQ ID NO: 26658 - DNA, 156 bp, Glycine max
  Peptide Sequence Number=SeqID_118343
gcatgtggctgctctggaattctgtgccctgaccgttctgtagaagctgtcataaaaggtgttgcaaaagatgcacctgctgcgcttagcgcactgatctcacgcttagctcacggctttgatgctgatgctctgccagattctcctttgcgctaa

SEQ ID NO: 26659 - DNA, 405 bp, Glycine max
  Peptide Sequence Number=SeqID_118344
atgacgttgttacttagcaacattctacccaacgaccgtaatgccgatctccccctgcagaagtatcagttgggatcgcgcccacaagacacccagtggacccggagacgtccaataggaccatggggtttccagctctggttacgggcctctatcagtcctacagggtgcccgtaccccctcggcaaggtcatgccatcccgacatagggatcgcgcccgcaggacacccagtgacccaaagaagtccaacagggtcctgggttttccagctctgattacgggcctctgtcagttctacggagtacccgtcaccccaacaaggtcattaggccccgcattaaaccgggctttcatcaagaagtactgcgcccccagacgggcacagggcgagacaccacagtag

SEQ ID NO: 26660 - DNA, 780 bp, Glycine max
  Peptide Sequence Number=SeqID_118345
ttggaacctccttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatccctcgctcctacatatcctcaattgtgatgaggaatcagacctaccttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggcggagatttcctggaagatgccaggaagatacttaa

SEQ ID NO: 26661 - DNA, 165 bp, Glycine max
  Peptide Sequence Number=SeqID_118346
atggtgacaccgccaaggtcccctccgcagtcagatgggaaaactgccaggaaaccacattacaagcgaaatctcaaagagagttgggcttcgtcctcaaaaggaaacaacaccagaaaatctagccttccatggattcaaacagaaaacgcaaatgaaacatga

SEQ ID NO: 26662 - DNA, 129 bp, Glycine max
  Peptide Sequence Number=SeqID_118347
gaatcctttgaaggattacactcagagctccaacctcgaatgttcggtggagcaactctagagactgcgcaaagagttaaacaaactttcaacgttacaaagacttcggagacattgatagctatttag

SEQ ID NO: 26663 - DNA, 1080 bp, Glycine max
  Peptide Sequence Number=SeqID_118348
atggtcgttctctgggagcgacgcgtccagctcagggacgacgagtatactgatttccaggaggaaatagggcgccggcggtgggcatcactggttactcccatggccaagtttgatccagaaatagtccttgagttttatgccaatgcttggccaacagaggagggcgtgcgtgacatgagatcctgggtaaggggtcagtggatcccgtttgatgccgacgctatcggccaactcctaggatatccgttggtgttggaagagggccaggaatgtgagtatggccagaggaggaaccggtctgatgggttcgatgaggaggccatcgcccagctgctatgtataccggggcaggattttgcccggactgctgcagggaggcgagtgcgaatcatgcgcaccaacatgaccaccctgacccagatatggatgacgttgctcctcagcaacgtcctgcccaccgatcataattccgaccttcccatgccgaagtgtcagctggtgtacgccatcctgacacggatgagcatccatgtggctcagttgatcgctgatgccatctatatttttgcaggtatggcgcccactaagcaccctttggacccagataagtccaatagggccctgggattccccgcactgatcacaggactctgccagtcgttcggagtccccgttgcacctaccaaggtgattcggccgcccatcacccgggcttttattgagaagtactgccgcaggcgcaccccaccacctcatcaggctggccaggctggggcatttggcatagagcagtatttacggcatttggttcgccagcaggcggccaaccaccgagcccatgtacggacccatgattgtctgtaccagatgagccttagcatgcagagccagggcttcgctcctttttcatgccctactccagaccagttcagggcagaggttgcatggcccggagattggcccgaggcccaagcaggagaggcacccccagaagctcccggcgatggagaagaagcccacgaggatgaggagatggctgatttgcttgacttcttgggagggagtggagacacgtga

SEQ ID NO: 26664 - DNA, 591 bp, Glycine max
  Peptide Sequence Number=SeqID_118349
atgccttactatggagtcattaaagagatttgggaggttgattacggtgaatttagagtacctcttttcaaatgtaaatgggtcaatggaaacacagaagatccatgcgactctagatgggcagtggttttgcaagggagaacaatttgtatcggtcaccatgttgatggatcaacacttgatgtcactgacatgccatctttctccaaagatatgccttcaagtactattgaacaagaagaggatgatgtatatgcaaatcgtactgatcatgacgagggtttatgggagaacattcctacggccatggcaacaccaccaccgtccccgccaaaatcagaaaaccctcctgaggttactttgaaaaggacaagacaatccacgaggctcagaagtttgacgtctagatgcttagatggcccacggccagttgtgaacgtgaatccggctacatgtagagggtcagggcctcataaagagaaatttcacagttatttaggggttgtcgcaagggaaaaagttcctattgtacacgcgaattggaatgttgtccccgacgatctaaagagcttaatatggaaagatattttg

SEQ ID NO: 26665 - DNA, 114 bp, Glycine max
  Peptide Sequence Number=SeqID_118350
atgttggctactggtggtggagaagaaggtgttagggtttgggtgggtgttgggagaggaggagagggggaaaatcgtgtttttcacgctgaagaacgtatttataatatgtaa

SEQ ID NO: 26666 - DNA, 219 bp, Glycine max
  Peptide Sequence Number=SeqID_118351
gggcaggatcgccttgggctaccttttggagtgaagacaaaacatgaacggcagaaaccagtcaaggtgcttaaggatgaacgcaaccggggatggggtcacgaccgaccgatcgttacccttctctgtgcgaaacaagcagggaatgtcgctgcaaggcagccccgtatcctttgtattttgcagctttcttttactatttgtttgggaaaagagtaa

SEQ ID NO: 26667 - DNA, 198 bp, Glycine max
  Peptide Sequence Number=SeqID_118352
atgtgtcctccacttatcaagcgcgaagcctctggtgactgggaaacacgttcttctgttgttttccggatcggttccttcgccaaatatgtgtatatggaagaaaaaagaaggagtagagacgagagtcgtcatcacggaaagggcaagacggacgaaatcagtgtcctatctttgctttcctcttatctccgatga

SEQ ID NO: 26668 - DNA, 300 bp, Glycine max
  Peptide Sequence Number=SeqID_118353
atggtagccacagtttaccaaacctcccatgaatgttcggaagaaaccattatagacattttagtgacaggattttccggacaactaaaaggttggtgggataattatcttactaacgaagaaaagtctacagaattattatcaaatcttaagtgtaaaaccttagcagattttacatggtacaaggatactttcttgactaaggtctataccagaaaagatagtcaacaacctttctggaaagaaaaatttctagccagtcttccaagatctttaggaaggggggttgaattaagataa

SEQ ID NO: 26669 - DNA, 231 bp, Glycine max
  Peptide Sequence Number=SeqID_118354
tatggtaaagagaaatcaaggagtatgtacaatttaagcgtccaaatattgggactcttaataacatgcgatgatgaagagggatcaggtctgaaagcaagcaggggctgctctcgttcttcgacttgccaagactgctcaacttgttattgtgaagggtgcatcaagtgccactttgaggattgcaattgccaagaatgcagagactttatgctatatgctaaaccttaa

SEQ ID NO: 26670 - DNA, 269 bp, Glycine max
  Peptide Sequence Number=SeqID_118355
gcccacttgggccctccggaatattcctccagaaggcggttgcttctggaggaagcaaccctgctcgcctgggcgagctgagctcgcctgggcgagctgggcggcaaccacctcccctattttgctataataggggaggaaggcaagaaggaagggccgaggcgcttccgaaacgtttccgtaacgttttccgtgaggaatttcgcaaagatttcaaccgttcttcgacgttcttcattcgttcttcatcgttcttcgatcttcaacgg

SEQ ID NO: 26671 - DNA, 351 bp, Glycine max
  Peptide Sequence Number=SeqID_118356
atgccccactcgcatacgttgttggttgtgttcccactctcggtggccactatttgcggtgatgaggagtttacaaaaattgttggtattgccaacaagtccccaagtgacctgcggtccttgagatttcttttccaaccttataaaaatccttttacaagcaaagatccacaagggatgtaccctcccttattctctttgaacctagtggatgtaccctccactagaactgatccacaagatatgtaccctctcttgttctcagtcaacaacccaagtagatgtaccctctacttgtaccacaaaggatgtaccctccaatgtgttaagacaaagatctcaggtggttaa

SEQ ID NO: 26672 - DNA, 146 bp, Glycine max
  Peptide Sequence Number=SeqID_118357
gtgggggtggcgacgagtatcatcagttggagggagttcaacgtctgttactggatgcgatgaatgcacaaatgcaacgtttgctggaccgtaccaatgaggaggtctatggacgactagaagctttggagaaccaagccaattag

SEQ ID NO: 26673 - DNA, 180 bp, Glycine max
  Peptide Sequence Number=SeqID_118358
gatagaaggcctcaagaggttaacattagcctcccacatttccacggaaaagataatgttgaggcctacttagattgggaaatgaaggttgaacaactctttgcttgccatctgtcataccctaatttcgtccggggacctttgctcgatgacgtgcgaccattctttggtcctcgtgag

SEQ ID NO: 26674 - DNA, 522 bp, Glycine max
  Peptide Sequence Number=SeqID_118359
atggaaatggtgggttacacaccttccagctttgtggatatggtcttcgccggcaaaaggatcgaagtgggtctgaaaggaggcaaatttggtcatctggctttgatgaaaactggggcaagtgaagaggatgagaatgagggagaaacccatgttgtgactgccattcctatacagccaagtttcccaccaacccaacaatgtcattactcagccaataacaaactttctccttacccaccacccagttatccacaaaggtcatccctaaatcaaccacaaagcctgtctaccgcacttccaatgacgaacaccacctttagcgcaaaccaaaacaccaaccaggaaatgagttttgcagtttcctcaacctccatttttccgaggatacgacttgaaccaacatgtgcacatcatggaggagccctggggcattccattaagcactatatgaccctgaagcataaggtgcaaagtctaattgatgcgggccggctgaaatttgaggagaatcgcgtgtaa

SEQ ID NO: 26675 - DNA, 177 bp, Glycine max
  Peptide Sequence Number=SeqID_118360
atgataaacattgcacagattaaatggcctaactctctaaaaacagtccccagtggagtcgccaactgtcgcaactacccttcggcgggagggcgacacgtgactcgcggtcaacgagggtgtttcccttgcacctacgtattccttaattgtgaaaaggaaatcagacctacgtag

SEQ ID NO: 26676 - DNA, 339 bp, Glycine max
  Peptide Sequence Number=SeqID_118361
atgcctaaaatttctatgtttaagcataaggacacacaggctaaagctgagtatgtgaagaagctgcatgagcaagtgaaggctcaaattgaaaagaataatgcgagctatgcaaggcaagccaacaaaagcagaaagaaagtcgtgcttgaaccagatggaggaaccttggatttgaggacaaatccttttcaagaaagagggagtgatgaggacacaactaaggacaagggccatgaagcacttgaagggcccatgaccagaggcagacttaaacagacccaacacgtcatagagacaaggctggtcatttgtatagctgccattgatgatgattga

SEQ ID NO: 26677 - DNA, 328 bp, Glycine max
  Peptide Sequence Number=SeqID_118362
gcttcctggtatcaacagggacaccaggatttatttattctgcgaagtgatcttccgtcacaggtattattcggcgcaaagtgcgtcgggtgctccagtggcttctgtttctatcagctgtccctcctgttcagctactgacggggtggtgcgtaacggccaaaagcaccgccggacatcagcgctggcaagtgtagcggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 26678 - DNA, 231 bp, Glycine max
  Peptide Sequence Number=SeqID_118363
atggagaatcatgaccaccaaagtcaggagataatggacaacagattggcacaacaaaatgagcaaattctcaacaaaatgagcaaatggcagcgtatactgacacctttacatattgtctatcatagcaggactcctatgtctatcacctaccatagcataggagaacagaacaaggccatgtcagaaatgaaatgctcaaaggttgatcgtccttggaatgggaaatga

SEQ ID NO: 26679 - DNA, 333 bp, Glycine max
  Peptide Sequence Number=SeqID_118364
atggaaagggtggggggtgatgtggtgcaatgggtggaaactactttctctgagggaagggaatcagaggtgcttgatcctgagattgcaggctctaggaattggcttggtgagatggagcaactcctccacattggtgctgcttgcactaaaagcaaccctcagcagcggttagacatggcaaaaactgttataaggataatggagattaaattcgagtgtggtcatgaatcaacaagccttgcaaattctcatcatgctgaacaatcacagaggaggcatggaacaaacagcttcggaagctgggataatatcgaatatggcagctcctag

SEQ ID NO: 26680 - DNA, 51 bp, Glycine max
  Peptide Sequence Number=SeqID_118365
atggccgaccagcaggctaccaagtccaaagccaaagtaggacgcacctag

SEQ ID NO: 26681 - DNA, 258 bp, Glycine max
  Peptide Sequence Number=SeqID_118366
gatcttgtcaaggggaggacgattggaattactaaagagttgggcgagttatactacttacagcatgaggacaataaagagtgtaccaaacagaaggttctcacttctaatcatcagacaagttcagaaccttggtcatcctcccaaatatggcttcagcataggcgtctagatgtgtgggaacctgcacctatcagtaatacttctggtgcaaagtggtttgtttcttttaatgatgactgcactcgggttacctga

SEQ ID NO: 26682 - DNA, 502 bp, Glycine max
  Peptide Sequence Number=SeqID_118367
ggtgctcagtggcttctgtttctatcagctgtccctctgttcagctactgacggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttgtacttggcaccctttgttgcacaatacgtgaagttccgtaacatgccatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaggctgcaccg

SEQ ID NO: 26683 - DNA, 219 bp, Glycine max
  Peptide Sequence Number=SeqID_118368
caaaagaatgtttatacggataaccactcgggtatttccgcccgtcagcgtgactcaaaagtcagtatgacagatcttgtgagtgcggaaggtgatgtaaatcttcgcgtgtcaacgggcttgtcggccgcgattgacgaagggtgcagaatgaccaaattttgtctctgcgtgccatcggacacgactgtgtctgaatggcaaaggggtgcggaatga

SEQ ID NO: 26684 - DNA, 258 bp, Glycine max
  Peptide Sequence Number=SeqID_118369
atggcagcgcagttgatccatgatcgcgtcgtgatggagtgcctagaggaggtgtcatcctttgaagaggatcttgaagaggacccagaagagttatctcctgaacctgctatggatgcccctgacttaccagaggatgatgaggacccgctccctgatgttgattctccagaggatattatgccagcatctgaggcagactctacagaggagagtggccctagagggacagcgaatagtgacgactcttcatcatag

SEQ ID NO: 26685 - DNA, 453 bp, Glycine max
  Peptide Sequence Number=SeqID_118370
atggcttctaggaaacgtaaaagtattggttcaagacccacagaacagtatgacacaaggagattctcttccttaaatgcttggaccagatacacagataatgttctagagagaaacattttaccagagaggaaagtagagatatatcattctgagctagatgattttaaagctgaattggagaggcgtaatttccataaacgcctcaccaatttagtcgatgggagcatagacctagctttgattgatgctggcagtctcaatacattcttagagacacctgtggtattaggtgaaggggagaccttacctacttactccagatactgcaggttgcctacagactacagagagatagaggctgccttatgcatacctagtcgagggttcatcttgaacttagagggccatcctaggaagattctcaggaacgatctgactacactagctcag

SEQ ID NO: 26686 - DNA, 312 bp, Glycine max
  Peptide Sequence Number=SeqID_118371
atggctgattgttttcgtaatgatgttgctggcagctgtattcagattcacaaaaaagatgagtggatttggaaaatagaccctactggacaatattcggagaatgaagcacatgtatttttgacatgtgatagaatacttccattatggtgggaatctatgacatgggtcaacattcatggagcttttctgcagaaaccgtggcagcacttttcccagcacgcgttctgtttgcctagtagaattcgtcttaaccgatggagaagttggtggctggccctcacatgggacagtgtggcagcaccggaataa

SEQ ID NO: 26687 - DNA, 330 bp, Glycine max
  Peptide Sequence Number=SeqID_118372
atggaagccaatgcggttgcaattgccgctaccagcgttgttgctaaggtgaacccgacgtccccatccggcatcaaccaaatgaatcatccaacctcagatatggagacacatgaaattccccaccacgatctagccaacttcgagccttgcctcggatatgctgctgaagggcaagcagttggtggtatacccctgcaaaacactttggagggccctcagtatcacccacaactgcacctcttgcattccacagcgattaaaaaccctcatgactatggcaggaatgggaaagttggatcatctagaggaaaggctcagggccattga

SEQ ID NO: 26688 - DNA, 966 bp, Glycine max
  Peptide Sequence Number=SeqID_118373
atgcatagtctcagtgaagttcttgttgctggtgagttctactactttcgtttcaatagtaatgatggtatgcataaagttattgaggaaggaccttggatgttccaaggaagacctattatcctacaaggctttagttacgtggctagtgcggttggtaaacctatgtatgcggactctatgactcttaagagcaaacgattgacttatgctcgtatttgtgtggaggttgatgctactagacctcttcctgattcctttgacctttgtgtggatgatgattttgaggataatgcggagaagctcctggaaattcatgttgaatatcaatggaaaccaaagatgtgtagtgactgccaagtttttgggcaccaggtgaactcatgccctaaaaaggttaatatgcctactactaaacctcaacctacaaaagctatatggaaggcaacaggggttattctaccaaaggatccaagtattatggctactgaaggagttactggggctgctacggaacagcaacaaacaaacatccctcatctgcatgaagccgagactagtatccagaaagcacacatgcgcacggccaataaggaagatgcatgtattgagagtacagttaatcatgttgaagctattgaagctttggttgctcacggtccagacctgaatttgggagaattagatgtgcttagtcctagtgcaaggaggggctcgggcatggttcctactattaccaacttctctacatctgtggctactatttatccaaacaggtttgatgttctgcaaggagaagaaggtgctgaaattaatcctgatttagggctcactgatttacttgctaccattaatggaggagccaaacagaagaagaaaggcaaaaataaggtaaatcctcaaggaggaatgactctgcgaagccaaggtaagcccaatgattcaagctgcttcttggaatattag

SEQ ID NO: 26689 - DNA, 513 bp, Glycine max
  Peptide Sequence Number=SeqID_118374
atgaccatgattacgccaagctcgaaattaaccctcactaaagggaacaaaagctggcctataccatcaatagtgccaaggtggtgttcatcaagaagagacctcaaaaccggcaattcaaaggatcaggaaactacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 26690 - DNA, 401 bp, Glycine max
  Peptide Sequence Number=SeqID_118375
atggactccacggctaaatcaaatgaagaaaccgacaagaggaaacgaagcatagcactaaaagcctcctcatcaatgcaagaggaaaatgaagatgaagaattggaagatgaagaagacttctcactttttgtgaagaagtttcacaaatttgtcaagaatagaataagcgagaggcgtcaaaatttcaaccatggaaaaagatcccatgaaggctctctaactcttagatgctacaatcatgaagaaagaaagaccaagaaggcttacatcgtttgggatgacaacgattcattcgaagaatctgaaaaggaggatgatcgaggccgtacccgaatcaaaaaaacattaaaaatgcagtatctaggaagtgatcctaggtcatctcccaacgagcaatg

SEQ ID NO: 26691 - DNA, 355 bp, Glycine max
  Peptide Sequence Number=SeqID_118376
gctccgccccctgacaagcatcacgaaatctgacgctcaaatcagtggtggcgaaacccgacaggactataaagataccaggcgtttccccctggcggctccctcgtgcgctctcctgttcctgcctttcggtttaccgttcgctccaagctggactgtatgcacgaaccccccgttcagtccgaccgctgcgccttatccggagttagtcttgaagtcatgcgccgggttaaaggctaaactgaaaggacaagttttgggtgactgcgctcctccaagccagttaccttcggaaggcaagaagattatcgcgcagaacccaaaaacggaatctcaaggaaagatcaatccttaa

SEQ ID NO: 26692 - DNA, 495 bp, Glycine max
  Peptide Sequence Number=SeqID_118377
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaaccccgtcagtagctgaacaggagggacagctgatagaaacagaagccactggagcacctcaaaaacaccattatacactaaatcagtaa

SEQ ID NO: 26693 - DNA, 246 bp, Glycine max
  Peptide Sequence Number=SeqID_118378
atgggtggcatgatgaatgttttgagtggtgcaaccctcttttgtaaaatctctcgacacctgacatcttcatgtgatcaaggggttcccatgaaccctaagagaataaaggtcattcctgagtggcccactccaccaagtgttgagggaaggagcccagagtatgaagaacctcgggatttgaggtcaaatcctttccaaggtggagggaatgatgcaatcctaccccacaagggcattggatag

SEQ ID NO: 26694 - DNA, 303 bp, Glycine max
  Peptide Sequence Number=SeqID_118379
atgtttttcagcatgaaaaacacgattttcactctctcctcctctccaaacgccacccaaaccctaacacctccttctccaccactcatgaccactagtggttgccatgagccgtcgttgcttgccgtcgaacccccacaccaagaggaacattttaatcaaagtggaatccttagaatcctcctcaaggattcggtggagaaaattcccccaatcctccatttcaaagcttctatgagaaccttgttttggactgacgaacgtgaacgagagaggtctttgagcgacacaaagagaaactga

SEQ ID NO: 26695 - DNA, 477 bp, Glycine max
  Peptide Sequence Number=SeqID_118380
atggcaagagctggtgacaatggtggtgtatatcatcaattggacgaatctcagcgcttatttctggacgcgtggactacacaaatgcaacgtttgttgaaccgtaacaaagaagagccctacagacgaatagccaaatcttcctcgtttactcttaaacctctatcccctagaaaagagattcctcatggactgccaccttcaagaagcatagaacatcaagttgatctccttctagaagcttcattgcctaacaagccaacttacaactgcaagccccaagagactcaacataaggatgcacaggtcaaagttgagtatgagaaaagattgtatgaccaagtgaagggaatgatgagaatcatgaaactagccaaatacaagctaaaggcccaagtggataaggacgaaggcctaagtggagaaggacaaagcccccgagtggagaaggatgaaggcccaagtggagaaggatga

SEQ ID NO: 26696 - DNA, 243 bp, Glycine max
  Peptide Sequence Number=SeqID_118381
atgcttaatcctcaagagaaaacaacactagagcttctgatgagaatcatgaaactggccaaatacaggcaaaaggcccaagtggagaaggacgaaggcctaagtggagaaggacaaagcccccgagtggagaaggatgaaggcctcaagtggagaaggatgaaggctcaagtggagatggatgaaggcccagaggcagagacactatcaagacaattaattgttgctgaaggctcaaactaa

SEQ ID NO: 26697 - DNA, 591 bp, Glycine max
  Peptide Sequence Number=SeqID_118382
atgaagctggaagagactctagctcaatccatgcaagtgccaatgtctaaccaaaagagcaccgagtctgcaattaagaatctggaagttcaggtgggccagcttgcaaagcagttagctgaaagaccatccagcagctttatagcaaacatagagaaaaatcctaaggaagagtgcaaagttgtgatgactagaagcaaaatggtgattcaagctgaggaaaaaattgttgaggaagcagaaggttatgaagaagaagagacaccaataagaggttgtcaagagaaaataaagaagaaggaagaaaaagaagaagaaataaaggaagaagaagaaaaagaaaaaaagttgaaaaatgaaaaacaaaaagagaaggttgttgagattgagaagaagaagggcaagagtgaggccaacatagaaaagaagaaagaggctactcctattgaatgcaacgagcttctcgctaagccaatttgtcggcatagcgagccatcccctgagcgcaccactcttgcggttgagcgcgaggaagaatctggaagaaggatgagctggacacacgcgctaagcaagggttcatcccgctaa

SEQ ID NO: 26698 - DNA, 267 bp, Glycine max
  Peptide Sequence Number=SeqID_118383
atgatccagagggaatggaggaaggaattggcgtttcctgtgacccggaatgccattgactccgactcgaagtgccctttcgcttcttcgaaggtgaagggacgcgttgtaatcgattacacaaatatggtaatcgattaccagagagcaacattcccagaaataactacttgtaatcgattacactattatggtaatcgattaccagaggttattttagccagaaaacaaaaatcaaaaagctttctaggagaaaaggaattttga

SEQ ID NO: 26699 - DNA, 231 bp, Glycine max
  Peptide Sequence Number=SeqID_118384
gaaaatgggggaggagcttgccacccagctcgcccaggcgagctaggttgcttcctccagaagcaaccgctttctggaggaacatcctggaaggcccagggagaagggagacacaaaagaattcaggcggttagtccttcgttcttttggaaaagggagaagagagacacaaaaagaattcaggcggttagtccttggcgaattctttttggcaaagggagaagagaatga

SEQ ID NO: 26700 - DNA, 418 bp, Glycine max
  Peptide Sequence Number=SeqID_118385
atggaaaaatgggcccagtttttccagactcgcagagatccttcttgggaggcacaggtcattcagaaacaaaacactgccccccatgttttgtctcgtgggggttatgaatatttggagcagaagctccttgctaagaagaccaagaagaagctggaggaagctgcacaatcagaaagcattgatggtgtcatcgacctttcatgccccatcagacgccacgtgaagtggaagatggcccacaccaagaaaacagaggagatgacgactgaggccgcaaaggaaattgccgagaagattgattcctttgaggagcaggcgtcacagggatccttcatcccctatggacgtcaggatgttctcaccgctgctattggacgtccagagcaccctagacgtgtctgtgctgttggagctg

SEQ ID NO: 26701 - DNA, 294 bp, Glycine max
  Peptide Sequence Number=SeqID_118386
atgaaggaaaacaacaaaggatccccagtggagtcgccaactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaactttttagtgaaaggttcgggagttgtatttacgcgcggggaagtggtcgacaagggtgtttccctttgctcctacgtattcctcaattggatgagaaaatcagacctacgtag

SEQ ID NO: 26702 - DNA, 872 bp, Glycine max
  Peptide Sequence Number=SeqID_118387
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcagatcctctctacgactaatcccacccgcatctcttgcatggttgctaaggctatgagcagtatgaaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 26703 - DNA, 330 bp, Glycine max
  Peptide Sequence Number=SeqID_118388
atgaagctaatgtgttggctatcgcaacctacccttcggcgggagggcgacgcgaaggctcatgggtgcgtcttccaagggaggaagacacgcggagtcaccaccaacatttattcgaggaaaacatcgaaaaaaccaagatgcggtctacgaactttaagtgtgaaaggtttgggagttgtatttatgcatggcgaagggatggtcgacaaaagcggggcttttgctcctacgtatcctcgatttgtggtgaggaactcagacctacgtagttcctacaaagcggtaaagttatgtgttgattttatgcttttgaacactccatgttaa

SEQ ID NO: 26704 - DNA, 93 bp, Glycine max
  Peptide Sequence Number=SeqID_118389
gtgtttctgggatacaagagtttcatggagtctatagctaataggcgaaagtgcaaggaagaagtgttctatgtgaccttcatgccaccttga

SEQ ID NO: 26705 - DNA, 201 bp, Glycine max
  Peptide Sequence Number=SeqID_118390
atgaattgcttttttgggtgccttcagatggtccgtggcggcgatggccagcagcaacgctgctggaggatgatccctttcgcttctttgatgattatgccatttgatgaagttttagtgaatgtcaattggagcattaagccttctggtaatcgattacaggctgttgtaattgattacaggctatctgttcttgtgtaa

SEQ ID NO: 26706 - DNA, 475 bp, Glycine max
  Peptide Sequence Number=SeqID_118391
atggctccgagaaagctttttgcaaaaagatctaggaaggacgccgcggctgaagggacttgtgccgctcccgagttcgacaaccatcgttttaggagcgctgagcaccaacagcgtttcgaggccatcaagggatggtcattccaccgagagagacgcgtccagctcagggacgatgagtacacagatttccaggaagagatagctcgccggcattggacgtcgctggtcattcccatggccaagtttgacccagatgtagtcctagagttttatgccaatgcttggcccacggaggagggcatgcggtcgtgggtaaggggccagtggattccttttgatgcagacgccctcagccagttcctaggagacccgctagtgttggaggagtgccaggagtgcgagtatagtcagaggaggaatcgggccgatggatttgatgaggaggccattgcccagctgttatgcataccgg

SEQ ID NO: 26707 - DNA, 198 bp, Glycine max
  Peptide Sequence Number=SeqID_118392
atctacagagatgcgagttcgaagtggaagccgttcagagaactttagatgagtttgtgaatgatttgaggtttccggactatggaaagctaaatcctctattggatcttccctataggtacctgattaggaactggtctgattctgaagtccttggtagtacgagactaagttgttgtgttatcacgagggatcggg

SEQ ID NO: 26708 - DNA, 168 bp, Glycine max
  Peptide Sequence Number=SeqID_118393
atggactcgagaaggttccagattagtataccaagtgacggctgccccaaattacacagtaggaggcctggaagatggttgaagaattggagcagctcactaagcgtgtcaacaacggctcagcgcgatgagccaacttggaggtcaggcttagcgcgcatgtggtag

SEQ ID NO: 26709 - DNA, 333 bp, Glycine max
  Peptide Sequence Number=SeqID_118394
atggggtggggctcggactccgaaccgtacgtggggcgagtttctgcctcatacagctcgggccgaagaccgggggaagttttggagagatggggagacccagcagctgccgtatcggacaaggatcgaattagcaagcctagcagagtcccctctagcagtagcactatagtccgtccttatttattcgcaaggaagtatccgcaagtcaaaggaaagcgaaaggtttgctcgactgagagagcgagtgccattctcttggaagaccttcctcacaggactctcagcatgctaccagtccgatctagctgcccggtagaccaaatccagtag

SEQ ID NO: 26710 - DNA, 519 bp, Glycine max
  Peptide Sequence Number=SeqID_118395
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatcccggtaactatcgtcttgagtccaacccg

SEQ ID NO: 26711 - DNA, 512 bp, Glycine max
  Peptide Sequence Number=SeqID_118396
ttcccatcattctaggcagaccttttatgaaaattgctagaactaagatagatgtttatgcagacacactatctatggagtttggtgatataactattcattttaatattcttgatgctatgaaacacccatctgaagatctttctgtatttcgtgctgaaataattgaccatattgttgatgaatacatgactgatcttcattctaatttgcatgcttgtcactcttcatgcattgaatttgaatttgtcacaattcagggtgactgggtttggctccatcttaggaaggatagattccctactaaaaggaaatccaagcttagctctagaggggatggaccttttcaggaggaggaactaacagatttgaggtcaaatcctcttcaaggggaaggggatgatgcaatcctccctaggaagggaccaatcacaagaaccatgagcaagaggctccaagaagattgggctagagctgctgaagaaggccctagggttctcatgaaccttagg

SEQ ID NO: 26712 - DNA, 354 bp, Glycine max
  Peptide Sequence Number=SeqID_118397
atgacttgtcgatcatgggctagtacttttgcttacctttggctttggacttggtcgactgctggtcggccacaggtcataggcaaccctccagcctttgtagatgagctgaggggctttggaggtggcggcggtgcgtctattgcccgctaccagccatccccaggctgctatggtgtctcgccctatgcctgtctgggggcgcagtacttcttgatgaaagctcaagttggaaaccccatgaccctattggacttctccgggtccaatgggtgtcttgcgggcgcaatccctgcaaacagtagatggcatcagagaccagttgagccacgtgcttacttacctatgtcatga

SEQ ID NO: 26713 - DNA, 360 bp, Glycine max
  Peptide Sequence Number=SeqID_118398
atgtatgatacattgcaaagtgattcgaagaagcctttgtatctagggtgcaagaagtctttgacgttgttgtcagcagtgttaagtctggttaatgtcaaggatatgcttatagaggaaaacacgttgccaaaaagttactatcaggtgaagaaaatactatgtctaacgggtattgtcgcaacctaccctttagcgggagggcgaggcgagattcaagggtgcaccttcaaaaaacaaaaacacgcgggagttgccagcaaattttatttgaggaaaacgttagaaaaaaccaaaaaggggtatgcgaattttaagaataagggtttgggagttgtttacacgtggggaaggtattag

SEQ ID NO: 26714 - DNA, 159 bp, Glycine max
  Peptide Sequence Number=SeqID_118399
atgctccaaccatgtgggatcgacacagacttaaaggagcacttaaaccggatgacccccaagccctacactctgaagagtccgtcagggcctctcactcctaattcagacactgctaatgaattatgcaatactcacgacctcacactcgtgttttaa

SEQ ID NO: 26715 - DNA, 222 bp, Glycine max
  Peptide Sequence Number=SeqID_118400
atggctgatggaaaactgatagagatgaagggtagagttaacctagggttaaaaaccaaatctggatttagtggtaattggagtgtcgcaatgtgcccttcgcgggcgagtgaaggcgaggctcacgggtgcactttccaaaggaggaaagatgcgcggagtcgccaccaacgtttatttgtggaaaacgtcggaaaaaccgaaggaaactggtcaaaatga

SEQ ID NO: 26716 - DNA, 447 bp, Glycine max
  Peptide Sequence Number=SeqID_118401
atggtgattcaagcggaggaaaaaattattgaggaagcagaaggtgataaagaaggagagacaccaataaaagactgtcaagagaaaataaagaagaaggaagaacaagaaaaagaaaaagaagaagaaataaaagaaaaagaaaaaaaagaaaaaaagttgaaaagtgaaaaacaaaaagagaaggttgttgagactgagaagaagaaaagcaagagtgagactaacatagaaaagaagaaagaggctactcctattgaatgcaaggaggtaccttatccgttggtaccctcccggaaagataaagagcgacatttggctagatttcttgatatcttcaagaaactgggaaattactttgccatttggagaagcactttagcaaatgcccttctatgccaaatttttgaaggatatgttaaccaagaagaaccggtacatccatag

SEQ ID NO: 26717 - DNA, 228 bp, Glycine max
  misc_feature (47)..(47): n is a, c, g, or t
  Peptide Sequence Number=SeqID_118402
atgagaaagcgccacgcttcccgaagggagaaagcgggacagggggncggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtga

SEQ ID NO: 26718 - DNA, 927 bp, Glycine max
  Peptide Sequence Number=SeqID_118403
atgggattcccattaaggaggaaggggaaagggaaggggaaggggaagggaaattccatgagagttgaaccccttactataaacttccaactaagagagcaaatagtaatattgccgttaattttcatacattttctttcacattctctgttatataggaatgatgctgagctgcttgaagatatcattgatcatgtgttgaagaggttgaataagaaaccaattaataactcaaaaggacttcttggaattgacaaaccgattgcagatttagaatcattgttacgtcaagagtcaaaagatgtacgcgttattggaatttggggtatgcatggtatcggcaagacaactattgtagaagaattatttaacaaacaatgttttgagtatgaaagttgttgttttttggcaaaggtaaacgaagaattagaaaggcatggcgtaatttgtgtaaaagaaaaacttctttctacactattaacagaagatgtgaaaattaacacaacaaatgggttacccaatgatattttgagaaggattggtcgtatgaagatttttattgttcttgatgatgtaaatgattatgatcaagtagaaaaattagttggaactcttgattggcttggatcaggtagtagaataattataacagccagagacaggcaaattcttcacaacaaagttgatgatatatatgagattggtagtttgagtattgatgaagcaggtgaactcttttgtctgaatgcctttaaccaaagtcctcttggagaggagtactgggactacttgctcctctcatattggatggtcgattatgccaaaggtgttcccttagttcttaaagttttaggtcaacttcttcgtggaaaggataaggaagtatggaaaagtcagctggacaaacttcaaaaaatgccaaactaa

SEQ ID NO: 26719 - DNA, 1198 bp, Glycine max
  Peptide Sequence Number=SeqID_118404
gtgatatcgctgaaccgctaaataaacagtctattcccttaacgtttgatgatggtagtcctatttctaagtcagagatatatgctactattcgagcacattttgaagaaaatatccccggccctcttcaacctttaaaagaggagttgctagaggaggctctctctgaatgcattaagccatcttctggagaaatcgatatcagtaatttacctgttaaaagtcttagttctacttctcgaaagtaccctaagaatataaccgttccaaggaaatcgggcaatatatccctgaggccgttcttggtggccgatactgagaccataattaacaaaaatagtcaacatgtaccctatgcggtcggtgtcatggttgttaatccggggattcccgttagtaggcgtgaaaggatcgatacttacttcagcgaagattactcttcaagagtcttcccaacctttgaagaaaggagctgccaaatgctcaaatcatttatctttagggtcgcggctattactcgaccaaataggtctgctaaaacaatctactttcataatttagactccttacatctactccccggcaaactagatgaccttgctaagaatctatgccctgagttgggttctaaaggatctatttcctatgaggatgtaagacttgaaagtcttagtattatgaaagagagtttgttagagtatatggagcaggatattcttctgctagggggaattatgcagtccttccaggacatatattataaggcttaccaggcagacatagtaaataagcttacaatagcctcactggctctaagtctatttcgtgaaaaatattacgattacaataagcatcgtatccacatccctaatcagaatgaggatacatttattcggcatggatattacggtgggcataccgacgcatacttaccatacggtactaatttatactattatgacgttaactctctctatccttttgttatcaaggaattctcaatgcctgggggtacaccagtctggcattctgatttagaatatatgacattagataacatgtttgggttcattgaagcatatgtagaatgcccaaaaagtataaataaaccatttcttccctatggggataataaggatggcactcttatctttcctacaggcacctttgttggggtttactatagtgaggagctcaa

SEQ ID NO: 26720 - DNA, 276 bp, Glycine max
  Peptide Sequence Number=SeqID_118405
atggcggttccaaagtcagaaaagatgcaaagacaagatgaaactaacaagaaacaaggtttcgttctctaccgaaaccacaagccaagttggaagattccgcttcggttgaagggttcctctcggtgtggggtttcaatggagaacaacgatggtttgtggtggctaatggtggctgcgagtgatgaagaaagtgcttggaactttagaaatggctttggaagaaagaagagaagaaatgacgtttttcttaagctacaccaaaagcaaggctga

SEQ ID NO: 26721 - DNA, 676 bp, Glycine max
  Peptide Sequence Number=SeqID_118406
tccgttgaggaaagataaagaacttatgggcatccgtaatggcatcatcggtggttatcatgaatggctgagggttcatacgcgagggttagattggctctccaagttgaaagttatcaatgaggagaacttcaaagctctggaagaggatgaagaagtccaagctctaaaattagagctaggaaaggcaagactcgccaaagaaaaattcaagtcagccactacaacatccggagaaagtgcaccgagttacgagaggaaaatgcggccgctgcaagagcccttgaacaagaaaccaaaagggcccgcaaggaggaacatggccgagataaattccgaggagctttgtggggcagcaacaatgagctcaagctctggagagaggaaagggaccagtcacggatccaagaggagtttggctcaacacttggaagccacggagcaaagcatgctagctatcatagggcaatacaaggaagagttaaaccagtcgttgacccatgaacaaaaactagtagaggacttcgcacaagcgtacgccgagaaggaagcaagagggagggtgattgatgcattgcatcaagaagcgaccatgtggatggataggtttgccttgaccttaaatggaagtcaagacctcccgcgactactagccaaagcgaacgccatcgttgaa

SEQ ID NO: 26722 - DNA, 531 bp, Glycine max
  Peptide Sequence Number=SeqID_118407
atgattcatgttattgcacagactccatacacacttcctacagctcaagacccaaccaaatccttgttaagggagtcaattcctactacccctgttagagatgcttcactttcagcaccagatgattcttttacacctgagtacccaacaaatccaaattatgaacatattgttgatgaaagacctttcattcgtgcatataaaggagagtttcaaccaacatatgggtgttgtaatatcatatcaaatgttattagggcaaaatttgatgaaccagctccaagttggttgaatgtgttagttgaccttcgcgataggtggtttggagagtttaagtataggtggcacccacaagaagagcgagccattagagctgtttttgagacaaaaggttcatgtattttaaaaagtgcaatgaacaagattagaaatggtcaagataaaggaaagtggataacatctaatgttcgagcagccttggacgaacattggggttctacagatttcctaaacaagagctccactgccaag

SEQ ID NO: 26723 - DNA, 271 bp, Glycine max
  Peptide Sequence Number=SeqID_118408
atggaaaaccatagatttataagcaattctgattcagcaaaaaccagaagcaacaaaaagcgtattagacaacaaaaggtacatgttaatgctcaggatagtgtccatgcaagtgtcaatccagcttcatccaatactgaagatcattataaccaaccaaagacaccaccgcatagtgtccatgcaactgtcaatcgagcttcacacgatgctgaagatcattttaatgtctctggttcatcagagaatgagaattctggatcaacagaag

SEQ ID NO: 26724 - DNA, 276 bp, Glycine max
  Peptide Sequence Number=SeqID_118409
atgcgttgttactactacgatggaagggcaggcagcagatatagattagtagcagagatagagcaactagttagtagtggcttcatccaccaacaacctacgaagaccccggaaacaagcaaagcatgttttgtagtgtactcatcacttgcaacaccacctgactacgactctaacaagagcaaagaagatagcactcaaacacccgctatcgagactggtgctgctatgatgtatgggctatattacttgtgctgcagacctctcatcatatag

SEQ ID NO: 26725 - DNA, 198 bp, Glycine max
  Peptide Sequence Number=SeqID_118410
cgcaccactccagtcatcaagcgcaccgcttcagctcatccgctaagcgaaacaagggcgctaagccaaaatccacttatgctcgctaagcgatctagatctgcgctaagcgaacgagtccaagttctagagagttttgagagattttgctgtgtgaagatctgcaaagatgtgagtttgaagcggaagctgttctga

SEQ ID NO: 26726 - DNA, 210 bp, Glycine max
  Peptide Sequence Number=SeqID_118411
atgccgctcagccccgtgatattggttaccttggccgatagagagctgatgtcggtggctcattccttcctttcgcttggaggcgcgtacctccacggaactgcgtggctgtttttgtatggaaatggaataggcctaactaccgaggggtgttgggtcgtttggggagctgcgtccctggtgaaatgtatcaccaaggggatcctctag

SEQ ID NO: 26727 - DNA, 1330 bp, Glycine max
  Peptide Sequence Number=SeqID_118412
atggcgctgggtgacaaaattgaactgcacaccttcggcaaattctcgccgttcgaaggggccaacgtggtgaaccacgggtttgaaaccgacaaacgcaaactgatgagcgcgctgaatgaaatggatgcgctggtgttcagctcccgcgtggataactatccgctgatcctctgtgaagcgctctccattggtgtaccggtacttgccacccacagcgacgcggcgcgagaagtgctggagaaatccggcgggaaaaccttcgcggaacaggaaattttgccgctggttcaattgccgaaggcgcagattgcccggactgtttttggcactgacctggaatcgttccgcaaccgcagccgcaaggcaatctgtagttatctgctgctgccgctgatctacctgctggtcaacgtcaagattgcccagctcggcgaaagcttcccgataaccatcgtcaccttcttgcccgtgctgcttctgttgtatgtcgataaaatcaacctgaagaagttgatgattgccttagggttgggcacgggcctgacgctgtttaactacatctttggccagtcgctggatgccagtaaatacgtcacctcgaccatgctgtttgtttatattgtcattattatcggtatggtctggagtattcggtttaaaactatttctccgcacaattatcggaaaatccttaggttcttttatattgccgttgcgttaattgttatgcttgctgccatggagatggcgcaaattattctcaccggtggcagcagcctgatggagataatttcgaaatatctcatttacagcaacagctatgtattgaacttcattaagtttggcgggaaacgtaccaccgcgctctattttgaaccggcgttttttgctctggcattaatctcaatttggctcagcatcaaacagtttggtatcaaaacgcctaagaccgatgctatgattcttgcaggaattgttctgtctggatcgttctcaggggtaatgacatttatcctgttttacctgctggagtgggcgttccagtacctgaacaaagaggcgattaagaaaaaactgccgctggcgattatctccctgacggtatttctggtaggcgtgatatttgcattcccgtacatctcagaacgtctgggtgatttgggaacggaagggtcttcgtcctattatcgcattattggtccactggtgatggtgggttattccttaacccatattgatggcgtagtaagattcggctcactttacgaatatgttgcatcattcggaatctttaacggtgcggatgtcggtaaaaccatagacaatg

SEQ ID NO: 26728 - DNA, 327 bp, Glycine max
  Peptide Sequence Number=SeqID_118413
atggggtggctcagatcatcatcggattctgtctcttctgctgcatctcctctcctcagcagcctctctctcttcagctgctctccttcttcctcagctgcttcttcatcatcaatgccactctctgagagccttttgatcagcagttctagctccatcttcttctctgtggtggctttgatggttgcttccagcaccttgcatgtgtccttgagttcagcaatcagagcatccttggacacagcacctgaagcagcagctttccctgatgtcgagacagatgtcgagacaatgtctgggacatgtgtcccttcaaacagtttgtaa

SEQ ID NO: 26729 - DNA, 192 bp, Glycine max
  Peptide Sequence Number=SeqID_118414
atggggaagaccacaattagaagttcaaaacgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 26730 - DNA, 378 bp, Glycine max
  misc_feature (218)..(218): n is a, c, g, or t
  misc_feature (367)..(367): n is a, c, g, or t
  Peptide Sequence Number=SeqID_118415
atgcggagaactcgcctgcctcctctagcgatacttctttcttgccacaaccatccttttttctctggaagacctttcactggaatatcctcgttcggagtggggatcattttgtcattttgttcttccgccatctttgccttccctttaacgtttacgggttgtgtcggcaggtcaaggggtgcgaacatgcgactgctgcgggtcacaccgctcangtcccttgatattggttaccttggccgacaacgaatgatgtcggaggctcttccttcctttcgcttggaggtgcatacctccatggaactgcgtggctgttttggtatggaaacggaacggtttaactaccgaggggtatcggggcgtntggggagttga

SEQ ID NO: 26731 - DNA, 318 bp, Glycine max
  Peptide Sequence Number=SeqID_118416
atgcttactacctcaaaagattggaaggctgtttcctatgactcctccgcggcttccacatatggcatagaggacgggcaacttaccaagatgtcttcctcccccgatacaatgaccaaatgcccctccactatgaacttcagtttttggtggagtgtagagggaacaactcccaccgagtggatccacgggcgtcccaaaagacaactgtatgggggcctatctgtacagggaggtcgatctctcccctcacctctcagcggctgtcgtcgaaggcatggaccaacatggaacttggctttagatgggaagcgttaa

SEQ ID NO: 26732 - DNA, 267 bp, Glycine max
  Peptide Sequence Number=SeqID_118417
atgtgtctatcggggaaggagaatatgccgatgaaattttctcataaccgaaacactgggtccaacaaagataggagagaatcactcaaagtgtatcaatctcacacaggattgacattctcaccctgggtcaaggtttatgataagttaggattttggctcaaggcttgtagaacggctggtcatgatatatgtcagggtttggccagcggttcggggataaaggggatgtcctacattatttccatgatacacatgcaacaatga

SEQ ID NO: 26733 - DNA, 417 bp, Glycine max
  Peptide Sequence Number=SeqID_118418
atgggtgatcaagaggagacacaagaacagatgaaagccgacatgtcagctttgaaagagcaaatggcttccatgatagaggccatgttaggaatgagacaaatcatggagaaaaacgtggccaccgctaccactgttagttcggctgccgaagcagacccaactctcctagctactgcacaccatcctcccccaaacacggggagcatcctcgacagcccgacgaggtccacgaagatcatcgagagtatgcccaaggggatgtcgatttctaccccccgatccccgtcgtggggccggcacctaacacattgcctcagcacaacctcacaaaacaaccaatattcttgtccacagaagaaccaaccccggcgacggaagaaaacaggaaactcgatctcctcgaggagagattga

SEQ ID NO: 26734 - DNA, 405 bp, Glycine max
  Peptide Sequence Number=SeqID_118419
atgacgcagctgatgaacctggcatatattggtcccctgaagcatgcatgtcggtcattatcgattggtctggcagcctgtctgaatgccgggttgttgtactggcagctgcgcaagcaggatattttcacgccgcagccgggctgggcgagtatcctcggtgcgtctgatcgttgcggtactggtgatgtctgctgcgttactgggcatgatgtccatcatgccggagtggtccctgggcaccatgccttaccgtctgatgcggctgatggccgtggttggcgttgggttgttggcttactttgccacgctcgccgtgttgggtttcaaagtgaaagagtttgcccgccgtacggcataaacgccaaaaggggagttcaccttagggtgctccccattgcatga

SEQ ID NO: 26735 - DNA, 207 bp, Glycine max
  Peptide Sequence Number=SeqID_118420
atggcgactccactggggatcacactcctaagtgggttaaacctatcttgtttttcttcatctttatgctttgttattattcgaaactgtaaatacgtgcttaagtgtttatcttttactgtctttccgagagtgagtttcggatgtggcacatgtgataaccccgctcaatggagggatcttgggagtattactatgttggcatga

SEQ ID NO: 26736 - DNA, 516 bp, Glycine max
  Peptide Sequence Number=SeqID_118421
atgggttctccacctgcctccactcctcctcctcctcctcctcctcctccttctcctccttcggacgcatcggcttcgctgtctgccgtgaaacggacacgcaaagcctcacgtctacgatcattgtccactagaccacctagtgctgagagaccagtggtgcatgttgatcctactaccgggaaggctgacggtccccacaagaagaaattaagaacatatttggggattgtggcgcgtgataaggtggacgtcacctacgagaactggaaggaggtccctactgctcagaaggacctgatttgggaggatattcaggcttctgacagtaggacgaaaaggaagttactgcagaccgtgggggagagatggaggcagtttaaatcagatctcacgaggaaatgggcccttgcagccgatcaggacggtgtcgaggacactgtctgtgagaaatacggcatcagcaaggaaaagtgggcccagttttgccagactcacagagacccttcttgggag

SEQ ID NO: 26737 - DNA, 1184 bp, Glycine max
  Peptide Sequence Number=SeqID_118422
tgaaaagctgattgctatcggctcctcaaccggcggcaccgaggcgattcgccatgtgctgcagccgctgccggccaccagtccggcgctgctgattacgcagcacatgccgcccggctttacccgctcgtttgccgagcggctgaacaagctgtgccagatcaccgtgaaagaggcggaagacggcgagcgtattttgcccggccacgcctatatcgcgccgggcgcgatgcacatggagctggcgcgcagcggtgccaactacgtggtgaaactgaacgacggaccgccggtgaaccgccataaaccgtcggtggacgtcctgttccgctcggttgcggtcaacgccgggcgaaatgcagtgggggtcattctgaccggcatgggcaacgacggcgcggccgggatgctggaaatgcaccgcgccggcgcgtggaccatcgcccaggatgaagccagctgtgtggtatttggtatgccgcgcgaagcgatagcgatgggcggcaccaccggtcctgccggacaagacaacacaggagtagatatggctgataaaaacatgcgctttttggtagtggacgacttcaacacgatgcgtcgtatcgtccgtaacctgctgaaagagctgggattcaataacgtggaagaggccgaggatggcgtcgacgccctgaccaaactgcgtgcaggcggcttcgatttcgttatctctgactggaacatgccgaacatggacggtctggaactgctgcagaccattcgtgccgacgccacgctgggcaaactgccggtgctgatggtgaccgccgaagccaagaaagagaacatcatcgccgccgcgcaggccggtgccagcggttacgtggtgaagcctttcaccgccgccacgctggaagagaagttgggcaaaatcttcgaaaaactgggtatcctgcgcgaactggggctggatcaggccattgccgaagcggcagaagcgattccggacgcgcgtgaccgtctggattatgtggtgcagatgaccgcacaggcagcggaacgtgcgctgaactgtgtggaagcggcgcagccacaccaggaccagatggaagccggcgccacccagctgaaaggccgctgggatgcctggtttgaaaacccgatcgagctggcggatgcacgcgagttgtttcggatacgcgcca

SEQ ID NO: 26738 - DNA, 486 bp, Glycine max
  Peptide Sequence Number=SeqID_118423
atggggatcgcaccccaagagacacccagtggacccggaaaagtccaacagggccctggggtttccagctctggttacgggcctctatcagtcctacagggtgcccgtacccccccagcaagctcatgccatcatgacataggtaaggattgtgcccgcaagacacccagtggacccgaagaagtccaacagggtcttggagttgtcaaagctctaattacgggtctctgtcagttctacggagtacctgtcacctccagcaagggcatcaggccccctactaatcgagctttcatcaagaagtactgcgccccagacaggcgcagggcgaaacaccacagcagcattgggatggcggcagcgggaaacagacgcaccgccatcacctctgctcatccacaaaaaggtttgagtattgcctacacaacatggccgaccaataggcgaccaagtccaaagccaaatgatgcacctagttgctcatga

SEQ ID NO: 26739 - DNA, 91 bp, Glycine max
  Peptide Sequence Number=SeqID_118424
atgacagaaattgtctgcgcggaagatgacgtaaatctccgtgtgtcaatgagcttgttggctgcgattgacaaaggatgcagaagacgat

SEQ ID NO: 26740 - DNA, 453 bp, Glycine max
  Peptide Sequence Number=SeqID_118425
atgaccatgattacgccaagctcgaaattaaccctcactaaagggaacaaaagctggtgttggggactttcatcactatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 26741 - DNA, 480 bp, Glycine max
  Peptide Sequence Number=SeqID_118426
atgcttaaacaaagtcaagggtcgctgaatatttctcagatcggaggagatgctacattcagttttggtaaatatcatttaaatacaagagtgcagtttcagaacgcgctaacaaataaagatttgtatccgatgcctggatttataggccgtgctaatttcttttatcagaccaaagcgtttaaaaatgctgcagaaatccaagctggactgaaagtttactatttctcaaagtttgcttcaagagaatattttccgatacttaacgaatacattttaccaagagcggattcattttcaatcgggggacagcctattgccgatgtttatatcaatatgaaagttaaaaaaatgttcttctttattgaagggcaacagataggtacacttatctcatctaataaagcctatgcatttccacattatccggtttatgattttagactgaaccttggaattgtttggtatttgttcaactaa

SEQ ID NO: 26742 - DNA, 228 bp, Glycine max
  Peptide Sequence Number=SeqID_118427
atgcatacctgggcaagatttcacccagccgctgcaaggagacgagtgtggatcatgcacaccaccacaactccgatctccctttgccaaagtggatcgcgcccacaagacacccagtggacccagagaagtccaacagggccttggggtttccagctctggttatgggcctctgtcagtcctaccgggtgcccatccccccagcaaggtcacgccattgtgacatag

SEQ ID NO: 26743 - DNA, 381 bp, Glycine max
  Peptide Sequence Number=SeqID_118428
atgacgttgttacttagcaacattctgcccagtgaccgtaatgctgatctccccctgcggaaggatcgcgcccacaagacacccagtggacccggaaaagtccaacagggccctagggtttccagctctggttatgggcctctatcagtcctacagggtgcccgtacccccccccccccagcaagggatcgcgcccgcaggacacccggtggacccaaagaagtccaacagggttctggggtttccagctctgattacgggcctctgtcagttcaacggagtgcccgttgccccaacaaggtcattaggccccgcattaactgggctttcatcaagaagtactgcgcccctagacgggcgcagggcgagacaccacagtag

SEQ ID NO: 26744 - DNA, 162 bp, Glycine max
  Peptide Sequence Number=SeqID_118429
atgtatattgttgtggtacttaaggatgaacgcaagcggggatggggtcacgaccgaccgatcgttgcccttctctgtgcgaaacaagcagggagtatcgctgcaaggcagccccgtatcctttctattttgcagctttcttttactatttgtttgttttaa

SEQ ID NO: 26745 - DNA, 144 bp, Glycine max
  Peptide Sequence Number=SeqID_118430
ggcgatagcccggttttgattgaatatcctttcctgtgcttgtcttgtattgaggaatacggtaaggatgggaaactaaggcagctaagccactacactagtacgaaggagcaagctccggcccccgttctatccactaagtaa

SEQ ID NO: 26746 - DNA, 477 bp, Glycine max
  Peptide Sequence Number=SeqID_118431
atgttatctgaggatcaggaattacaagcttatccagattctgttttagatattcgtgaattacaacctggcaatgtggaagttttaattcagtggcaaaatctccctcccagtgaaaatagttgggaatctgtggctaaattacaagaggtttttccgacttatcaccttgagggcaaggtgagtcttttaggcgggaatattgataagcataagcataagccacacatcacccgcaaacagcgagcaagagaagcaataaccatggaccaccagcagcagggtgcacaacacccaaggggtgcaaaccacccaacagttatgacccacccaaggggtgcaaaccacctaatagttatgacccacccaaagggtgtaaaccacccaatagttaggattcacccaaagggtgcaaggtcagaagatgtgaatcaaagggacatgacccttgggaacagtcacaaccaactgttatga

SEQ ID NO: 26747 - DNA, 310 bp, Glycine max
  Peptide Sequence Number=SeqID_118432
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtgactgcgctccttccagcca

SEQ ID NO: 26748 - DNA, 306 bp, Glycine max
  Peptide Sequence Number=SeqID_118433
atggcaggaattggtgacggtggtggtgaatatcatcaactgggcggatctcagcattttttactggacatgattactacacagatgcaacgtttgctgaactgtaacaatgaaaagctctatgagcgaattgaaggattggagaaccaattgaatcagaatgttggaagacattatggtgggaacagagggggcaatgatggacccaagcaaaacagaatggaggggctggacagaattgagggagtaaaactcaatgtacctcctttcaaaggcaggagtaacccagacgcctaccttgactag

SEQ ID NO: 26749 - DNA, 219 bp, Glycine max
  Peptide Sequence Number=SeqID_118434
atgagagcaagtttagcatatgacaccggaattggggtgaattctacaggctttttcgctgcaaaattcatttcttggttggtgttttggtttgtgctaaaggtggtgttcatcattggttggatggcctttgtggataactgggtggtaggtaaggagaagggttgttattggctaagtaatgacattgttgggttggtggggaacttggccgtatag

SEQ ID NO: 26750 - DNA, 296 bp, Glycine max
  Peptide Sequence Number=SeqID_118435
atgctccagtggctctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagaattcgatatgacgttgagggggagactgctgctgctgatgatgactga

SEQ ID NO: 26751 - DNA, 616 bp, Glycine max
  Peptide Sequence Number=SeqID_118436
atgtcttttgctttcatgctttccaagactacaatgtcttcagtcatttatgatttcaaaaactacaatttcttcatttacatttcaaagacttcaatgtcttcagtcatttacgctttcaaagactacaatggcttcatttacatttcaaagacttcaatgtcttcagtcatttacgctttcaaagactacaatgtcttcacttacatttcgaagacttcaatttcttcagtcatttacgctttcaaagactacaatgtcttcacttatatttcaaagacttcaatgtcctcagtcatttatgctttcaaagactacaatgtcttcattttcatttcaaagacttcaatgtcttcattcatttacgctttcaaagactacaatgtcttcatttacatttcaaagactacaaattctttagtcatttacatttcaaagacttcaatgtcttcagtcctttacactttcaaagacttcaatgactcaatgtccttgtcgcaacctacctttcggcgggagggcaacgcgaggctcatgggtgcatcctccaaggaaggaaaacgcgcggagtcgccaccaacgtttattcgaggaaaacgtcagaaaaaccaaaact

SEQ ID NO: 26752 - DNA, 303 bp, Glycine max
  Peptide Sequence Number=SeqID_118437
atgttctttacgatgccattgggatatatcaacggtgttggaacctcttacgtgccgatcaacgtctcattttcgccaaaagttggcccaggagcttcccggtatcaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcaccctgcgcgtaaccaccacacccgccgcgcttaa

SEQ ID NO: 26753 - DNA, 947 bp, Glycine max
  Peptide Sequence Number=SeqID_118438
atggtgaaagttggaacctctttacgtgccgatcaacgtctcattttcgcccaaaagttggcccagggcttcccggtatcaacagggaccaccaggatttatttttctgggagtgatcttccgtcacagtcgcttctgtttctatcagctgtccctccctgttcagctactgacgggggtgggggggtaacgggcaaaaagcaccgccggacatcagcgctggcaagtgtagcggtcacgctgcgcgtaaccaccacacccgccgcgcttaatgcgccgctacagggcgcgtcccattcgccatttcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattagaggcataaagaaagataaattaatgctagagagagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgtttcgactgcggcgagcggaaatggcttacgaacggggcggagatttcttggaagatgccaggaagatacttaacagggaagtgagagg

SEQ ID NO: 26754 - DNA, 111 bp, Glycine max
  Peptide Sequence Number=SeqID_118439
atggcgtcttgcaatggagaaaaagtatttataaaaggaaaaacaatatcagaagcacaaaggataaaatatggaaatgaaggtctaaattggggtgttgctgcaatgtag

SEQ ID NO: 26755 - DNA, 553 bp, Glycine max
  Peptide Sequence Number=SeqID_118440
atggcgcaggcgctcgtcagattcctcgataaccagtatctgctggccgacggcgtggaaaccaaattcgtcgcgggcatttttgcgattttcggccacggcaacgtgctggggctggggcaagcgctggagcaggatagcggcgatctgcgggtgcatcagggccgcaacgagcaggggatggcccatgcggcgatcggcttcgccaaacagaagctgcgccggcagatctacgcctgcacctcatcggtcggccccggcgccgccaatatgatcaccgccgcggccaccgccaccgccaaccgcattcctttattactgctgccgggcgacgtttacgcatcccgccagccggatccggtgctgcagcaaatcgagcagtcttacgatctcagcatcagcaccaacgacgcgttccgcgcggtgagcaaatactgggatcgcatcgtgcggccggaacagctgatgagcgcctgcatcaacgcgatgcgcgtgctgaccgatccggcggaaaccggcgcggtgacgctgtgtctgccgcaggacgtgcagg

SEQ ID NO: 26756 - DNA, 321 bp, Glycine max
  Peptide Sequence Number=SeqID_118441
atgaggaagatgttgctggttgaggtccttgacactgctttcccgacctcaatgcaatggcactcacatttctgggattctggacagattgagaagtcatttacctcacaagttcttcaagggaaggttacgggggggcctcaactgtttgttgtttctggggctattgttgttgttgttgttgctagattggtggaggaacgtcataattgttctgttgtggctgattttgctgctgaggttgaggaggtctattgtagatgtttgctacataagcttcaggatgttcaattgcttcagattgttgcacagaaggcaaag

SEQ ID NO: 26757 - DNA, 834 bp, Glycine max
  Peptide Sequence Number=SeqID_118442
atggcgaacaccgacaacacgtcctgtttctcttcgggtcgagcccgccggcagctgtacctgtacggtgaagatgccgcggtcttcctgcggcaggaacgaggtcggcagcttgatgaacagcagcgccatgccgccgagcaacagcagataaatcaccatgtagcggccgctggcgtgcagaatgcgccccacgccgcgctcatagcgttcggcgttgcggttgaacatgcggttgaaccagccgaagaagccgcgcttgccgtgatggtgccccttggcgatcggtttgagcagcgtggcgcacagggccggggtcaggatcatcgccaccagcaccgacaacaccatggcggaaacgatggtgatggagaactggcgatagatggcgccggtggtgccgccgaagaacgccatcggcacgaacaccgccgacagcaccagggcgatgccgaccagcgcgctctgaatttgccccatggatttgcgcgtggcttcacgcggcggcaggccttcttcgctcatcacgcgttcgacgttttccactaccacgatggcgtcgtccaccagcaggccgatcgccagcaccatggcgaacatggtaagggtattgatgctgaagccgcaggcggaaaggatggcgaaggtgcccagcagcaccaccggcacggcgatggtggggatcagcgtggcgcggaagttctgcaggaacagatacatcaccaggaacaccagcaggatggcttccagcagcgttttcaccacgtccttgatcgaggctttgacgaagggggtggtttcataggccactttggcctccagcccgtgcgggaa

SEQ ID NO: 26758 - DNA, 210 bp, Glycine max
  Peptide Sequence Number=SeqID_118443
atgcggggctaccgtatggttacccgcacctttcgtcaaccaagggcaaacaagcccgttgacacccaaagactaacatcgtcaactgcaccttttgtcgtcctgacccgtgaagtcagggacagcgagttaggtggcaagcggagataccttatggtcatccgcacctttcgtcaaccgaggggaacgaatttgatggcatcaggatga

SEQ ID NO: 26759 - DNA, 376 bp, Glycine max
  Peptide Sequence Number=SeqID_118444
ctgtccctccctgttcagctactgacggggtggtgcgtaacggcaaaagcacgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggggcgaattggagctccacccgcggtggcggccgctctagaactagtggatcccccgggctgcaggaattcgatagcctgtgatatggggtacctcaattcagttttgtcctcttcaagccaggttcatgctgcagaagattcacctgtcagtggagggggcctcag

SEQ ID NO: 26760 - DNA, 472 bp, Glycine max
  Peptide Sequence Number=SeqID_118445
atgaccaagttcgacccagacatagtcctcgaattttatgctaatgcttggcttacagaggagggcgtgcgagatatgcgatcctgggtgaggggtcagtggatcccgttcgatgcggatgctctcagccagttcctgggataccctttagtgctggaggagggccaggaatgcgagtatggccagaggaggaaccggtccgatgggttcgatgaggaggccatcgcccagttgctatgtataccggggcaggattttgcccggactgctgctggaagacgggtgcggatcatgcgcaccaacatgaccaccctgactcagatctggatgactttgctgctcagcaacatccagcccagcgatcataattcggacctccccctgccgaagtgtcagctggtgtacgccatcctgactcggatgagcattcacgtggctcagttaatcgctgatgccatctttctatttgcag

SEQ ID NO: 26761 - DNA, 279 bp, Glycine max
  Peptide Sequence Number=SeqID_118446
atggcaccaatcaccacctattttttgattctcatgtcctcagtgttctatgttttctgggatgcacgtgtcgcgcttgaagagttcactgtccatgaccatcttggctttccaatggaatgtaaagcagtgttttgttgtcttgatctgctggattgtcatgaagaacagatatcaacaaatatgatagcttcaaaacagagtaaattactcctgctgatccataaccaatattctgttgtcatgacccggataatcgagttgaatctcgtagcttaa

SEQ ID NO: 26762 - DNA, 1122 bp, Glycine max
  Peptide Sequence Number=SeqID_118447
atggacttctttactagagacataaatgaggactctatgcttagatgtccattcttgaggaacatcaatgagcctactaacttctcattcttttcacctttggctttaccaatgcctgacttaatgtttcaagcacaccgtttatctgttctgttattaatcttgatagaaatcggcacacttacaaaatatctgattgttactcaggttcgtggagctaaaggtccaatttttgaagatggtcccaattttgatttggcatttaggcttttccacgggagtgatggtgtagtacccttatctgacagatcttttcggccttctgagaagaaagtacaggcagaacctcccaaatcccaattcaatcctttagctgcaaaggcagcaactattagtctgtcatcatttggatttggcggggctttcggttttgatgcattttctgagaagtggaacaaccagaaaagaaaatccaaatcatcaaaaaatgaaccttcttcacaggatggttcaaagcatgaggccaacaatgattggcttcaaaatggtaactgccccattgcaaagtcataccgagcagttagtaatgtccttccacttgttgcaaaggtcattcagcctcctccaggcataaaatacaagtgcccacaagcagtagttgcagcgcgggcagctattgcacgcactgcatttgcaaagaacctccgtcctcagtccctgcctacgaaggtcctcgtgattgggatgctgggcatggcggctaacgttcccttgggtatatggcgggaacatactaagaaattttcgccgacatggtttgctgcagtccatgcagctgttccattcatagcaatgctaaggaagtctgtcttgatgcctaaatcagcaatggcatttactatcgcggcatcggtgttggggcaagtaattggttcgagagctgagaggtacaggctgaaggcagttgctgcaaaaaaggtgtctataactgaaacctctggtgttggtcctctcctgttaccagtggctactacaaaagacaagcactgtggtgatgctgtggattggaaagcagtttctcttcagctggcagcaacttcaccaactgatgtattttgttga

SEQ ID NO: 26763 - DNA, 732 bp, Glycine max
  Peptide Sequence Number=SeqID_118448
atggggaggaaagggggttggttttctgcagtgaagagagtttttgtttcatattccaaaaaggaacagaaacagcatcatcataagtcaaagttaggatgttttgggactcatcactatgaggatctagaaggagcgccaattgccgctgttccttcacttccaccaagaaaagaccccaaaccaataagtgaggcagagaataatgaacagagcaaacaagccttttctttggttttggccactgcagtggcggcaggggctgctgttgctgctgctgctgcagaggttactcgtctcacaaacacgcctcgttctaatggaaaagcgaatcaagaaatgacagctatcaagattcaaacagcataccgtggatattcggcaagaaaatccttgcgtggcttgagaggtttgtcgaggttgaaaacgttggtgcaagggcaatctgttcaacgacaagcggctactaccttgcaatgcatgcaaactctttcacggttgcagtctcaggttcgtgcaaggaaggtcagaatgtctgaggagaatcaatctcttcaaaggcaactgcagcagaaacgtgaaaaggaatttgacaagtcgcaagctaatcagattggagagaagtgggatgatagcttgaaatcaaaggagcaagttgaagccaaattgttgaacaggcaagtagctgctatgagaagagaaaaggctttggcctatgcatcaacacatcaa

SEQ ID NO: 26764 - DNA, 2358 bp, Glycine max
  Peptide Sequence Number=SeqID_118449
atggtgtcagggagcgacccagttgagtcttttttcaattccgttcaagttgtgaaggattcgctgtcgccacttgaagtgggtattcgcaaggcggcgaaggatcttgagcattgtttggcagggtcaaagaacaaggtaaacaatggtgtttgtttgattgccccagtgagggaaagtggtgcatttcagatctgtgatgtgaagaagaagaaaggtttgtcaatgaaggttcccttgaaggctttctggggcatgttttcacagaattcagggaatggtaatggtaatggtagtagtaatattagagctcaagtgggcaaggaagatggaccctcttgcaccaattgcttgcagtttgctgtgacttggtctttgttggttaatggattccttcagtctctgccacttcctttcaaatctgggaagaagaagtgtcagaaagtgtgtgatgaagacaagctgtgttcttgcatgaagcctactgtttcatcatgtgaggtgaagcagaatgaatccaaggggggtcagtttggtagagcagttagggagaagggtgtgaggaagaaggatgggaaaaatgtttcacttgagtgccttataggttttatctttgatcagctatctcagactcttcagagtcttgatcatcatggggtgcaagataataatgatgaccttgacaatgggaaaactagtctgccccaaccttctttttctcattttggtcatgtgaatgcactcgcaggtttcttggaggagcacaaagtatatgtgaatagcttcttggggaatttgaggtttgcaaaggtgggtggtgtgccatcaagtgtgcctggagaagaaagcccttcaactaacggagagggagatattagtagtgacaatggtaatggtaataatgaaaacaaggatgaaaccggaggaaattcgccgcagaaggttgccaacaacatattcagtattcctctctcgaatgtggagcgtctaaagtcgacactttccacagtttcattgacagaattgattgaactgctaccgcagctggggagaacatctaaagaccatcctgataagaagaaactaatctcggtacaagatttctttagatacacagaagctgaagggaggaggttctttgaggagttggatagagatggggatggccaagtaactctggaagatctagaagttgcaatgagaaaaagaaagctgccacgaagatatgctaaagaatttatgagccgtgctagaagtcacttattttccaggtcttttggttggaagcagttcttatcattaatggaacagaaggagccaacaattcttcgtgcatatacttctctatgtctaagcaagtcagggacactgaagaaaagtgaaatattggaatcactaaagaatgcaggactccctgcaaatgaagacaatgctgttgctatgatgcgatttctgaaagcagatacagaagaatctatttcatatggacatttccgcaatttcatgcttctacttccctccgatcgtcttcaagaagatcctaggagtatttggtttgaagctgcgacagtagttgctgttccaccagctgttgaaattcctgctggaagcgttctgagatctgcattggcaggtggcctttcttgtgccctgtcatgtgcgttactgcatccagttgataccattaagactcgagtacaagcatcaacaatgtccttccctgaaataatttctaagctgccagagattggaaggcggggtttatacaggggctcaatccctgcaattcttggacagttttcgagccatggcttgcgaactgggatatttgaagcaagtaaattggtgttgataaatgttgctcctacactgccagaactccaggctggtctttttgacaatgtgggtgaggcttttgttgcgacttgggagcaggatggtcttaggggtttcttccgtggaaccggagctaccttgtgccgtgaggttccattttatgttgctggcatggggctttatgctgaatctaaaaaggttgcagaacgactactagagcgggaactcggtcccttggaaacaattgctgttggagctttatctggtggcttggcggctgttgttacaacgccgtttgatgtcatgaaaactagaatgatgactgcacagggccgatctgtgtcaatgaccttgatagccttctccatactaaaacatgagggaccccttggcttgttcaaaggagcagtacccaggttcttttggattgctcctctaggtgctatgaactttgcaggttatgagttagcaaagaaggccatgaataaaaatgaggagggcaaggcaggcagttcagagtaa

SEQ ID NO: 26765 - DNA, 808 bp, Glycine max
  Peptide Sequence Number=SeqID_118450
gaacccacagattacgacattcaaacctgatggatcatattcatcggtccagcttgagatcccgacaggggagaagaaatggaacagtgacgaatgggtgggccggctgaagaaactgaggatattcaacagagttgaggacgaaatcccttgggatgtaggaacaaacgtggtgccaaaatacctaggagatgacatgatactccttcttggcctcaccgataccaaagcagaagagctggtcaacgaagaaactaggcatggcttgtctccgtttcactcgttagagaaatggaatccgacattgagaccaggacacggactggtctgggttcaatgctggggcattccattagtagcatgggatattgcgcaacttcgcaaaatcgtggcagcaataagggacctggtggaggtggatgacgacggagaagagttgcggaggttagacagggcaagggttctcatcagaaccccatggaggcctatactccaacacacatttgacattcacatggcggggagcgccctttggtcgtcggatgaaatcgattcagacgacagcgacaccggcaccctgctgtcgaagatgatcagagcatttggaactgagtacatgcccagaagtttcaccggcgactgcatcggcagattcacgaaccaggacaacgcgacgatacccaatggaccacgagacgaggaagatccaatgagtaaggatcgtggtaggaaactcgtagagcacaaaaacagcaacatcacgggagcagaggcacaacagtcatggtacattggtgcactgaaatag

SEQ ID NO: 26766 - DNA, 135 bp, Glycine max
  Peptide Sequence Number=SeqID_118451
atgaagaacataggtgatgtggggccaccgacacttatgttagtattgggaaaagggcattgtggtcaatttatttcaaaagggaaaaagcggggtgggaacttggaagatgttgagaggagggcattgaggtaa

SEQ ID NO: 26767 - DNA, 612 bp, Glycine max
  Peptide Sequence Number=SeqID_118452
atgagtagcaaagggttgctgagaggagcttcgttaactgcaaacgcagtgtggcatagaagcagtttcttcccaaaggtaacggttagcgtccaccgcaagttggtgaaatttcgaagcttctcattaaccaccacttgctcctctcttctacctccggatttgccgcgtttggcaaaaacggctcaaatttcacttaccccaaacgaggttgaagaaattgctcccaaaattcaacaagttatagaatggtttggacagcttcagggtgttgatcttgaaagtgttgaaccctcgatcagagcagtagattattcctcttgcctaacagattgcattacattctttcagctgagaatgcgtgagacggaaaacaatttgcgtgataatgatcctgaaacatttgaccatagggacgccttgatcgcttctgtcccgagctatgaggagccttatattaaagttccgagggttttcccaattcaacgtaaaggtgcaatgggtatcgagaaggctcaaatcaacattgtggtggttggttatgtggactctaagaagttaaggaactcaataagcctgttgctgagagacaaattgctgtcattaacttaa

SEQ ID NO: 26768 - DNA, 1074 bp, Glycine max
  Peptide Sequence Number=SeqID_118453
atggacgccacgaaggtagtgacgctgaaagcaatcgaagcaactccgtcaaccttcaaagactacggtcaggtcatcgaggcttcgccggacggccaggaatttggttcccacgatgctcaactcgacctttctcaaggaactccaaggttctacattatgcatattgaaaatcgcccgcttaagttttctagtattacacatcatgcaagcgtgactcagtgcctcgggtctattggtggccatgtttggtatcttggagtggccaagtcatccattgttgattcaaatgaaatcaaggatggcacaagcaagaagattgtgcagtcaccttccggtcattcatatgtgcctccagccattgaggatgtccaagttttcaaggttgcaggttccaaatttcttaagcttaaccggggaacatggcatgctggccctctatttaaggcagctgcaatcgacttttacaatctagaactgagcaacacaaatattgtggtgagtagcataatggaggcaccgaagctgaaggtagtgacactgaaagccatcgaagcaactccgtcaaccttcaaagagttcggtcaggtcgtggaggcttcgcgagacggccaggaattcggtccccacgatgctcaactcgacctttcccaaggaactccaaggttctacattatcaagcttgaaaaatgcccgcttaagttttctagtattacacatcatgcaatcgtgactcagtgcctcgggtctatcggtggtcatgtttggtatcttggagtggccaagtcatctgttgttgattcaaatgagatcaaggatgacacaggcaagaagattgtgcagtcacgttctggtcattcatatgtgcctccagccattgaggatgtccaagttttcaagatttcaggttccaaatttcttaagcttaaccggggaacatggcacgccggccctctatttaaggctgctgcaatggacttttacaatctagaactgagcaacacaaatgagactgatcataccacacactactttaagaaggacgatggagtgatgtttgtaattgacgattaa

SEQ ID NO: 26769 - DNA, 3516 bp, Glycine max
  Peptide Sequence Number=SeqID_118454
atggcagaaaagaagaacccagaacaagaagaacaacaccgattcccagttctgacagtgctcaagaacaacgcaatcctcaagaacatcttcatcgtactcgatgaacacgacgaggatcagacggttctgattggacgacaccctaactgcaacatcgtcctcacgcaccccagcgtgagccgcttccacctcaggattcgctccaacccctcttcccgcactctttcactcgttgatttggcttctgtgcagggtacgtgggtgcgtgggaggaagctcgagccaggagtgagtgtagaattgaaggaaggtgacaccttcactgttgggatttccactaggatttatcgtctcagctgggctcctcttacccaattgggtgtcgttgtgccccaacaacatcaaaaagaagatgaacaagaaaacataatcaaggatgagaatttggaacacactgcagaacaagatattccgatgtctgaagacattgtttctgtttgttgtgatgaagaaaggaagatccattctgaagatgaggcattgggagtacccaatggaactgaaacatcatgttttcctacaaactcttgtgttgaaaacataatttgtgactgtcaattatcacccccatacatacaatcacccccttgtgcacaaccggttgatgagcttgataacaccaagaaaattgaagctcgtctcgaagtggagatgcctggagaaactaatttgctttgcacattgagggaatatttgaaacacaacatatgtctgccagttgtggaagcagtccaggggaccaagatgcagcaatttcaagccccacatgatacttttaccggacaaccaccttccttggaaatgcattggtccagctttcaaataaatattgatccttcgtcttttgatgaaaaacatgctgctgcagtgcctgtaatacctacagaatctgaatttggatgcacacatggagatattgacaaggttgaaggtattttaactactgcaccaagaagtttcaattctgagaacacatgtttgatagttgacgaagatatccctgattctgaatttcataaaatggaagttgttgaagaagtttctgtggattcagtacctgatggagaaaaacaagatgaaatgcatgggtcaagctcacctacaaatcttgatcccgcgtttttagatgaaaaacatgttgctgcagtggctataatacctacagaatctgaatttggatgcacatacggagataatgacaaagttgaagatattttaactactggatcaagaacattcaattctgagaacacatgcttgatagttgacaaagatattcctgattctgaatttcatcaaatggaagttgttgaagaaatatctgtggattcagtacctgatgaaaaacatgttgctgcagtggctgtaatacctacagaatctgaatttggatgcacatacggagataatgacaaagttgaagatattttaactactggatcaagaacattcaattctgagaacacatgcttgatagttgacaaagatattcctgattctgaatttcatcaaatggaagttgttgaagaaatatctgtggattcagtacctgatgaagaaaaacaagatgaatgcgatgaagagaacctgaatggtaaatcttgccgtgaggaagggtactctctagatgaagtagttgaagataatggaaacaaatgcattaaaaacatagatcctgcatcttttgatggaaagggcttgactgcagtaactgtaatacccacagaatttgaatttggatgcacactcggagataatgaaaggattgaagatattttagaaatggagtcaagaactatcaattctgagaacacatccttactggatgagaaagctattgctgttaccaaatttcaactagtcaatattgttgaggaaggggggtactcactggatgaagtagttgaagataatggaaacaaatgcattaaaaacatagatcctgcatcttttgatggaaagggcttggctgcagtaactgtaataccctcagaatctgaatttggatgcacactcggagataatgaaaggattgaagatattttagaaatggagtcaagaactatcaattctgagaacacatccttgctagatgagaatgctattgctgttaccaaatttcaagtagtcaatattgttgaagaagttgctatggattcaatatctgatggaaacaaatgcattaaaaacatagatcctgcatcttttgatggaaagggcttggctgcagtaactgtaataccctcagaatctgaatttggatgcacactcggagataatgaaaggattgaagatattttagaaatggagtcaagaactatcaattctgaaaacacatccttgctagatgagaatgctattattgctgttaccaaatttcaagtagtcaatattgttgaagaagttgctatggattcaatatctgatggagaaaaagaagataaatgtgggaaggagttggagtcaaagttgccggcttccctgaatgcgaagtcctgtcacgaacaaggtaagtctgtggctgaaatagctgaagatactggaaaaaaatgtgcaagcagcatctcctccacatcatttcaagtagaatcaccaaattcttcgatgcctcgggaacagacccctcaatctctcactgctgtgacaagatgctctggaggggagttccttgaaaaccatgtcaaaccaacagagaaaagctcagcctttggcagtatctggtcaaggtgtaagcctgctagtgctcccctagttcaagccagaaagagtagatttatgagcacagctaaggttggcactgaagttaaaaggagtaatgagaagaatgttgtcataaataaattaatgccgaaggatctttctgctgtttttgatgaggagaaagaagcattcattctaaataaggaaaatttaagcccaaatacctatcacttgcagtttatgagaaagaaagataagccagaagaaattaaacattccatatcacaaaggtcacccaatttgagctattttagtcccaggatctatttagacaaaagaataagcagtgtttcaaacaaagtgaaccagactccaaaagtagctcaagaatggaagtcacaaagaaagcctcttcaatgtcatatcaacttggtccatgagcaagatatgatggagttaaaaaagaacagagtggaaaaggtagcatccttcccatcactaatgaactcaggagggaaccataaatcagtgactgtttctgctgcaaaaagcattgatgatgtgcctatttgtggacagatttcaaataagtgcactaaaacttctcatactagtagagaacaaaagaggagctgggacatggttgtagacactgcttctcttctgaacaaggagtcaaggaaagctttgcagcttctacaaggcctcaaggggactcgtttaatcattccaagtttgggtaatgagttttag

SEQ ID NO: 26770 - DNA, 273 bp, Glycine max
  Peptide Sequence Number=SeqID_118455
atggccatctcaaaaagcacagtggtcgtagttattctctgcttcatccttatacaagagattgcggtggcaagtgcaattccaggtgcagtaaggctaggaggcaaaaaatgtgcattagggcatgcaatagttgctgcaagaagtgcaggtgcgtgccacccggcacttctgggaaccgagatttgtgcccttgctatgctagactcaccacacatggaggaaagctcaagtgcccatgaaatgatgactcgatcagagacgtctagctaa

SEQ ID NO: 26771 - DNA, 1533 bp, Glycine max
  Peptide Sequence Number=SeqID_118456
atgtacactagcttagagattcttgctgttggaggaaacagaaaaaaaagaatgtcttcaaagtgcaaaaatgtgatgccgcacgagactccgaacgtgaaggagcactacgtgattgggaacaaggtactaggaaaagggcacgtggcgacaacatacgtgtgcactcacaaggagacaaagaagaggtatgcatgcaaaacgatcccaaaggcgaagctgttgaagcaagaggactacgacgaagtgtggagggagattcaggtgatgcaccatttgtcggagcaccccaacgtggccagggtgcagggaagctacgaggacaaattcgccgtgcaccttgtcatggagatgtgccgtggcggcgagcttttctataggatcactcagaagggtcattacagcgagaaagaggctgccaagttgatgaagaccattgttggagtggtcgaggcttgtcactctcttggggtcatccatagggatctcaagcctgagaatttcttgtttgatagccattccgaaactgccaccatcaaggtcatcgatttcggattctctgtcttctacaagccaggacaaacgtttagtgatatagtaggaacttgctactacatggctcctgaggttttacgcaagcaaactggaccagaagtggacgtatggagtgctggtgttatcctatacatcttactgagagggcacccacctttctgggcaaaatccgaatcagcaattttccaagagattttacatggagagattgattttgtttctgatccgtggccaagtatatcagaaagtgctaaggatttgataaaaaaaatgttggataaggaccctgagaaaagaatctctgctcatgaagtcttatatctaacgcctgcagaatcttatataaaatcaggtcacccttggattgttgatgatagtgttgcccctgacaaacctctggaccctgctgttttgacacgcctaaagcatttctcaacaatgaataaacttcagaagatggcattacgtatcatagcagaaagactttcagaggaagaaataggcggattaaaagagttatttaaaatgattgatgaagacaatagtgggacaatcacttttgaggaactcaaggatagtttgaaaagtgtgggctgtgatctcatggaatctgaaattaaatcccttatggaagcggctgatatagacaacaatggaacaatagactatggtgaatttctcgctgctacactgcacttgaataagatggaacgagaagagaatttggttgctgcttttgcctattttgataaagatggtagtggctacatcaccattgaagagattcaacaggcttgtaaagactttggccttggtaatatgcacctggatgagataatcaatgagattgatcaagacaacgatgggagaattaattattcagagtttgcagcaatgatgagaaagggtggtccagatgttggtaggagcagaaaaggcaattatacagcttcaatattggatgtgcttgtggagtga

SEQ ID NO: 26772 - DNA, 1254 bp, Glycine max
  Peptide Sequence Number=SeqID_118457
atgtcgagcgacagcgacgaagacgagctcctccagatggcgctgaaggagcaagcgcagcgagatgtcaactacggcggcaaatcctcctccaattcccgaaagccggtggcaaactacgtccagccgctgaagaaacccgctcctccgccgaaacagtcgcagggcaaaggcagagtcgccgacgacgacgacgattccgaaatcgagatgctcagcatctctagcggcgacgaggacaacgtccaagatccggttgccgcctccaggaccaaagctgccgcagccggaagaccggtgcgcgaagacgatcgcacctgggacggcgaggagcctagtcgctggaagcacgttgacgaggctgagcttgctcgtagggtgcgtgaaatgagggaaacaagatcagcagctgcacctcaaaaatttgtggcttcaaaatttgaaaaagaaggttctgcagtgggtagaaaggggcttacctacctacagtcattccctcgtggcatggaatgtgttgatccactggggttggggatcatagacaacagaacgctaaggttgatcactgagtctgcacatagttctcccaagactgacaaggatattcaggatggcaacttacgtgaaaaattgctgtatttttcggagaacttcgatgcaaagatgttcttatcacggatacacagtaataccagtgctgccgatctggaggctggtgcacttgctttgaaaactgatttcaaaagtcgtactgagcagagaaagcagttggttaaggacaactttgattgctttgtctcttgcaaaacaacaattgatgatattgagtcaaagttaagacaaattgaggatgaccctgaagggtctgggacttcccatttgtttaatattattcaggatgttagtttgcaggctaatcgtgccttgaagcctttatttgagagacaggctcaagcagaaaaaattaggactgtccaaggtatgctacagaggtttcgaacacttttcaacctaccaagtactatccgaggcagcattagcaagggtgaatatgatttggcagtcagggagtacaagaaggccaaatcgattgttctgccctcccatattcaggtaggtatcctaaaacgtgttcttgaagaggttgagaaagtgatgaatgacttcaagactatgcttttcaagtctatggaagatccacaaatagatccaacaaaccacatcatcttgggcatgccactggtagtgggctag

SEQ ID NO: 26773 - DNA, 288 bp, Glycine max
  Peptide Sequence Number=SeqID_118458
atggtatttaaaaccattgaaatgattaagatcaagattatcgagattaaggttgagaagtttgaaattgagatcaatgctcctaattctcttcaaggtgcatctaagaaacaatggaatgatgtcatttttctttcagcttctaccataactaatttgtttggatgtgtgggacagagggcttgtggtacctgctgcccaccattcctcctctgctttgagaaccgtgtgaatggagagtgggcagaagggaaggaagttctcatacagagtcgcacacttacttga

SEQ ID NO: 26774 - DNA, 1194 bp, Glycine max
  Peptide Sequence Number=SeqID_118459
atggcttcttctctctccaccaaaccattctcatcaaccgacgctctctccgccttcgcttctctcaatcccgatctccgatccttctcccccggctacctccgtctctcactccgtcctcgtcttcccaagagacttcagatacgggctgctgggagtatctatggaaatcactttcgtgtttcaacatatggagaatcgcatggaggaggtgttggttgtattattgatggatgtcctcctcaccttcctctctccgaagctgatatgcaattggatcttgacagaaggaggccaggtcagagccgaattacaactcctagaaaggagactgatacatgtaaaatattttcaggagtttctgaaggacttactactggaactccaattcatgtatttgtacccaatactgatcaaagaggacatgactatactgagatggcagtagcttataggccttcccatgcagatgctacctatgacatgaagtatggtgtcagatccgttcagggtggtggtagatcttctgcaagagaaacaattggaagggttgcttctggtgctgttgctaagaaaatccttaaagacttttctggaactgagattcttgcctatgtctctcaagtttataatattgttcttccagaggaccttattgatcatgacactctgactcttgatcagattgagagtaacattgttcgatgtccagacccggaatatgcagagaagatgatatctgcaattgatgctgtgcgagtgagaggtgattctgttggtggtgttgtaacatgcattgtgaggaactgtccacgtggtctcggttcaccagtatttgacaaacttgaagctgaactagctaaagctgctatgtcattgcctgcaaccaagggctttcagtttggtagtgggtttgcaggcacctttttgactgggagtgaacataatgatgagttctatatagatgaacatggaaacacaagaacaagaacaaatcgctctggtgggatacagggtggaatttccaatggggaaatcattaatatgagaatagctttcaagccaacatcaacaattggagtaagtctaatctcttctctttctgtcttcatcactatctcattcactcgtcacacagatactagccacccagatatgttcactgatatctttcactctgcttattcttgttag

SEQ ID NO: 26775 - DNA, 4980 bp, Glycine max
  Peptide Sequence Number=SeqID_118460
atgtgtagtatgtgccgttattgtggtgtgggcttgtcagaatcaaattttgacaacaagaaacagggaaatgagagtagtctaaagttgaatggtaaagtttccattaggccttgcaaatcttgtggagagaagctagagcgagcaaatgcgaaatggcatagtacaagtccttatgcaacaccacttatcagtccaactacgtcattgctaagtactgatagctgtgtctccacttgcagtgagttttcagttgatgtgaactcatgtgataggaatagtcaagaagaaagttcagttgaaggtgttgtggaagagcttgattataagttgaatggttcaccaaaagtgatggaaaacaataacaacaatgagggttacacagtgagagatgtggagattgcacaaggacataactttcaagaagtaaaagctgatttttctgaagaacctactgcatcctctgctgctgaagaagctgaatattctcttcctgatgatttggatgtccaaacttgggaacctcctgagccagaaaacccacaggatgatatggaaaatagtgtgacttgtaatgacgacgatgaagaccagggcctagggattgcaaactggggtgagcctacctctatgagtagttctgagaatgaattaagtgggagctataggttcaaagaggaaaaacaaagagcaatggaagaagtaatgaatgggaaattcaaggcacttgttggtcagcttcttaaatctgtgggagtttcctcttctgatcaatgtgataagagttgggtggacatagttacatctttatcatgggaagctgcttcttttttgaagcctggtgccattggagctaatgcaatgaatcctgatggatatgttaaagtgaagtgcattgctgctggttcccgcagcgaaagtcaactgatcagaggtttggtcttcaaaaaacatgctgctcacaagcatatgcctactaagtataaaaatccaagattattactgatcagcggtgtgcttggccattctatcaatgggctgtcctcatttgactccatggaccaggagaaagatgatctgaaatctaaaatggatcgtatagaaatgtgtcatccaaatgttatattagtggagaaaactgtttctcgtgatatacaagagtcaattttggcaaagggaatgacacttgtgcttgatatgaagcttcatcgtctagaaagagttgcatgttgtactggttcaccaattttatcatgcgataatttgaacggtcaaaagctaagacactgtgactttatctattttgagaagtttgtggaggaacatgatgctgttggtgaaggaggaaagaagcccatcaagactttgatgttcattgagggctgtcctacacgtttgggctgcacgcatgctatgattatgaagcatcaatatagatgtggataccatactgcacttacagctcaagtctcaatgagttttctagttatattcctagtcaatgttggacatcttaacacatgcctcacatccaggattggacatctagagcctcaagttttgcagattttactgaaaggtacacacagtgatgaactgaagaggatcaaatgtgtcatgcggtgtgcagttgtcatggcatatcatttaatccttgaaacctcctttcttgttgatcagaaagcaatgttctctaccattcctgctgtgagtgtagcagatatcttgccaactgataaaaaatcctgtgatttagcatccactaattcaagcattccatctcttgagtattctgctgagaatggaatagttagtactgatattcccatatgcaatggacttcatgaaaacaacatcaatggtttaaacctaggatcagaggagttttctccattctcttgtgaaccatataatccagccgtattttctgggttctcagctatttcatcttctcttaaaaaggttatgggggacagttttccctttgcatcttctgctccttatcaatctttatcagcttactttggcttcaatggaaggaaacctgacggtcaggttaatgagtcgatttctgttttaaactctctggaggctgatgaaaataccatgatggaagcaaaaagtcattctaatgaagtgaagttacttaatggtggacaatccctgtcttcacctgtgcatttagattccaatggggatataagtaaatatgatgaaaataatagaaaagaactccaacgtaaagatgatatcaatgcagtgttggattctcagagtattttggtcttgatgtctagatggaatgccttaagagggactgtatgccagcaaagtcatttttcacatattatgttctacaagaattttgatattccacttggaaaatttctggaggataacttactcaatcagacaagactttgtgatgcctgtcaagaattgccagatgcccacttttattattatgctcatcacagtaagcagcttactatccaagttaaatgcttgccccaggaaaaaagtttgcctggggaggcagaagggaaaatttggatgtggagccgttgtcgaaaatgcaagtctggttctacaaagagagtgctgatatccaccactgcccgtagtttatcatttggaaaatttttggagctcagcctttcttactattcttctagcagaaaattgagttgtggacattctcttgatagggattttctctatttctttggattaggtcacatggttgcaatgttcagatattcttctgttgccacatattctgtgtgtatgcctcctcgaaagctggagttctgtggtgcaataagacaagagtggcttttgaaagagactcagaatgtgtatatgaaaggcataacattattcaccgaagttgcaaactgtttgaagacaatacaatttgatggccttggaggatcaattagagatttgtctgaagttgagaagatgttcaagcaagagcaagaagaattcgaggcaaacatcaagactgctgttgctaaaaaaggggatccagaccaggctgccttcaaacttctcagtttaaaccgattgatgtgggatcttttgcttcaatcctatgtgtgggtccggcgcttgtacccattacactcacctgatggtttaagacttgaatctgatgtctctgagaaagttatgcatgaacatgattattcaaaggtggaaggtattgctagtagagaaactgggtctatgggtaattttatggaagatggggatgccaatgtaaaaattatgtttggctcatctgtgcaagtaaatgaactaccgataaaggaaattcctatcagtggaccttttctagagtgcaatgaactggctgatccatctaacgcacagaatgagaggataccgattgttgatgatttgagatcaagaagatcttctgaccaaaacttgaatttgagtctggatgttataccaactcatcttgaagtaggtgaaaactctccagtttctacagatattcaaactaatcatttggttgctgatttaaaggtattaaacaaaatttcttcctttcattcaccaatttccaacatgctggattcaaatgattggttctggaagccatttgctgacattcgacagataggcataaaggaattccagaaaagattattgccaaaatttgaatttgtaagcagctctattgctgaatatatacccacagcccatcaattaatcactgaggaaggtacaaggttgcatatccctctcaagactgacaatcatgttgtgtctgacttcgagggtgaaccctcaagcataattgcttgtgcactggccttattgaaagatgcatatgaggtgtcagaaattgatgatgaggatgagagaaacgaaagtggaataacttcaaactcaacagaatgtttgcatggcttgaccaatggtgctgccttaacttcttcacactcattttcaagaagttcttcagattcagattctgtgcattctgcaggaagcacttcttcagaagagtcacgagcctctcgtgctacagaaaaccatagcatagagattgctatgggttatgctaaatcacttgggagggaaaaatattcagtgatatgtcattattttaagcagttccgtgaacttagaaattggtgttgcctatctgagcttgattttattgcttctttaagccgctgtaggaattgggatgccaaaggtggaaaaagcaagtcctattttgcaaaaacacttgatgacagattcatcataaaggagattaagaagacagaacttgattcatttttggggttttcttctctgtatttcaaacacgtgagagaatcatttgagtctggcagccaaacttgtcttgcaaaagtcttggggatatatcaggttactaaaagacacgttaaaagtggaaaagaggttaaatatgaccccctcatggtgatggaaaatcttacctacaatagaaatattactcgccagtatgatcttaaaggtgctctttatgcccggtacaattctgctgctgatggagctggagatgttctgttggatcagaactttgtgaatgacatgaactcgtccccattatatgtcagtcttaaagcaaagcgttatcttcaacgtgctgtttggaatgacacatcttttctgaattctatcaatgtgatggattactccttgcttgttggagtagattctcagaagagcgagcttgtctgtgggatcattgattatctcaggcagtatacgtgggataaacatcttgagacatggatgaagtcttcacttgttgtgccaaaaaatgtgttgccgactgtaatatctcctaaagaatacaaaaagaggttcagaaagtttatgtctacatattttttgagtgttccagatcactggtgttcccagaaatcctccaatccttgcaaactttgtggctcaggggaagatgacccttctcagcaaaagccctag

SEQ ID NO: 26776 - DNA, 240 bp, Glycine max
  Peptide Sequence Number=SeqID_118461
atgcggcgcaacaacatcaaggttgggtataggtggtgtccgacaatgctggtaggggtcatggcgacgttgttgatggcgcaatcgaaaaagtgtttggtcgagaaaagttgcgtgcaatcagatttggaggtggaggcagcatgcaacgttggaggagggtggcaagtggtgcaacggcggtggtggtcgttgatggtgatggtgtcagcatggatgttggttggtagtattgtttga

SEQ ID NO: 26777 - DNA, 591 bp, Glycine max
  Peptide Sequence Number=SeqID_118462
atggaaaacctttcaccattgatttacaaaaaccccattagaagaacttctaggcgatctacaatgtatcttggtgtgagaaaaaggccatggggaagatatgctgctgagattaggaacccatacaccaaagagagacactggctaggcacatttgacactgctgaagaggctgctatagcttatgatctttcatctatcaagatttgtggcattaatgctcgaactaattttcactacccttttgtgtctcttccaccacttcctatgtcgtcattgcctcctccaccgccaccgccgaccccagagttggatccaagtgttgaagtttgtctagagatgatgaatgctgcttcttacgatggtgatgatgaatctcttgttattgcttccattttgcaaagtttttctaattctggtggatctgcagcatctggggagcttttgtgggttggagagtttgtaataggatcatctgcagaaggagtttgtggcagtgagcttttctcttgtttattggcctgtgaacacattgtgttttcagactcatcaatacctacacacttcaagagagccctgagtgcttgttga

SEQ ID NO: 26778 - DNA, 1470 bp, Glycine max
  Peptide Sequence Number=SeqID_118463
atggcttataggcaatggttctttttctgtcacagagataggaagtatcctaatggtggaaggtctaaccgagcaaccagacgtgggtattggaaagcaacgggaaaggatcgtaacgtgatatgcaattctaggtcagttggagtgaaaaagaccctggttttctatgctggcagagctcctagtggtgagcggactgattgggttatgcatgaatataccttggatgaagaggagcttaagagatgcctgggtgttaaggactattatgcactttacaaggtttacaagaaaagtggacctggtccaaaaaatggtgaacagtatggcgcaccatttaatgaagaacagtgggcagatgatgacatagtagattttaatatcaactcagctgatcaggaggctccaaatgatgttgataatggtaatgtactgcagcctttgcttgatgatgaaatcgacaacatcattaggggaattttggatgatgagcttgtccttgatcagcagcatgtgaatggttatcctgactttcctcaggttgttagtgaagaaacacaaagtactgttgtggatcagttctctgaggctgtgatgttccctgagccagtcagaatcacacagcctagcaaccaattttttgatgcacagcctagctttgacttcaatcagccagttacttctcatttgcatgtttctgaagcatctgaggtcacttctgcttccagcattaaagcaaaggagcttgattttaatgaggatggcttcttggaaattaatgatctcattgatactgaacctatattggcaaatatggaaaatcctgtggagtaccagcagtttgaagatgggttaagtgaacttgatctgttccaagatgcacagatgtttcttcgtgacctggggccaattattcacgaaacagattcacatgcatatacaaatgcatttgtcagcagcaatattgaaagtcaaagttaccagttgctgccaaatccagaggatgccaatcaaactgtcggtgaattctggatgcacggtgaaagaaacaccccaagtgcatcagaaggctttgttgattctttctcgctatcatccccaggtgttgtatatgaatctgttggctttcctacggaaggcaataacaatcaaagtagcactgtggaagatgttgctacaagtagcttctcctctgctctctgggcctttgttgagtcaatacctacaactcctgcatcagctgctgaaagtgctttggtgaaccgagcattgaatcgaatgtctagcttcagcaggttgaagatcaagcacacaaacattgctgcagcaggtaaagacactgcaactatgaagagagcaggcagaaagggacttccattccttttcttccctattattattgctttatgtgctttttgttgggtttttgttggaaacttaagactattggggagatgtgtctctccttga

SEQ ID NO: 26779 - DNA, 528 bp, Glycine max
  Peptide Sequence Number=SeqID_118464
atgaattccaatgccacttcaatgcataaagtaatacaggaagttggagacaacagaacggttgaaggaaacgaagatgcttcttctgaagatggagattccaaagtgtatcttcctgaccttggaaagggcttgggttgtgtaattcaaacaagggacggaggctacttggcatccatgaaccctttggatgttgctatggctagaaaagaagctccaaagctagctatgcagatgtcaaggccttttgtgttggcatcacgccaatccttgacagggttcaagttgtttcagaaattggctggcattgaatttgatgaactcaactccaaggttttgcccttaatgcccatagatgaaatgataggcaaaactgcaggacatgctgcttttgaaggcattgctaatgcaatcatacaaggtaggaacaaggaaggatccagttccagtgctgctagaatattttcttacttgaaaagcatgggaagtgccatgagttcaggaaggagagagagaataacaacatga

SEQ ID NO: 26780 - DNA, 1740 bp, Glycine max
  Peptide Sequence Number=SeqID_118465
atgccctgcaaacttgcttctccattgtggctcttaccagaggaactcatctcggagatcctctttagggttccggtgagatcccttctgcaattcagatgcgtctgcaaatcatggaaaaccctaatctcccatccccaattcgccatgcaccgccttcgtacctcaatcgcccatccaaacattgcccaccaacaattgacctcttccaaactcgtatcatactctgtgcattcactgctgcaaaactcttcaatccctgaacaaggccattattactcctcgacgagtcacaagtaccgcattcttggttcctgcaatggcttattgtgtttgtctgatattaacttaacccatgtcgtattgtgcaacccttccatcagatcgcaatccaaaaaattccaaatcatggtttcgcctcggagttgtttcacttactattgctttggctatgatcacgtgaacgacaagtacaagttgctggttgttgtgggtagttttcaaaaatccgtcaccaaattatatacctttggtgcagattgttattgtagcaaggtgattcagaatttcccgtgtcatcccaccaggaagccagggaagtttgtgagtggcactcttaattggatcgcgaaaagagacctaaacaacgacgatcaacaaaggatgattctttccttcgatttggcgacggagacctatggcgaagtgttgctgcctgatggggaccatgacaagatttgtagtcctacattggatgtcttgcgtgactgtctttgtgtttgtttctctgactgtagaaaaggtcattggattgtgtggctcatgaaggagtatggggttccaaattcttggactaaattggtgaccatcccttacattaagcttgggatttgtagatggtctcacttgtttgtgccattgtgcatttcagaaaatggtgttcttctcctcaagactacatcttccaaattagttatttacaatttgaatgatggtaggatggactatcttaggattgtggatgaacttgggtttgatattcatgtttatcatgaaagaacccttctccgtaagagtgctcactcgtctctatgttcacccctctctcctctctccataccagcactcactcctctctccataccagcgctcactcctctctctcggtctctcctcagaggttccaagaactcctctctccagtaccagcgctcactcatctctctgcggggagaccagtcagggtcacgatgttttgcgagaatgctccaaccatatgagatcagcataggcttaaaggagcactcaaacccggtggcccccaaggcctacactctgaagagtccgtcaggtcctctccctcctgattcagcgatagccacatctctagcagttcccggaaattctttcaattattcatccgattgctccgatagaattcccaaacgtaagagagacggagaagagattgaaacctccacttgtactgtctttcatacgattcctttttctccctccacgaatattatctcgcaaatcccaacggtggaagcctctgggtttctgcgggaaagaaaaaggctacaatgcgaagggtttttctctcagttcagacatgatatcgaaattcccaacggtgagaatgctcggaattgtgttgtgaacatgatactcaaatttcacgacgatccaacggtgaacgggtttgagatcgtcatttttctgagactggtttggtag

SEQ ID NO: 26781 - DNA, 303 bp, Glycine max
  Peptide Sequence Number=SeqID_118466
atgagtgacactcttaattggatagctaagacaggtaatcaattgaggattctttccttcgatctggggacggagacatttggcaaagtgttgctgcctgaatgcgacgacggtgacaatgttggcagtccggagctaaatgctgtgtggaattgtctgtgtttctttctatttgcaatttcccacttagttgtgtataactcagatgataggttgtgttatgttacgattgtgggccccgatctgctaacttaccatgaagtttgttgtcatactcacggctacgttgcatcttcctcttag

SEQ ID NO: 26782 - DNA, 987 bp, Glycine max
  Peptide Sequence Number=SeqID_118467
atgggggattcacaagaaaataacaaaggaaagagtagagacaaagataattatgtatcttggactatggaagataccaatgagttgttgcacctcttggtggatgctatgaataggggattgcgtgatgccaatgggtcacttagcaaacaaaatgtagaacgaataatacttcctcaactcaatgcaaaaactaaattccctaaaacttatagtcattatttgagtcggatgaagtggtttcgaaaccagtataacatgatgtcaacccttatgcgcaacaactctggctttggatgggacccaattggaaaaactttcactgctcatgaggattctcacccaagtcacagcaaacttcgaggaaaaagtatggttgattatgagtatttgaagatcgttgttgggggtggagtttctagcgggaataattctatatcagtcgatccagatgatactgatgcaacaacttttgagccagaaaataaaactgttgggatagaagaattttcatatgatcctaatagtgatacattcataacaccaaataactatgaaccagcatatcagcctccatcaccaaaccaaccaagtccaccatcccacccccctttagattcagaggttcccatagaaaaacaaaactgtcacaagcgaaggagatccgagtatggagggagttcaagcgctgttgggatcaacaatcaaggcaacgttctggaaaatctttctgttggcattgagactattgctgtgaattttgaaaaaatatccaacatgatggagaaaagagaaaaagatagagatagagatagagagctcgagggtattatttgggatgttataaaagaaattccaaatttggatgacataacgcgtttcaagacagctgaattgttaaatactaaagcaaaaaaggattttttcttgaagatgtcaccggaagaacgctcatcttggataaactttaagttagggaataattaa

SEQ ID NO: 26783 - DNA, 1470 bp, Glycine max
  Peptide Sequence Number=SeqID_118468
atggcttctttctgcatgcctgtgagagttggtctcttttgggcaagagtggttatgcgcaaatggcttaacatggctagtaacgagcctgattacaccgctgaccctgatgatgataatgaggatgaccctgaaagtgactcagataatgaagtttgtgttggaacatggaatgttggaggaaagcttccatctgatgacctagatattgatgattggttaggcattaacgagccagctgatatctatgttcttggtcttcaggagattgtaccattaaatcctggtaacatttttggtgctgaagacactcggccggtaccgaaatgggaaaacattattcgagatacactgaatagagttagaccaaaagcaccaaagatgaaatccttcagcgatcccccatcaccatcaaaatttaagccatcagatgatgcgccagacatagaagaagaaatattacttgaaagtgatggtgatattggtgaggaagtccatccgttggatgaagaacacaatgtttatgatggaggtgcagataaaccaaccacatatgaagaagcctcgaatactaattttcaggcttcagatgctgctgatattgccaacacagaagaaccaataggcaatgatttaaagagacagttttctgatggaaagaggttgagtaggctgaattgtttccgtgacgaaaatttgcccaaaaaaacagaaacatcatcttctcaacaggccagtaagctatccagaatgattagtagttctgataggattggattgagctggccagagccaccactacatctgctatctcagggaccattggatagaccaacttcttttaaatctgtcagatccttttcagcatcaaagtctttcagaacatgtcagaccttcaaaaaaaccatagatgacataggtttgcttgctgaaattgaccttgaagctttaatgaagcggaaaagaagatcatcatatgtaaggatagtgagcaaacagatggttgggattttcatcaccatatgggttcgtcgtagcttgcgtaaacatattcagaatttgaaggtgtcaactgttggggttggtgttatgggctatattggtaacaagctttcaaaagagctcgagaaaggtgtgtttggtggatggtcagaaggcaagttaaattttccaccaacgtataagtatgagaataattcagataaatactatggagaggacccaaaggttgggaggcgcacaccttcatggtgcgatcgtattctctcctatggcatgggaatgagattactaagatatggaaggactgaactcaggttttcagaccacagaccagtgactgccacatacatggctgaggttgaggtgttttctccaaggaagttgcagaaagccctgacttttactgatgcagagattgaaaatgaagaagtcatggcaactttaggtagctttaatttagccaaataa

SEQ ID NO: 26784 - DNA, 1026 bp, Glycine max
  Peptide Sequence Number=SeqID_118469
atggaactattgaaagggtgcggatcacaggaagagataatggaagtgctttctgcagtggcttcggatttgggggatgtgatcgatgatgtgaacaccttgcaggtgattccactgaatggtgcattgaccaatgaagtttttcagataaactggccaaccaaaaatgatggtgaggtcagaaaggttctgattcgtttatatggggaaggtgttgaagttttctttgacagggaagaagaaattcgaacctttgagtgcatttcaaagcatggtcagggtccacgccttcttggccgattcacctctggcagagttgaggagtttattcatgccagaactctatcagctgctgacctccgtgaccctgaagtatctgctttgatagcatctaagatgagagagttccataatcttcatatgcctggtgcaaagaaggctcagatttggcacagagtgaggaagtggcttggtcaagccaaaagtctgtgctccccaaaggatgcaaaaaaatttggcttggacaatctggatgaggaaataaatatcctggagaagaagttatctgaaggatatcaagagattgttttttgtcacaatgacttacaatatggtaacataatgatggatgaagagacaagattaatcactataattgactacgaatatgccggttataatcctattgcatatgacctggccaatcatttctgtgaaatggtggcagattaccacagtgacacacctcatgttcttgactacaagaaatatccaggcaataaaccaagcaatgctaaagtgaaccagttagtgaaagctgcagaaaaatacactcttgcaaaccatctattttggggtttgtggggacttatttcgagttatgtgaacaaaattgactttgactataaggagtatggaaggcagaggtttcagcaatactggataaggaagcctactttattggactcaccaagcatcgtttccctagatgaaactgtgaatggattgctgtcatccttcacgtga

SEQ ID NO: 26785 - DNA, 249 bp, Glycine max
  Peptide Sequence Number=SeqID_118470
atgccggaatcggagatagggacgccgacggcggcgtcggtgccggcgacgccggatactccgggaggaccgttattcacgtcgctgcgagttgactcactgtcacatgaacgtgagtcgttctcaatggctgggtgcaagtgtctgccgaccaagggccatagctgcttcactgatttctcagttggtgttccacttcccaatgtttctctcactcaaaagtcatacgaaattcacgcggagggttaa

SEQ ID NO: 26786 - DNA, 2682 bp, Glycine max
  Peptide Sequence Number=SeqID_118471
atggtgctggaatcttggaatgtcaacttgttgggtgagcctttagcattaaattttgttgcatctatggctgacagcttagccatggagttaaggcaaaaggaatgtaatgagccagtcaagctgattaaagttatatggagtcgacccttgtccctcccaccactgaagctactagacctcagtttgcatgcagggcttcctagaaattggatgcatttgcatttcttgcgtgcaatagggactgcaatgtccatgagagctggtatagccgctgatgctgcagctgctcttctttttcgtatactttcccagcctgcattgctttttcctcctcttagacaagttgacggagttgaagttcaacatgaacctttgggtggttatatttcttcctataaaaagcagattctttccgtacacttgagatctaaaacatttgttgttgatcagatagaagttcctgcagctgaagcctctattgaagctactgcccaaggcattgcatcaatgctttgtgcccatggtccagaggttgaatggagaatttgcaccatttgggaagctgcttatggcctgattcctacaagttcctcagctgttgatcttccggaaattatagttgcaaccccactacagcctcccgtgctgtcatggaatttgtacatacccctattgaaggtcctggaatatcttcctcgtggaagcccatcagaggcatgtcttatgaaaatatttgctgctacagtggaagctattcttcagaggacatttccacctgagtccactagagaacaaaacagaaaatcaaaatacctagctggcataggctttggctctgcctcaaaaaacctggccgtggcagaacttcgtacaatggttcattcactcttcttagaatcatgtgcatctgtagagcttgcttcacgcctactttttgttgtcttaactgtctgcgtcagtcatgaagctcaattcagtggaagcaagaggccaagaggtgaagataactattcatctgaggatatcattgaggacttacaaacatctgaaaaccagaaagaatcaaaaaataggaaattgaagaagcaaggtcctgttgcagcatttgattcttatgttctggctgccgtttgtgcccttgcctgtgagcttcagttgttccctttgatttcacgggggaataatcatttagcttccaataaggtgcaagatatagccaagcctgttagactaaatggatcctcccatgagttgcggaatggcttagattcagcagtacgtcatactcacagaattttagcaattttagaggcactattttcattgaagccatcttctgttggaaccccttggagttacagctcaaatgagatagttgcagctgctatggttgctgcccatgtttctgaactatttagaaggtcaaaagcttgcatgcatgctctgtctgttctgattcgttgcaaatgggacaatgaaattcactccagggcatcatcattgtataatctcatagatattcacagcaaagctgttgcatctatagtgaacaaggcagagccattagaagcaaccttaattcatgcacctattcggaaggattcccttgtttgtgttggtgttaaaaggcagaatcagtgtgaaagtagtagctgttttgatgctgggcggacatctgttgtaccttcagaagattcattcccatcaaaacttgaccataattctaacaaaaccccatgtccaaagggtgcatcagattataccttgggtaaaggtgtcacaggtttctcattggatgcgtctgatctagccaacttcctcacaatggacaggcatataggattgaattgcaatggacaaatttttctaagatccacgctagcagagaaacaagaattatgtttttctgtagtttcactgctatggcacaagctgattgcatctcctgaaacacaaccttgtgcagaaagcacttctgcccaacagggctggagacaggttgttgatgcattatgcaacgttgtatcagcctcaccaacaaaagcagctacagcagttgtacttcaggcggagcgggaattgcagccctggattgccaaggatgatgattcaggtcagaagatgtggagaatcaatcagcggattgtaaaattgattgtggaacttatgaggaatcatgagactgcagaatcattggtaattgtggcaagttcatcagatttactactgcgagccacagatgggatgctggttgatggagaagcttgcactttaccacagctggagctattggaagcaacagctagagcagttcagccagtgctcgagtttggagaatctggattggctgtggcagatggcctttcaaaccttttaaagtgtcgcctctcagctacaattagatgtctttctcatccaagtgcacatgtccgagctctgagtatatcagttcttcgtgacattttgcatactggttcaatcagatgtagtcctaaacctcggagattaaatggcacccacaacccttcttatcaatacttcaatttggatgccgttgactggcaagctgacatagaaaaatgcttgacttgggaagctcacagccgactttcaaacggattgtctattaactttcttgatatcgctgccaaagagttaggctgtactatttccatgtga

SEQ ID NO: 26787 - DNA, 576 bp, Glycine max
  Peptide Sequence Number=SeqID_118472
atgggcctggaacttagagtccaacaagatgttgctggcttttatgtcgcggtgaatgacgggcttgtcaaggccgtggaggtaggaaagcccatgggccacgccacggatgatgttgacacgtgtgggccagggaagtggggagagggagagagagagatcgggctcgtggagccactggtcgagggtttccatctcggcggtgaactcgcggaagccttggaaggcgtcaggggagagtttttttactgcgacggtggcgccgctggagaggcgggccttgtagacgaggccgaagctgccgtcgccgacgatgaggtgaggggagaagttgtcggtggcgcgggcgagctcgtcccaggagatcttgatgaggttggggtcggaggaccagctggcgtccacggcggagagggaggaggaggcttcgcggtggggggcggggcgggttcggatatgggaggagcgggcccgggtcttggtggagttgcggtggtgctggcagaggaggatggcggcggcgagaaggagggtgaccacgaagaagctggcgatagaggcgacgacggcttgtaa

SEQ ID NO: 26788 - DNA, 198 bp, Glycine max
  Peptide Sequence Number=SeqID_118473
atgaaagctaaggacccagttgatatggctgagcatggacaggttcagcccgatcatgggcataagttttggcaagtatattctagacagggcaggaagggaatctatcctagactcatagttggttatggggagagagaacctatcacgttgggaggagaatatagagaaattgttaggaaccaagaattgaaatga

SEQ ID NO: 26789 - DNA, 198 bp, Glycine max
  Peptide Sequence Number=SeqID_118474
atggggaggaagatgaaggtggaattggtggagataggtagggggaaaaggagagaaagggacataaagagaggaggagagaattgtttagaggtagaaggggatggagagaggaaggatgtggggttgtggttgcaccctgaagccaagggttcccccccactaaatatagacaccaacacaaggagagctagctaa

SEQ ID NO: 26790 - DNA, 144 bp, Glycine max
  Peptide Sequence Number=SeqID_118475
atgtcacttctcttaggggctatttacaagaaaggaggagagcaacttaggtccattttcacaatggaacataacaggaacttacaaaggttcatagtgtatagacggcagcagaagcttattcagccccttctactgttctaa

SEQ ID NO: 26791 - DNA, 298 bp, Glycine max
  Peptide Sequence Number=SeqID_118476
atggagtggtggtagattagaatataggaccacacctcatggtgacttggtcggatataggtctcgtatagatcatatggagagtcatgagctacagtttggactacaacaagatatctctattgaccccatgaatcttgatctacttcaccaaattgacatgcgaggcaatcattacattgattggatggaataccatgcagagtggattaatatctggaaaaacaaacacagtgatgttttagctgggcaatggattgaaggaatagtgacacatacactagcgtacatggaatga

SEQ ID NO: 26792 - DNA, 223 bp, Glycine max
  Peptide Sequence Number=SeqID_118477
gtgccccagtgggcttctgttttctatcagctgtccctccctgttcaagctacctgacgggggtggtgcgtaacggcaaaaagcaccgccggaccatcagcgctggcaagtgtagcggggcgatcggtgcgggcctcttcgctattacgccagctggcgaaagggggatgtgctgcaaggcgattaagttgggtaacgccagggttttcccagtcacgacgtt

SEQ ID NO: 26793 - DNA, 351 bp, Glycine max
  Peptide Sequence Number=SeqID_118478
atggtttttcacttaaggcttgtagtgagcttcaaaacaaggaaagggaaacaaggctcaaaagggctatcaaaggaattaatcaaggaagcatcaacgagaatcaagccaagactattgtgcaagcaatcaatggggcaaaacacaccaaaaatttatgatgatggatggctcaaattctcacaaaggtgccttgctaaaatctcttataaagcgcctgtagaatcctgcatgaccaagaaaagatcgcatctctcgcacgcaagaggggccgaaagacatcctcctataggcaaaagtgccgaaggggcaggtgaatgtggttttttccctgatcctcaggagcaatag

SEQ ID NO: 26794 - DNA, 243 bp, Glycine max
  Peptide Sequence Number=SeqID_118479
atggcgaagccggtggtgaacatctccggcaagacgatgagacgcggccggcgatccggctattgccagcaacgcgtcgaaggcggccagattggcgaggccgtcgcgccaggccgggaaagctgcatccagcgtggcgcctgttgctccgaagcacagccggatcaatcgccttatggggtgataaggatcggcacaaaagaccgacagcggaatggccgccacgcccacgtgctcggttaa

SEQ ID NO: 26795 - DNA, 654 bp, Glycine max
  Peptide Sequence Number=SeqID_118480
atgttggatatctcgcaattcgatcagattaacccaccggcgcgtctgctgatggggccggggccgatcaacgccgatccgcgcgtgctgcgcgccatgtcgagtcagctgatcggccagtacgatccggcgatgaccggttacatgaatcaggttatggcgctgtatcgtgcgctgttccgcaccgaaaaccgctggacgatgctggtggacggcacctcgcgcgccggcatcgaagcgctgctggtttccgctattcggccgggcgataaggtgctggtgccggtcttcggccgcttcgggcatctgctgtgcgagattgcccgccgctgccgcgccgaggtgcacacgattgaggcgccgtggggcgaggtgttcagcgccgatcgcatcgaagacgcgattaagcgagtgcacccgcgcctgctgctgacggtgcagggcgatacctccaccaccatgctgcagccgctgcatgaggatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 26796 - DNA, 591 bp, Glycine max
  Peptide Sequence Number=SeqID_118481
tgcgtcgggtgatgctgccaacttactgattgcagtgtatgatggtgtttttgaaggtgctccagtggcttctgttttcttatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaaatactttaacacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 26797 - DNA, 251 bp, Glycine max
  Peptide Sequence Number=SeqID_118482
gcccacttgggccctccagaatattcctccagaaggctgttgcttctggaggaagcaacctggctcgcctgggcgagctgggcggcaaccacctcccctattttgctataaataggggaggaagtgaagaagaaaaggccgaggcgcttccgaaacgtttccgtaacgttttccgtgaggaatttcgcaaaggtttcaaccgttcttcgacgttcttcattcgttcttcatcgatcttcgatcttcaacgg

SEQ ID NO: 26798 - DNA, 843 bp, Glycine max
  Peptide Sequence Number=SeqID_118483
gtgaggcatgcttactcgctagaaagccaccgttcatgcacagagaaaggagaggcaaattgggaccgactcttagcaaacaaagaaggagcgtcggtcaactggttccctcgatggaaagaaggaagaaccagggttcttatttcgtgcagaggatttccgaatgttcccttgatggggacaaggggttgcgtcagttacaatcccgttcttgctataaggcaaattggctaccctatgagagggacatcgctagaggaagagctcgcgcatgtccacaaggcatgggaggtggtgcaaaagaaggacaaagaactcaggggcagtaacaatgggtccattggtggctaccgaaggtggttgaaagcccacgtgcaaggtttggattggttcccgagtttgagaaccgctaaaagggaggaagttgaggcaccggaggaagacgaagaggtgcaggcccttacggcagaactcgagcaagcccaaacagtcaaagacaggttcaaatcagcagctcttaaaatccgaaaggagaatgccgaactaaaagatataaatatagctaccaccaggccttggaacaagagaccaaaggactccaacaacgagcttaagctccggagagaggaaatggaccaatcacgagtagacagtttgatcttgaaagatgagttgaagaccaacatgctagccatcgtcagtagataccaagaagaactaaatctagccacggcccacgaacatagagtggcggacgagtatgcccaagtgtacgcggaaaaggaggctagaggaagggtgatcgactcgctacatcaagaggcaacaatgtggatggactga

SEQ ID NO: 26799 - DNA, 174 bp, Glycine max
  Peptide Sequence Number=SeqID_118484
atgactggacagccccttttgagcttatgtgtgacatcgaaaattaagcatggggctaaacctgtaagacaggcacagagaaatgataatcccggtgatatcattgatgtagtgaagaaggaggttgattccgatggactcgggtgccagatacagttggagagtactcgctga

SEQ ID NO: 26800 - DNA, 1145 bp, Glycine max
  Peptide Sequence Number=SeqID_118485
atgatctggaacagtctcgccctggcgggcttggtttcgatgatgcgacgcccaacggaccggcgtgccgacctgctgggtagcgacgagtcgcgagggagacagctgaactgtccctgcagcggcttgggggcgtggcgcagccgacaggccagcgtggccggcgtagcgcgcgtcggcgaaacgctggctgagtgcgagcagggccgggtcggggcgctgccggtgtacccgctgtgcccagtcctgtgcggtttcgtgcggttcacgggccaggccgaggcgggcgtagcgccgtccgagccggtgccaggcgcgcagcagcggctcgcgttcgcgctcgccacgggccagcagccaggccatccacgccagcgccagcagtgcggccaccacgaagccagcgaccagctgcccggggcccagatcgtccagcccgaacggcttgagcagctgctgctggcggcgcgcatcgaaggacagcaccagatcgttccagccgcggcgcagccagtcgcccatctggcccagctgcagccaacgctgctgcagtggtgtgtccgtgccggcctgcaggcgatcatccagggtgtccaggatgcgttccggtgccacggctgcggtcgggtcaacccggacccagccgcgctgcggcagccatacctcggcccaggcgtgggcatccatccgccgcaccacccagtagtcgccgatgcggttgcgggtgccaccagcgaaaccggtcaccacccgcgccgggacgccggcgttgcgcatcagcaccacgaaggccgagctgaagtgttcacagaagccggccttgtagccgaacaggaactcgtcgatcgggtcgcgccctgccgcaggggtatccagcgtgtacgagaaatcggtggtgatccactgcagcgcgcggcgcacgatggcctcgtcatcgctgccagcgtcctgccgccattgctgcgccagcgtggcggtgcgcgggttgaagccggccggcagctgcaacgtcgcgcggcgcagatagggcgacagcgtgctgtcgaagcgcagtggcggggccgaatgcaatcgccagcggctgagcgaggccagcgggcgttcgctgctcaggctcatgtccgcatccagcacgctgcccgcag

SEQ ID NO: 26801 - DNA, 597 bp, Glycine max
  Peptide Sequence Number=SeqID_118486
atgttcctttacccacctgatgaggtttccttagtggggcagacacttcacaccttccttgcttggccgacacatctggtcaagtctttatcacagcaggtagttgtgtctcctgcaaaaccacctccaaagcccgatgatccactttatctgatgacattgaccatcccagagcttttctcgaggccttatcaggttagatgggatgccaccgtgtttggggtctttaatctagatttccccctatacataaaacacgaagacctctccgaaatcgcacacggtggtcaatgtctcagcatatcagtgttacagttgtggattttcggacactggcagatggtggtcatcctgcccaaggaacacctagttgtctggttttgttcattgcataataggccagacaactaccttaaggggattattaatagtgctttaaaaggtcttgatgatgctccacagcctaaatcaaaggctcctgctaggtggattgtcgtcaagtgtaatagacaaaaaggaagtactgagtgcagctactatgtgatgcactggatgtccaccatcattttaggaacttttaggaataattgggaagcg

SEQ ID NO: 26802 - DNA, 123 bp, Glycine max
  Peptide Sequence Number=SeqID_118487
atgactgaagcgcgtcaaaagggggtacggaaaccaaataggggaggagcttgccacccagctcgcccaggtgtgccaggttgcttccttcagaagcaaccgccttctggaggaagaatctga

SEQ ID NO: 26803 - DNA, 271 bp, Glycine max
  Peptide Sequence Number=SeqID_118488
atgttagctatcatcaccaagtaccaagaagaactaaatctagccacggcccacaagcatagagtggcggacgagtatgcccaagtgtacgcagaaaaggaggctagaggaagggtgatcgactcattacatcaagaggtaacgatgtggatggaccgattcgctcttaccttgaacgggagtcaagagcttccccgattgctagccaaggccaaggcaatggcggacacctgctccgcccccgaggagacccacggacttctcgactatt

SEQ ID NO: 26804 - DNA, 333 bp, Glycine max
  Peptide Sequence Number=SeqID_118489
gttgctggttgtgttatatgtggtggagcacatgattctggttgttgcattcccacagaagatacaacacatgaagtgaactatatggggaaccagccaagaccaaactttaatgcagaccgaccgttaagcagctttggagccaacacagagaagaaccctaaggaggagtgcaaggctgttatgactagtagcaaaatggtgagcataaatgaaggagagaagaggataggtgaagaaaaacaacagctggtgactgagccagcaattgacccagtggtggaacctttgagtgagactgaggaaaaagtggaagtagaagatgatcaatag

SEQ ID NO: 26805 - DNA, 229 bp, Glycine max
  Peptide Sequence Number=SeqID_118490
atgaccatgattacgccaagctcgaaattaaccctcactaaagggaacaaaagctggtaccgggccccccctcgagggcgaaacaccacagcagcattgggatggccggtagcgggcaatagacacaccgccaccacctctagagttcacctcagctcatccgcaaaaaggttagagcgttgcctacgacacatggccgaccagcaggctaccaagtccaaagccaaag

SEQ ID NO: 26806 - DNA, 582 bp, Glycine max
  Peptide Sequence Number=SeqID_118491
atgaaagaaatgaaaagagaaaaacatgcctcctatagtagtcataactcttgcaaaagcctaagtgaagaactttgtgactattacgaaggaaggcataggtcatatcttagacatcactcccataggagagaaatggaaagaaagcctcaagaggctaacattaacctcccatacttccatgggaaggacaatgtagaggctaacttagattgggaaataaaggtagagcaacaacttaaaaagaagtctacttcaaaatctgtggctctcactctatccaaagaaagaccaagaggacacattacttctcaatgccccaccacaaaaaccatgattatgaggggccaagacatttatagtagccaagatgaggctactacttcaccttcctctagtgaaagtgaaaaagaaaaaggggaagaatctagtgaagaaatctacccccaagaagaaggacaaccattagtggttaaagagaagtgtaaggaggcacttgctagcattgccacacctcttgggcttgagtttattcctcaagtaaagaagttgttggatgagggtttgatagggactcattag

SEQ ID NO: 26807 - DNA, 732 bp, Glycine max
  Peptide Sequence Number=SeqID_118492
atgtacaatcttcatgagaaaggaagagctcctgatcttgaaagtgtattggcagacttcatgacatataaagctagctctaaaggtaattgttatacaacacaacagcagagaactcagtttggaaaggattattcttttgaagattatcaatgggaattagaatggcaaccttgttatcacaatgaagcaaaaagtttgtttaatctggatgacctgttaatgcaattcaagggtacagtagattcaatgcaacaagcatttaaaagagctgagactcagattgagtatgcagagattgaaacacatcaagaaagcattcttcaagttaacacaatccaccatcaattaatcaccaaagaagaaaaggatgaagtctccattattccagaatattcttgcatggcgactacgggctatgttgtaggcaaagataaaggtcgattggaactcagtgtagaggataagaaaattttctttgacctctttgaagcaatgaaacacccagatatgagtgatgcctgttttgaagaagaagaggtggagcaggagatagcattatcagcttcaaccatggtactacagttccctttggaaaaagaacttaattatgtgacagactgcctagcttgtgatgaagagcatgatgatccaaaagataactctattggtcatgtggtttttgaagaattaaaaaaaataggccaacagaaaatcccaaagcaaaattga

SEQ ID NO: 26808 - DNA, 150 bp, Glycine max
  Peptide Sequence Number=SeqID_118493
atggaaaatgcgaagcacatggctacaccaatgagcactgcttgttatttagataaagatgaaaccgatcagtcaatagatgttaagcaatatcgagatttcaatcaaattccaaacaatcacaccttagtgtcgttaaaagaatcataa

SEQ ID NO: 26809 - DNA, 436 bp, Glycine max
  Peptide Sequence Number=SeqID_118494
tttttggccttatcttgcaggtgacgacgacgtcgagttggcggcggagaaagactcggcattcagtgatatactggaggaaggtggggatgacgtcaagtccgcatggcccttatgggctgggccacacacgtgctacaatggcaattacaatgggaagcaaggctgtaaggcggagcgaatccggaaagattgcctcagttcggattgttctctgcaactcgggaacatgaagttggaatcgctagtaatcgcggatcagcatgccgcggtgaatatgtacccgggccctgtacacaccgcccgtcacaccctgggaattggtttcgcccgaagcatcggaccaatgatcacccatgacttctgtgtaccactagtgccacaaaggcttttggtggtcttattggcgcataccacggtggggtcttcgactggg

SEQ ID NO: 26810 - DNA, 355 bp, Glycine max
  Peptide Sequence Number=SeqID_118495
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgcttgatcggacggactcggctgtgacacatccccctgaggtttcttctcttaccagtggtgctgtggtctcacctacactgaagcaagcccaaccagctgtaccacccacatgcataccagattctggccttgccaaaggtcagagaccgattcctgtcgaagagttttatcagccctctttgagatggagaaagggtccagatac

SEQ ID NO: 26811 - DNA, 555 bp, Glycine max
  Peptide Sequence Number=SeqID_118496
atggacaagaaaatccgcggtattgtgagtagcattctgaaagatgcttctgtgcctgatgctgagaaagatgttccaacatcttccaccccaaatgtttctgtgcctgatgttgagaaagatgttccaacatcttccaccccaaatgtttctgtgcctgatgtcaacaaagatgttccaacatcttccggcccaaatgatgaagtactctcttcccccagcaaagagagatcaacagaggaagatgatcaagccgcagaggagacccctgcaccaagggcaccagaacctgctccaggtgacctcattgacttagaagaagtcgaatctgatgaagaacccattgccaacaggttggcacctggcattgcagaaaggttacaaagccgaacgggaaaaacccccatcaagaggtctggacgaatcaagactatggcccagaagaagagcactccagtcactcctgccacatccagaagaagcaaggctgctatcccctccaagaaaaggaaagaaatttcctcatccgattctgatgagggatgtcgaaactag

SEQ ID NO: 26812 - DNA, 342 bp, Glycine max
  Peptide Sequence Number=SeqID_118497
atgacggacgtgtggggtgctaataccttcctcgtgcgtaaatacaactcccgagcctttcacttaaaagttcgtagatcgcgtcttttccggtttttccgacgttttcctcaaataaacgttggtggcgactccgcgcgtattcctttcgtggaacacgcatcccgcgagtcacgcgtcgcctcccgccgaagggtaggtgtagctgattcagatgatgaagggtctatagatttaaggacaaatccttttcaagatggaggggatgatgcaatactcccaaggaggggacccatcaccagagtcatggctaggagattccaagaagaggggatcctctag

SEQ ID NO: 26813 - DNA, 396 bp, Glycine max
  Peptide Sequence Number=SeqID_118498
atggtcaatgtctcagcatatttgttatatagttgtggattctgtaagaatctgactgagacaagtatgcaagcggggaattccaatgtgtatggattcctcgagccaaagtccattcagagatctgggaaatcgcagtttgaatcggaaagttatatcaagagttggatgcagagttcaaaacgcgatgtctaccttggagcctacctgaatggaccagacaactaccttaagggaataattaacagtgctttgaaaggacttgatgatactccacaacctaaatccaaggctacatctaggtggattgttgttaggacaaaaaggaagcacttagtgaggctattacgtcatgcattggatgtctacgataatcttaggaactttcaggaataa

SEQ ID NO: 26814 - DNA, 465 bp, Glycine max
  Peptide Sequence Number=SeqID_118499
atgaaagaaatgaaaagagacaagcatgcctcctatagtagtcataactcttgcaagagcctaagtgaagaacttcgtgactattatgaaggaaggcatagagcaaaacttaaaaggaagtctacttcaaaatcttatggctctcactcttatccaaagaaagaccaaggtcaaggaatcttaggggtgagaccttctaagcccaaagatgataaggggaagacaatagaaaagcaaccccttaaggctagtatgcaagagaagactagctccatgaagtgctttaaatgtcttggaagaggacacattacttctcaatcccccaccaagaaaaccatgattatgaggggccaagacatttatagtagccaagatgaggctactacttcaccttcctctagtaaaagtgaagaagcaaaaggggaagaatctagtgaagagatctacccccaagaagaaggataa

SEQ ID NO: 26815 - DNA, 360 bp, Glycine max
  Peptide Sequence Number=SeqID_118500
atggttaaagaagcgatgtacacagtttttccactattgatgaatgctaaccgaaatagaaattctattaggggtgtattcatgatggttcatggactgacgacccacacaaggttccaagaaccaattggtcagcaacccaagattgatggaatcaggtttcaaactgttaatctacagcagaataacgagcttctggcacctttcatggacgaagaaattcagaaggcaatttttaaagctgcagcgaagttttttatgaaggaaggcaattcacaaaaggattgcatggatttaatggaaatcagaaccttgaagaaacaggaaactcagcaaagcatgtttagtggagggatctaa

SEQ ID NO: 26816 - DNA, 366 bp, Glycine max
  Peptide Sequence Number=SeqID_118501
atgcagggggagaggttgaaggttcggaaaactgaagaaagggaggaaaaacgcaggaaagaggaagagaagaagaagaaaaagaaaaatcgaggcactgtggaatcgaaccgtggatcgtttcctacatcatttctcttgctagccttgtaccgtgtgcaacagtcggggaagggggctgagtttaagggtcctgcatttttttgcaataagctttcacttgaaattagtgaggagaagaaaaaaggagaaaattcaagccgaggtgcttccgtaacgcttccgagacgttttcgctatcgattccgtggatgttcttcgtcgttcttcaccgttgttcattgttctttgttctccaaccattaa

SEQ ID NO: 26817 - DNA, 369 bp, Glycine max
  Peptide Sequence Number=SeqID_118502
atggctctcctggctgcttctcttgttcctgcttgttttttgggaaagagtggtgtgtctctcaaggactccaccttgtttggtcttttattgtcagaacctatcaaagctaactttagctcttccgcattgaggatcaagttgttgatttcattgtttctagcatatttaaggtgtcttgacttgcttggttttctattgagccttaacttccttgctcccactccaacccagcttcacactagtttgttgctcgaattgttgagtcagggattctggatcacggtggttttggactgtgttggctgcgtcggggaagttttatatctaatgtttttaggaatgatgattgacgtaggtggtgattga

SEQ ID NO: 26818 - DNA, 153 bp, Glycine max
  Peptide Sequence Number=SeqID_118503
atgggggggggggtttggttgtttgggaaaactgccaggaaaccacattacaaacgaaacctcaaagagagttgggcttcgtcctcaaaaggaaacaacaccagaaaatctagccttccatggattcaaacagaaaacgcaaatgaagcatga

SEQ ID NO: 26819 - DNA, 321 bp, Glycine max
  Peptide Sequence Number=SeqID_118504
atgtcatctattgtttacggggattgtgcccgcatgacacctagtggacccgaagaaggccaacaggttcttggagttgccagctctaaatacgggtctctgtcagttctaggggagtgcctgtcgcccccagcaaggcaggcgcagggcgaaacaccacagcagcctggcgatggccggcaacgggcaacagacgcaccgccatcacctctagagttcacctctgctcatccacaaaaaggtttgagtattgcctacaccacatggccgaccaataggcgaccaagtccaaagccaaaggacgcacctagttgctcatga

SEQ ID NO: 26820 - DNA, 1032 bp, Glycine max
  Peptide Sequence Number=SeqID_118505
catgggaacaaatcaaaccggcaagaggttctaccaagtcaaggttaaaagcctagataccaccagcatcaaggaattagggcggttgatggaacctctccaaatgcaagccttccgcaagacttacggaaagattttagagttgaccatagcagaggtatccatagaagccattgcatcactcacccaatactacgaccagcctttgagatgcttcacattcggagacttccaattggtaccaaccattgaagaatttgaggaaattctagggtgtcctctcgggggaagaaaaccatacctttcctccgggtgtctcccctctttgagcagaattgcaactgtggtcaaggattcagcaagaggtttggaccgcataaaacagactcggaatggcatagcgggcctaccacagaggtacctagaagacaaggcgaggggtatggccaatcaaggagattgggtcctgtttatggatgtgttagctttgctaatttttggggttgtcctctttccaaacgtggatggtttggtggacctagcagcaatcgacgctttccttgcataccaccatagcaaggaaagtctggtggtagctgtcttggcagatttatttgacacatttgaccgaaagaggagaatagattgggaccagcttttggccgggataggaggtagaacaatcaattggttccctcgatggaaggaaggaaaggagggagtccttttctcatgtggagggtacccaaacattccgctgataggaacgaggggttgtattaactacaatcccgcgctcgctataagacaactagggtaccccatgaggggagcaccgacagaagaaagcatgtctcctttccttgtgagggatttcggtgcacaaaatttcaaggctatacaaagaatccataaggcatgggaaaccccgttaaggaaagatcaagaacttaggggcattcgtaatggcatcattggtgggtaccatggatggctgaaagttcatatacgaggtttagattggctcgccaa

SEQ ID NO: 26821 - DNA, 300 bp, Glycine max
  Peptide Sequence Number=SeqID_118506
atgagacaaacgcggccatacagcggaatgacaccggtaaaccgaaaggcaggaacaggagagcgcacgagggagcgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtag

SEQ ID NO: 26822 - DNA, 775 bp, Glycine max
  Peptide Sequence Number=SeqID_118507
atggcaagggaaggcataggtcacatcttagacctcactcccatagaagaaaaggaaagaaagcctcaagaggctaacattaacctactatacgtccatgggaaggacaatgtagaggctaacttagattgggaaataagggtagagcaacaacttaaaaggaagtctacttcaaaatcttatggctctcactcttatccaaagcaagaccaaggtcaaggcatcttaggggtgacaccttctaagcccaaagatgataaggggaagacaatagaaaagcaacccattaaggttagtatgcaagagaagactagatttataaagttctttaaatgtcttggaagaagacacattacttctcaatgcccctccaagaaaaccatgattatgagtggccaagacatttatagtagccaagatgagactactacttttccttcctctagtgaaagtgaagaagcaaaaagggaagaatctagtgaagagatctacccccaagaagaaggacaacctttaatggttaaggaggagtgtaaggaggaaattgtctcctccaagaggttagctaagagggaaaggcattttgaaataaagacaaatattaaagaaattactcctcttagacaacctccacattttctcctttgtaaaaagacacttgttagtatttccacacctcttaggcttaagtttattcctcaagtaaaggatttgttagatgagggtttggttcacaagagcttaaatccttgtgctttgttggtgcctaaaatag

SEQ ID NO: 26823 - DNA, 327 bp, Glycine max
  Peptide Sequence Number=SeqID_118508
atggctgaagaaggatgcactccctccaagatgaacgtactccttcagcctccccctaacggaagattccgcactcatgaatttgaagttctctccgaattacgagagtttcttagagacacaagtgtattatgcctaaatgactttgcaattcattttatccgtcttaagaatttccttggccaattcattggttgcaattttaagttatttggtgctcaatctgttgaaaatccatctctttctagagaggatttgttcttcttcttcttctcattctctaagggattaagagaccgtgagtctcttgttgtaaaggaattctaa

SEQ ID NO: 26824 - DNA, 405 bp, Glycine max
  Peptide Sequence Number=SeqID_118509
atggcccacttggagctctcgattccatggcgcggctcaacagagcagccgcaccgtcctacctatttaaactatcctgagggaaacttcggagggaaccagctactagacggcatagttcaccatctttcgggtcccgacaggtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcacc

SEQ ID NO: 26825 - DNA, 504 bp, Glycine max
  Peptide Sequence Number=SeqID_118510
atggcaggtcggctaccagacgagaccgcgggcggcgacttcctcgacgcgggtgacgacgccgttgcggtggaagaccatggtgtcgaagaggttcgagacgacgcaggtgtggttggggatgatgaagatttttctcgccgatctgcggcgcggtccggtgcaggcagagaggtcgatcacgccatgctcttcggaaaggctggcgatcttcgcctcgggatagccgaccacaaggccgaaatcgctgaaaccctgcagatccgaggtcagcgccttcgaaccggcatcaatgacggcgcgatcgccgttcggccgggagacgacggtcgcgacgatatacatggcgcagtcgtcttcggtgcaatggcccatgcggatcatctggcggtcgttgtagatataggtcccggcccggtgttccgttgcggatttgacgagatgggcgtcgaagaggctcggcgtgccgccattgctgacgatcgggcaggcgatgccttcagc

SEQ ID NO: 26826 - DNA, 431 bp, Glycine max
  Peptide Sequence Number=SeqID_118511
tccaaactcaggagcacaggttgcttgagcaaatggaccaatggcttgccctcaattctgccagcccgcatcaattagaccttgcaccttacgcttcaggcccctacaatgctcaatggaatgcctcggggcttctccatgacaagcacacgttgcgttcgagtcgtattctcggagaaatggaggttgatgaaccttggttagggttatggctaccattgaattatcaagtagatatgggagcaaggatggcctttgtggataactgggcggtgggtaaggagaaggttggttattggctgagtaatgacattgttgggttggtgggaaacttggctgtattggaatggcagtcacagcacgggcttctccttcatcctcaccctcttcatttgccccaattttctcattcgtccaagcaggatgactaa

SEQ ID NO: 26827 - DNA, 612 bp, Glycine max
  Peptide Sequence Number=SeqID_118512
atgagtaggagggcgcggcggtcgctgcaaaacccagggcgcgagcccgggcggagcggtcgtcggtgcagatcttggtgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggctcttcggggcctctttcctcgggcgtcgaacagtcaactcagactggtacggacaaggggaatccgactgtttaattaaacaagcattgcgatggtccctgcggatgttgacgcaatgtgatttctgccccagtgctctgaatgtcaaagtgaagaaattcaaccaagcgcgggtaaacggcgggagtaactatgactctcttaaggtagccaaatgcctcgtcatctaa

SEQ ID NO: 26828 - DNA, 166 bp, Glycine max
  Peptide Sequence Number=SeqID_118513
tcctttcgctaagcgcaagcctcgcgctaagcgcatctttgttcatgcgctaagccgcgattctcatgcgcttagcgatcaaccctggcatttgaggctgatttggtctgctaagctggccaaggctaagctaagcgtggtgtattgtttggctaagcgcgactag

SEQ ID NO: 26829 - DNA, 96 bp, Glycine max
  Peptide Sequence Number=SeqID_118514
cccaaaatctaccttaaggcttaagagaaccctagggccttctcttgcatctttggctcaatcttcttggagtcttctatccaatacccttgggag

SEQ ID NO: 26830 - DNA, 609 bp, Glycine max
  Peptide Sequence Number=SeqID_118515
ggcatcactctctcggtcgtcgcctccatcttgttcggcgcgatgtattacttcacctctaccctcaccccgctgaacggcgagcaggtctacggctggcgcacgctgctgacgctgccgttcctgacgctgttcatggcgctgtccggcgattggcgcaaagtgggcgacacgctgggctggatcggccaacggccgcagcgtctgctgggcctgctgctcacctcggcgctgctgggggtacagctgtggttattcctgtgggcgccgctgcacggcaaggcgctcgacgtatcgctcggctattttctgctgccgctgaccatggtgctggcgggccgtttgatctaccgcgatcggctgtcgctgctgcaaaagctggcggtggcgtgcgccatggtggggctggcgctgatgctgccggcggcggcctggttcgccttcggcgacggcggcgtggcggcgttgccgaccaatgccgagctgtattggcgcattccgctgctcggcgtcatcagcgccgtggcgctggtgtgttacatcctcgccagccgtctgctgcctttcagcctgttcggcctgctgagctatgtggaaccggtgctgctg

SEQ ID NO: 26831 - DNA, 521 bp, Glycine max
  Peptide Sequence Number=SeqID_118516
gtctgagttcctcattggaggatacgtaggagcaagagcctcgcttttgtcgaccacaccgccttttgttgccatgactcaagagctggtagcccgtggagacaccttacggatacgaggagatagagccttcggttttgcgccgcacccatctttgtcatccagaggcggcgggcccgatgacaagcagagacaaaatttggtcatgtctgcacccttgtgtcatccagaggcggcgggcccgatgatacgcggagataccttacggttatccgcacccttttgtcatccagaggcggcgggcccgatgacaagtagagacaaaatttggtcattctgcacccttgtgtcatccagaggcggcgggctcgatgatacgcggagataccttacggttatccgcacccttctgtcatccagaggcggcgggcccgatgacaagcagagacaaaatttggttatctgcacccttgtgtcatctagaggcggtaggcccgatgatacgcggaaatacccgagtg

SEQ ID NO: 26832 - DNA, 452 bp, Glycine max
  Peptide Sequence Number=SeqID_118517
atgggtgacctagaggaagtacaggaacagatgaaagccgacatgtcggctttgaaagaacaaatgacttccatgatgaacaccatactggggatgaaacaacaaatggagagtaacctggccaccgccgctgccgttagctcggttgccgagggaagcacaccagggcatatcaacaacccccatccggggtacaatcgaggtacttatccctacagtttactgcccaattacacaccactagccatacatgaagacgtaggtcacgttcctcccctcatcctcgaaggggaacctcctcgacatcctgacgtggtccacgagaatcctcgagagcatgctcagggagacatcgactcctactccccgtttcctgctgaggggccgccgccgaacgcactacctcaacccaacatcacgggagagcctcgaagacacccaacgcagccaat

SEQ ID NO: 26833 - DNA, 450 bp, Glycine max
  Peptide Sequence Number=SeqID_118518
atgggcttcctcatcaaacccatcaggcctggttcctcctctggccatactcgcactcctggccctctctacccagcactaaaaggtatcccaggactggccgatagcgtcgagcatctacatgaacgggatccactgacccctaacccaggatcatcatgtcacgcacgccctcctctgttggccaagcattggcataaaactcaaggactattctggatcaaacttggccatgggagtaaccagtggtgcccaccgccggcgccctatttcctcctggaaatcagtatactcgtcgtccctgagctggacgcgtcgctcccggagaaacgaccaccccttgatggcttcgaagcgctgctggtgtaccgcgctcctaaagcggtgactatcatactccggagcggaactagttccttctgctgccttgtccttcctggacctctttga

SEQ ID NO: 26834 - DNA, 477 bp, Glycine max
  Peptide Sequence Number=SeqID_118519
atgctccaacctcgaatcgttggtgaagaacattatgagactgcgcaaagagttaaacaaactttacaacgttacaaagaacttcaagacattatagctatccttggcttggacgaattatccgaagaagatcgcttaaccgtagcaagagcacgaaaaattgagcgtttcttatcacaaccttttttcgtagcagaagtttttaccggttcgccggggaaatatgttagtctagcagaaacaattagagggtttaaattgattctttctggagaattagatggtcttcctgaacaagccttttatttggtaggtagtgacattgatccacaagaagcacagcaaactcttgaaatagcagaagctaatttgaataaggccggaaggccaagagccaaacaattgaggccaattctagctcttagacgagctaggaccacgagtagaggctatcaatgtgatttcataacaagttga

SEQ ID NO: 26835 - DNA, 504 bp, Glycine max
  Peptide Sequence Number=SeqID_118520
atggtttgctacaacttatgcctttatataggttacataggtgatttctacacacttctatactacttagtcctagagtcttctagactcatctgtcatctaccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcgggtgcttttgccgttacgcaccaccccgtcagtagctgaacagggaggggacagctga

SEQ ID NO: 26836 - DNA, 363 bp, Glycine max
  Peptide Sequence Number=SeqID_118521
ggatataactcagcggtagagtgtcaccttgacgtggtggaagttatcagttcgagcctgattatccctaaacccaatcgaactccagtcgaatatgaagcgcctggatacaagttatgccttggaatggaagagaattccgaatcagctttgtctacgaacaaggaagctataagtaatgcaactaggaatctcatggagagttcgatcctggctcaggatgaacgctggcggcatgccttacacatgcaagtcggacgggaagtggtgtttccagtggcggacggctggaaacggctgctaataccccgtagggctgaggagcaaaaggaggaatccgcccgaggaggggctcgcgtctga

SEQ ID NO: 26837 - DNA, 453 bp, Glycine max
  Peptide Sequence Number=SeqID_118522
atgggtgaagtagaggaggtacaagaacagatcaaggctgacatggaggccttgaaagagcaaatggccacaatgatggaggccatgattagcataaaggagataatggaggtcaatgcggttgcaatagccgctaccagcaccattgctaaggtggacctgacccccccatacggcctcaaccaaataaatcatccaatctcagatatggtaggtctggaaggcaaagagttgggaggtacgtgcggccctcatttagtgcgaaaaacaagcatgtcttctcgccatatggcttgcctccgaactatacaccacccaatgtggcgtacacttccggtgaggatgtcaataactccgctcccatactcattgaatgtcgacaacctcaaactgatcatgcacatgtctctcaacccatgggggagatgcatgagataccctattgcaatctag

SEQ ID NO: 26838 - DNA, 99 bp, Glycine max
  Peptide Sequence Number=SeqID_118523
ggtcagtatgttagagattgtgcggcggccgacaaaagcaaggctcttgctcctacgtatcctccaatgaggaactcagacctacgtagttctggataa

SEQ ID NO: 26839 - DNA, 156 bp, Glycine max
  Peptide Sequence Number=SeqID_118524
atgtacgaaaagagagtgccacatcgccttgcctcccagtatgggacaatggtcatttcaagaatcagtgctaatcctgtaatgaacccttcactaaagtctataaaaggcaaccattacccaaaagtagagcatatacattatcataaaaagtaa

SEQ ID NO: 26840 - DNA, 744 bp, Glycine max
  Peptide Sequence Number=SeqID_118525
atggagagaagtatgatagatgctgccagtggtggagcccttggagacatgactcctgctgaagccagaaatttaattgagaagatggctttcaactctcagcagtttagcgccagaaatgatgccatagtcattagaggagtgaatgaggtagctacaaactcagctgcatcatctgagactaagaagcttgaaggcaaactggatgcattggttaacttgggtaacccagctggccttgaatcagaaatctgttcctgtcgcaaggacctttgcccttccatgcagcaacctggagcaattgagcagcctgaagcttatgctgcaaatatttacaatagacctcctcaacctcagcagcaaaatcaaccacagcagaacaattatgacctctccagcaacagatacaaccctggatggaggaatcaccctaacctcagatggtccagccctcagcaacaacaacaacaatctgctccttccttccaaaatgttgctggcccaagcagaccatacattcctccaccaatccaacaacagcaacaaccccagaaacagccaacaattgaggcccctccacaaccttccctcgaagaacttgtgaggcaaatgactatgcagaacatgcagtttcagcaagagaccagagcctccattcagagcttaaccaataagatgggacaattggctacccaattgaatcaacaacagtcccagaattcttacaagctgccttctcaagct

SEQ ID NO: 26841 - DNA, 216 bp, Glycine max
  Peptide Sequence Number=SeqID_118526
atgtttgtgagaatgaaaattttgatgaccaatacttcaacatcctatcatagaggagagctcgaaagaccatctcttcttaccgagaatgcattgggtatcatggttcgtttgcagtcattaccatggtgcccaatgcatgcaattaagaaggcgatgcagactttttggcttcccgtgacaaagacgatgaaaacaaatgcaatgcatgagtga

SEQ ID NO: 26842 - DNA, 510 bp, Glycine max
  Peptide Sequence Number=SeqID_118527
atgactagaggaaatccatctgacttacaaccctttgatcctgagatagataggacattttatagattagttagacatcatttagtaccttttgagcatcctgagcattctgttattggtgatttggagcattattgttttgaacattctgattttgaacattttgagaacatggcacaacctccaccccgtgagaggactctaagggaaatggttgcacctgatttcacctacgaaagcttgtgcatccaataccctgatgaggatgtcccatatgttcttaaaactggactgatccatttgcttccaaagtttcatggccttccaggtgaagacccacacaagcatctgaaagaattccataatgtctgctccaccatgaaaccaccagatgtccaggaggatcacatatttttgaaggcctttcctcattctttagagggagtggcaaaggactgctatattaccttgctccaaggtccatcacgaccatcagaaaggatatttcag

SEQ ID NO: 26843 - DNA, 219 bp, Glycine max
  Peptide Sequence Number=SeqID_118528
atgcaggaccctcgacaaaggcataggcaggagaagtttcgatccctctcagttgatcacacgccccggcctatgttacttgctcctgcagtggtagtcatcggtggcatattgccgagaagcgtcatcctcgttgattgggataagttctcgattggatcggatcagcctttaaatagtctcccttcttcacctagcagaagctatgagactatttaa

SEQ ID NO: 26844 - DNA, 348 bp, Glycine max
  Peptide Sequence Number=SeqID_118529
atggtttctagaggtatcatcccttcgaaaaaacatattgcggtagtagggactaccagcaacaacatgctatcaaagagaaaaactctagatgagggttcactgttatcaagaagggagagagacccaaacacagttttatactggtttggcaaattacgtgcctacgtccagtactcaagcaatcccttggatgtttccactaggcccctttgtaaaaatccgtgtgtacaaagtctgaaccacacaaggaatacaattcctttgtgttcagcattcttacaacaaagacccttaaaatcatcaaagagtttgaatgacaagaaagaaaaaaggaatatctcttga

SEQ ID NO: 26845 - DNA, 120 bp, Glycine max
  Peptide Sequence Number=SeqID_118530
atgcagcaggcaacaattcatcgaattctaggccttcataattatgcttccaaaggaggaaagggaactcaaagcaatcctggcagaggaaattcaggagtaaaaggaaacaaggtctaa

SEQ ID NO: 26846 - DNA, 351 bp, Glycine max
  Peptide Sequence Number=SeqID_118531
atgaccgaccctctcgatgagtcgatctcttgctttctcataagggtgaacccttgggtactagtaccctcacctccagaggactacataggactacacgtcctcaccttcaaaggtcatgtccttcccttcaaaggactacacgtcctcgcctttaaagggtcatgtacctttaacttcagaggactacacgtcctcgtcgtcaaagggtcatgtaccttcacctttgtagggctacacgccctcacctttagaggactacacgtcctcgcctttagaggactacacgtcctcgccatcagaggactacatgtcccccattttcaaagggggacatgccctcacctttag

SEQ ID NO: 26847 - DNA, 1133 bp, Glycine max
  Peptide Sequence Number=SeqID_118532
atggctacctcaccaaaagaaacttcagctcctggttcaccctctgtaccatcatctccatcatccaccaaagcaccatcaaaccaggaacgacctgaattcaatatccagcccatacaaatgattcctggttcagcccctgttcctgaaaaactggtccccaaaagacaacagggagtgaagatttctgaaaaccctagccctgcaacaagtcctagggaagtagacccggagatggataagaagatccgcagtattgtgagtagcattttgaaaaatgcttctgtccctgatgctgatgaagatagatcaacagaggaagatgatcaagccacagaggagacccctgcaccacgggcaccagaacctgctccaggtgacctcattgacctagaagaagtagaatctgatgagaacccattgccaacaagttggcacctggcattgcagaaagattacaaagcagaaagggaaaacccccattctaggtctggacgaattaaaactatggcacagaagaagagcactccaatcacacctaccacatccagatggagcaaagttgcaatctcttccaagaagaggaaagaaatttcctcatctgattctgatgatgatgtcgaactagatgttcccgacatcaagagggccaagaaatcagggaaaaaggtgcctggaaatgtccctgatgcaccattggacaacatctcattccactccattggcaatgttgaaaggtggaaatttgtatatcaacgcagacttgccttagaaagagaactgggaagagatgccttggattgcaaggagatcatggacctcatcaaggctgctggactgctgaaaactgtcaccaagttgggagattgctatgaaagtctagtcagggaattcattgtcaacattccctctgacataacaaacagaaagagtgatgagtatcagaaagtgtttgtcagaggaaaatgtgttagattctcccctgctgtaatcaacaaatacctgggcagaccaactgaaggagtggtggatattgctgtttctgagcatcaaattgccaaggaaatcactgccaaacaagtccagcattggccaaagaaagggaagctttctgcagggaagctaagtgtgaa

SEQ ID NO: 26848 - DNA, 933 bp, Glycine max
  Peptide Sequence Number=SeqID_118533
atggctattggaagaccggagcatcctggtcgagtacgtggggctgggacaggggttacaattacgcagtattgtggtccagcatcgcgtcggtctacgacttcatcaaacatcactgtagaacagttggctgatataattggtaacctaaaagaagaatggcgaagacatgctgaagaagaaaacattaaaagagacgaggcgtggatgaggagggtagaagaggaaaaacagtgcactatggacacatttaaaggacaaatacaacaagctatcaagttggagttgtcccaaattgtatcacaacattcagccccacttcagccaaatgatatagaagtattagcagcaagggtaagcacgaagggaagctgtgcagcagcagagacaaatgcattagctaaaaaaccctctgagttgaatggtgacagcgtcgggttgcatgtaactgtcgagaactccaacaaattagtggcagtgggcaaacagtgcgacagttttggcaccatccacaacgtgccctatgctgatgatgttgttcgcgtgagtgtggtggaagttattttcggtgatgcggaggttccaatccctacatcggaaataaagtttgtcaaagaagctttagggagttttgttccatggccaagacatttggtcaaacccatgttacctgaggaagcagagaaggatgtcagctcaccattgaagactgttgaggaggaaaagccacctgaggttattgatccattgggagagttggtgaagaacttgttcgacatttaccaaaggcctgttgaggtgttatgggatggtgctaaatttgggatcaataatgtcaaagatggcttcttcatcacacacgctgatgtgagcgagataatattaggagacaagtgtttaaacatctccattctacaactatggcttatgtaa

SEQ ID NO: 26849 - DNA, 294 bp, Glycine max
  Peptide Sequence Number=SeqID_118534
atggaacatatgaatttggggatcccacggtcatgtggctccgcaagccaccggactcttgggacacgaggaaacactgggtccaacaaagataggagaaaatcactcaaagtgtatcaatctcacacagggcaaggattgacattctcaccctgggtcaaggtttatgataagttgggattttggctcaaggcttgtagaacggttggtcatgatatatgtcaggttttgaccagcgggttcagggataaaggggatgtcctacattatttccatgatacacatgcacaatga

SEQ ID NO: 26850 - DNA, 519 bp, Glycine max
  Peptide Sequence Number=SeqID_118535
atgccttatgtggaggccgcagaggagtcattagaaaccgctttccagtctttcgaggtggtaagcatttcctccgtagattccttctctgggcaagcttgcctgtccgatgcagcagtaatgatggcccgagttatgttggggaacggttacgaacctgggatgggtttaggcaaagacaacggcggcataactagcctgataaacgccaaaggaaattgtgggaagtatgggttaggctataagcccactcaggcagatataaagagaagcatcgcgggaaggaagagcggtagtcaaaactcgcggttgagacaagaaggtgaaggaagcccaccctgccacataagtaggagctttataagcgcgggtctgggggacgaaggtcaagtggtcgcgatgtacgaagatggtgttccgagtacattggatttggtacgatcatgccctcctgatttccagctgggaaattggcgagtggaagaacgccccggcatttacgtgatgagcataatgtaa

SEQ ID NO: 26851 - DNA, 261 bp, Glycine max
  Peptide Sequence Number=SeqID_118536
atgatgacaaaggtgatgacaaaaagctcaaaaatcaatcaaagaacaactcaagtgaatcaaagatcaatcaagaacaattcaagagttcaagataagaatcaagaagaattcaagactcaagaagaaagtttaaagtcaagaatcaagattcaaggttcaagacctcaagaatcaagatcaagattcaagactcaagattcaagaatcaagagaaggcttaatcaagataagtatgaaaaggtttttctcaaaaattga

SEQ ID NO: 26852 - DNA, 521 bp, Glycine max
  Peptide Sequence Number=SeqID_118537
catggggtcctttggagaagctggttgggagtgggaattctcatggagaagaaatcttttcgacaatgagttgggaagagcttcagcctttattgaacaggctacaacactaagccctaatgcagctttgaaggattattgggtgtggggagctgacccaaagggaatctttactactagaactgcctatctttgtattaaaggtgatcagccaattggttacctaaatcgtggcttcagtcagctgtgggaaatcaaagtacctcctagagccctatcctttgcttggagactactttgggataggttaccgactaaggaaaacttaattagaaggcaagttgtaattgaaaatgatctttgcaccttttgccaaagccaagttgaatgtgcctctcatctctttttcacttacaaaaaagttatgccaacgtggtgggagtttaactcttgggtcaaggaagatagagttatgcactgtaggcctggggacaacttctctcagcacttctccttggctg

SEQ ID NO: 26853 - DNA, 270 bp, Glycine max
  Peptide Sequence Number=SeqID_118538
atgaccataatttgtctctgtgcgccatcaaacactatcgcctctggatggcgaaaaggctcgccgcctctggatgacaatagggcacagaatgaccataatttgtctttgcgtgccatcggacacgatcgagcctggacagaaaggcgcagaatgaccataatttgtctctgtgcgccatcggacacgatcgcctttggatggcgaaaaggtgtgtggaatgaccataatttttctccgcatgccatcgggctcgccgcctctggatga

SEQ ID NO: 26854 - DNA, 322 bp, Glycine max
  Peptide Sequence Number=SeqID_118539
gtcatttcgggacaagcggatcatttatgatgaagaggatgagcttcaagagaatgattcagagttcttgcagggtggaaccatgcagtaccagacacgagatagatcttccaaagaacagggcttttttcgaataagccaattcatttgggaccccgcggatccactctttttcgatctattcccaaaggatcacgcttttgtctctgggatttatcacttggaaaagaaaatgtcccatactaatggattcgggtccacaacgatgggttcaatgtacgagatcaatagttcattacctaacgaggcatttttccgttag

SEQ ID NO: 26855 - DNA, 294 bp, Glycine max
  Peptide Sequence Number=SeqID_118540
atgggaaagttggatcatctagaggaaaggctcagggccattgaaggaggtgaagattatgcctttgctaacctagaagagttgttcctaatacccaaacatggtcattcccaagttcaaggtgccggactttggcaagtacaaggggactactcgctccaagaaccatctaaagattgtcagtacaattctgatatggctccggataggatgcaactacaaaagtgtgcaaaagggggcacgaatctttcaaagaatacgcccaaagatggagagacttggcaactcaagtag

SEQ ID NO: 26856 - DNA, 318 bp, Glycine max
  Peptide Sequence Number=SeqID_118541
atggctacaccacctagctctcctcctccttctcctcctcatcctcctactggtgcagcatcacagtcaccatctaccttgaagagcacaagaaacgccacacggctaagatcattggcgactagactagttgggacagagagaccgctggtccatgttgatcctgcgactggcaaggccgacggtccccacaataagaagttaagaacatatttgggaatcgtcactcgtgataaggtcgatgtcacatacaagaataagaagcaagtccctgatgctcagaaggatttgatatgggaggatattcaagtactttag

SEQ ID NO: 26857 - DNA, 423 bp, Glycine max
  misc_feature (63)..(63): n is a, c, g, or t
  Peptide Sequence Number=SeqID_118542
atgagtgaccaagaggaagtacaggaacagatgaaagccgacatgtcggctttgaaagagcanatggcttccatgatggatgccatgctaggaataagacaactaatggagaataacgtggccaccgccgccgctgttagttcggctaccaaagcagacccaactctccccgctaccgtgcaccaccctatcccaaacgtgtcatacgtgacgacgtgggtcatgtccctccacccatccttgaaggggagccttctcgacagctggacgaggtccacgaggatcgttgagagcatgctcagggagacatcgattcctactccccattccccgctgagggaccggcacccaacgcgctacctcagcgcaacctcacggaagaaccgtgaaaccgcccaacacaaccaatatttttgtccgtag

SEQ ID NO: 26858 - DNA, 663 bp, Glycine max
  Peptide Sequence Number=SeqID_118543
atgtgtttatgtagctatggtcaaaaagcatctctgtgctcaagtggtgaataccttacaagaaagaggagcaatggaatacactatgtagtagctgaaacagcggattctccagctacattacaatacctcgccccttatacaggagcagctctggctgaatattttatgtaccgtgaacgtcacactttaatcatttatgacgatctctccaaacaagcacaggcttatcgccaaatgtctcttctattacgaagaccacctggtcgcgaagcttatccaggggatgttttttatttacattcactgagttattggcgtgttataaatgccctgaaaccaattgatggtcgaggagaaatttcagcttcggaatctcgattaatcgaatctcctgctcccggtattatttcgagacgttccgtatatgagcctctccaaacaggacttattgctattgattcgatgatccccataggacgtggccaacgagaattaattattggagacagacaaacgggtaaaacagcagtagccacagatactattctcaatcaacagggacaaaatgtaatatgtgtttatgtagctattggtcaaaaagcatctctgtggctcaagtgtgataccttacagaaagaggagcatgaatacactatgtag

SEQ ID NO: 26859 - DNA, 228 bp, Glycine max
  Peptide Sequence Number=SeqID_118544
atggctccgaaaaagctttccacgaagagatctaggagggacgccgcggctgaagggaccagtgccgcccccgagtttgatagccaccatttcaggagcgctgagcaccagcagcgctttgaggccatcaaaggatggtcattccatagagagagacacgtccaactcagggatgatgagtacacagattttcaggaggagatagcttgccgacattggacgtcgctg

SEQ ID NO: 26860 - DNA, 531 bp, Glycine max
  Peptide Sequence Number=SeqID_118545
atgtcttgtataacagaaatgtttgcatcttcagaatatcaagatgaccatgctccactgtggtcatttgttacaataaaggaaaagataggagatgggggtgaatgtggtagtggaattgctacttgtccgaaagttactaatgcatatttggttgatttgaggagggtttgtgaagagactgaaaacagattaaagtctaagaatgttcctttacctactgacaaaaggactccaacatcaccaacattaccaccaaaaagaagaaaatcaagcaatatagagagtgcatttaatattgaggataggaatcatcttagagcagagatagcaaggatgttttattctgccggcttgtcattccatcttgctagaaatccacattttgttagttcttattcatttgctactaactgtaatctaagtgggtttcttcctcctagttataacgcattgagaactagtcttttacagcaagagaggtctcatattgaaaggtgcttcaacctatcaaatctatgtggagtttaa

SEQ ID NO: 26861 - DNA, 366 bp, Glycine max
  Peptide Sequence Number=SeqID_118546
atgccctttatcattcaagagcagcaagctgagtggataaacacgcatagacgaatcctgcttcctttatcattcaggaacagcaagttgggtggtaaacgcgcagagacaaattctgcgccctttatcattcaggaacaacaagttgggtggaacagcaagttgagtgataaacgcgcagagacagattttgcaccctttgtcattcggggacagctcgatcgtgtccaacaacacgtagagacaaattatggtcattctgcgtcttgtatgaaccaagaggaacaaattcgacagtatcaagatgatgttccgctggcagcggaggttcactggctaaatggtgtttcgctcgaacgaaattag

SEQ ID NO: 26862 - DNA, 240 bp, Glycine max
  Peptide Sequence Number=SeqID_118547
atggtggaagaacaaaataacaaaacgacccttacttcagacgaggatattccggtaaaaggtcttttggagaaaagggatggatgtggcaagaaggaagtgttgctagaggaagcaagcaagtttcttcgcattattcagcagagcgagttcaaggtcattgagcagctcaacaaaaccctggccaggatctctcttttggaactactcatgagctctgagcctcatcgggctttgcta

SEQ ID NO: 26863 - DNA, 3393 bp, Glycine max
  Peptide Sequence Number=SeqID_118548
atgagagccactgttgaaggatccatgaccgagaggtttgacgacggtgaaaaggagaagaagaagaagcgccgatccaatcgtcgatccaagcaaaatcctccatcatcttcagcgtctgaagttaatgaggcccagggggtgtcaccagaatcagggaaaattggaacacctactcatgcttctccatcctttggcagttcattgaagcaggtcaatgtgtgttctcctaatgagcaaggattatccaaatcatcaaatgtcgcttttaattcgatgcctcccatgcatatcaatgagcaagtggaacctggtgatttgcgaattgtgccaatgtatgatggaggaattgattcaaaatcattttctgagcccactggttgcagagggtcatctgtaattaataaaaacaaggactcagtcccttgcggtcaaattgggctttctgggcagaaaaattattttagtccacactggtctgtagaggctgttgagaaggcattggagaagggtgatatttttaaagctctccttcatgtcaatgctcacaatagacttgaggcatactgcaaaattgatggaatgtcaacggatgttttcattggtgggattccagcccagaatagagctgtgcaaggtgatattgttgcagtcaagtttgatcccttgccattgtggacaaaaatgaaaggaccaaatgggtcttgtaacaacactgcaacactggaaggttgcaaccttcttacagaagataaagaagtgggtggtaatatttgtaatgggaaagctaaagtaggtgctgagtatgagtctgctcattgcagaagctatcctggtcaaaacaaggaggatgctgatcaaaactcctcatatagaagttatcctttgcctgaaaaaacaatggtttatgatgatattacctctcagggttctactaaccatttagatctgcatggaatggccagccatgacagcattaatggtcatcactgtgctgctcctgattccataaagaacaattcttgtagtgggcagagcaatgcattagaaaagatgtgtttgttggttaactctttcccgtctaaaagaccaactggcagggtggttgctattatggagagatctccacgtcgagagggtattgttggtcacattaatgtgaagcagtgggtttctttcagggacacaggcaaaaaggatttgaagaagaataagaatttgatttctgagcatgaatacatccaactgacaccaactgatccaaagtttccaaatatgatgcttcttgttagaaagttgccaaactgcattaagaaaaggatgaaaagtggtgatgtgacaatcgaaatggatctggtagctgcacaaattgatgactgggttgaagaaagtccttttcccgaggctcacattttgcgtgtttttggacgaggtggtgaagttcagacccaattagatgcaattttgtttcagaatgcaatctgtttgtctgagtttctacctgaagctctgtcctgtctgccatgtgttccttgggaggttccactgaaagaaattcaaagtagaatagatcttagaaatttgtgcatatttactattgatccttcaactgccactgatctggatgatgcactgtcaattgaggagttgcctaatggaaattatagagtaggtgtccacattgctgatgtgtcatattttgttctccctgacacacccttggatagcgaggctcagtttaggtcaacaagtgtctatatgttgcaaagaaagttacctatgctgcctgcattattgtcagagaatattggttcacttagtcctggaggggatcgacttgcagtttccatgctcctggatataaatcttgcaggagatgttgtagaccgttggattggtcgtactgtcatacattcttgttgtaagctttcatatgaacatgctcaggacatcattgacaaggcttttgattttgagggttcaaatttcagtgaagatggctatcctagagtgtatggccattttgaatggcctgatgttattaagtctttgaagagtctttatgaaatttcaaatgtcttgaaacagaagaggtttactgatggggctctacggcttgaaaaccccaaagttgttatcttgtttgatgaaaatggagttccttacgatagtatgctttctgaaaggaaagaatcaaattttcttgttgaggaatatatgcttttggccaataggattgcagcggaagtcatatgtagagcttatcctgatggtgcattgttgaggaggcatcctgaacctaatatgcggaagctgagagagtttatggcattttgtcagaaacatggtttagaattgaacacatcttcatctggtcagttccattggtcattagagcagatcagggaaaagctcaagggtgatcctgtgctttacaatatacttatttcttttgctacaaggccaatgcaattggcatcttacttctgtagtggagatttaaaggacagtgaaaatgaatggggtcattatgctttggctgtcccattttacactcatttcacatcacctctgcgtcggtatccggatattattgttcaccggacactacttgctactatagaggctgaggaattatatatgaagcatcagaaggctttgcagggttacaaggaagtgaaagtgcaaaaaagatgtttcacagacattagttttgataaaattgctgcagaatccatggaaggtagggaagcactatcagccgcagctgtgaagcatagtgttccatgtgcagaaacacttgcagatattgctgcttattgcaatgagagaaagctagctagtagaaacgttaaggatgcctgtgataaactttacatatggtttctcctgaagaaaaaggaggttttattgtcagaagcaagaatactgggactaggcccaagattcatgtcaatttatattcaaaagctagctattgagcgacgcatatattatgatgaagttgaaggtttgactgtggagtggcttgagacaacatccactttggtgcttagcatgtctactagtaagtgtgcatttaggaggggctgccctaacaagtggagggcatttgaagaagttgcattgcttacttgtccatataacctggattttaccatggataattctaaccagagtgaagtaatgaaagtggatgatagtataactgccatggacagggaggagcccatttcaagatcagacttatcggaaactgaaattgaccctgcatttttcccactcacagtgtgtcttctttcaacaattccagtagcacttcatgctgttggtggtgatgatggcccccttgatattggagtgaggctgtacatgagctcctattttcggtga

SEQ ID NO: 26864 - DNA, 96 bp, Glycine max
  Peptide Sequence Number=SeqID_118549
atgggggaggaggttgccgcccagctcgcccaggcgagctgggatgcttcctccagaagttatgggaattttacggaagcattacgagcgtcctag

SEQ ID NO: 26865 - DNA, 355 bp, Glycine max
  Peptide Sequence Number=SeqID_118550
atgggtatactccagggtatgcaccagaatagcgccattcctgcaagcaggccacgtcaggagcccggcaactctatgttaaaaagatgtttatcaccgctgacactcgtcaatcagttagccctaatcgttttgctgtccaccgcactcggcgtaaccggcatggcgatttccggctggctggtacaaggggtacagggtaatgcgcatgccatcaatgaggcaggctcgctacgcatgcagagttaccgtctgctggcgtcggtgcctctgacgcaggacgaccagcctctcattgatgaaatggagcgcacggctttcagccccgaactggaaaatgcagccatccgcgccg

SEQ ID NO: 26866 - DNA, 542 bp, Glycine max
  Peptide Sequence Number=SeqID_118551
tgcgggccctcaaggcaatcctccattctcaccctttttcggagccccatgaatttcattgcctagcgctgttcatgtgtcctccattatcaagcgcgaagcctctagtgactgggaaatacgttcttctgttgtttttcggatcgaagaaaaaagaaggagtagagacgagagtcgtcatcacggaaagggcaggacggacgaaatcagtgtcctatcttagctttcctcttatctccgatgagagtcccgagacgtgtcagaaatcaaaaggaagcaggcttgcgcgatccgtgaaattccgtaatgtggcggaaatcgaaaagagattcttcctccagaaggctgttgcttctggaggaagcaaccttgctcgcctgggcgagctgggtggcaagctcctcccctattttgctataaatagggggagaagtgaagggagaagaggttcagccttcttggcacttcttattctctcgaaattgctgaggaaaattattttcgtgaagaaaatccaagccaaggctcttcctcttcaacgg

SEQ ID NO: 26867 - DNA, 312 bp, Glycine max
  Peptide Sequence Number=SeqID_118552
atgacggtgaaaacctctgacacatgcagctcccggagacggtcacagcttgtctgtaagcggatgccgggagcagacaagcccgtcagggccgcgtcagcgggtgtttgggccgggtgttcgggggctggctttaagctatgcggcatcagagcagattgtactgagagtgcaccatatgcggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 26868 - DNA, 454 bp, Glycine max
  Peptide Sequence Number=SeqID_118553
atggcgcctaccaggcaccctttggatccagataagtccaacagggccctgggatttcccacgctgatcacaggactctgccagtcgtttggagtccccgttgcacctaccaaggctggccaggctggatcatttgacacaaagcggtatttgcggcatttggttcgccagcaggcagccaaccatcgggcgcatgtacagacccatgattgtctttaccagttgagcctcagcatgcagagtcagggcttcgcttctttttcatgccctactccagaccagttcagggcagaggtcgcatggcccggggattggcccgaggcccaagcaggagaggcgcccccagaggctcccggcgacgaagaggaggcccacgaggacgaggagatggccgatttgcttgacttcttgggagggagtgggagctacatgactgggagatccccagattcat

SEQ ID NO: 26869 - DNA, 285 bp, Glycine max
  Peptide Sequence Number=SeqID_118554
atgtctttcatgtgtctcaactccgtaagtatatccatgatccatctcatgtggtcaaattggatgacgtgcaaggtattcggcacttgctttgggccacgttcatacgttggatgttgtgtatgttcgtggggggcgaagtgcactggccttccatggtctttggcacttgctttgggccatgttcatacattggatgttgtgtatgttcgtggggggcgaagtgcactggccttccagggtctatggcacttgctttgggccacgttcatacatcgtatgtag

SEQ ID NO: 26870 - DNA, 329 bp, Glycine max
  Peptide Sequence Number=SeqID_118555
gaatcaacagtgtcaacagtgtctatactagggaatcggtgagagcaacagcttctccagatgacgaatcagaaagatcgataattcctccaactagggaattagggggatcaagtgtttctccaactggtgaatcaggaggggcaacaatttcattcgatgatgcatcagagatgataattagaggtggagatgggggaactacttcaagctcaagagaaggaggcggattcaccactagagatcgtcactcagttggcattggttcgacccgtgtcggtgcgggctcagaagaagcaacctcattgggtctcaccaatagaagttga

SEQ ID NO: 26871 - DNA, 222 bp, Glycine max
  Peptide Sequence Number=SeqID_118556
gctaagttttggaagtgcaaaaagtacagttgggctaagcgcgcatccaccgctaagcgcagcttcattgcgcttagcgcgaaggagaatttggcagaccatcagcatcaagtgtcttcagccaggcttagcgcaagactggcactaagcccaaacccacttactcgcgctaagcgcgagggtggggctaagtgcaatgtcgcgaatttagagcctatttaa

SEQ ID NO: 26872 - DNA, 168 bp, Glycine max
  Peptide Sequence Number=SeqID_118557
atggttcaagacaaaagttaccccaaatttgggggagtaaagtcagttagaatgcaaagaaaaaagcgagcatccgctaagcgcaacactcctgggctaagcgcgaggaagaatccagaagaagatgagttgtacaggttcgctaagcacaccgcttcatctctctaa

SEQ ID NO: 26873 - DNA, 552 bp, Glycine max
  Peptide Sequence Number=SeqID_118558
atgtcacctgacttcatgggtcatgacgacagaaggtacaagagacaatgtcagtctctacgcgtcaacgggcttgtttgcccctgtttgacgaaaggtgcagaatatgcaggagatgatgttagtctctgcgcgtcaacgggctcgtttgccccttggttgacgaaaggtgtgggtaaccataagcgaaagaatgtttatacggataaccacttgggtatcttccgccagccccctaacttcacgggaattgtctatgcggagaattacttatgtatctccgcacgttacctgacttcacgggtcagtatgacagacaacgcggaggatgacgtaaatctccgtgtgtcaacaggctcgttggccgcgattgacaaaggaaattgtttgtgcggagaattacttgtgtatctccgcacgtcacctgacttcacgggttgggataacagaaagcatgaggcgtctctaccggaagatgctgacatctccggaaagggtgcagatgaccacattggtctttgcttgtcaatccgactaggggtcttcgaatga

SEQ ID NO: 26874 - DNA, 201 bp, Glycine max
  misc_feature (172)..(172): n is a, c, g, or t
  Peptide Sequence Number=SeqID_118559
atgggtgccaagtacctcgaagtggtcaaacgagggtcgcatcccaacaacggatggtccccggacgaaattaggacgcagaatgaccataatttgtctctgtgttttgttggacacgatcgcctctggatggcgaaaaaggtgtgccggaatgaccataattcatccccgnccacctctcaacttgttatttttgaatga

SEQ ID NO: 26875 - DNA, 251 bp, Glycine max
  Peptide Sequence Number=SeqID_118560
agctaaaagcagcatttgctgatgctgtgctaggggataatagggcagggactggtggtagtggagcaggggctagtgtttcaagtggaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 26876 - DNA, 417 bp, Glycine max
  Peptide Sequence Number=SeqID_118561
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgacgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 26877 - DNA, 615 bp, Glycine max
  Peptide Sequence Number=SeqID_118562
atgtgccttattgttagacaagggcattatattgagaatggtcaggttgttgttaggaggacttatattattccacaggaggatcctgaaatagcaaagtttagagatcaaggcctcaaattcttacctgagatggaattcctttttaagggtactattgctactaattttgcagcatatgcaccatctaaagattcaagacaatatgaaggattcaatacaagaacaaaagagacaaatgatagcattgatgataacactgacatggaagtgaatgagcctgagatagacacgacaactcagaacacgtctttggcaaaggaaaatggacggaggaagagaggaagagagggtgataaaagaactggggttgctgccaagctttcctcacaattagatcgtattattcaaacatttgaatctagtgtatctgctccagacccaactagcattactgcatgtgtagcaaagttgaaagatctaccaggacttgagcatgggagtgaattattttacaaaaccactaaacttatgaaaaaaagggcaaacaggatcacctttgttgctttagaagagcctgagctacaacttggatggatcaagtctaaaacttaa

SEQ ID NO: 26878 - DNA, 258 bp, Glycine max
  Peptide Sequence Number=SeqID_118563
atgcagataatggttagaactagagatcttggtcgggctttaggccgagcaataggaaaagccttggggaggatagacgggagtgacgatgatgcccccagcagcgaaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtga

SEQ ID NO: 26879 - DNA, 328 bp, Glycine max
  Peptide Sequence Number=SeqID_118564
atggatttcacctttttggggtccacctctatccctttctggctcacgatgaaacctagcaatttccctgatttgaccccaaaggtgcacttagcggggtttaacctcaatttgatatttcctaagcctttcgaacaacttctgcaggttgacaaggtgttcctcttcggtcttaaacttggcaattatgtcatccacatagacctcgatttcacgatgcatcatatcgtggaacagagccaccatagcccgttgataagctaccccggtgttcttgagtccaaaggacatcaccttataacagaacgtcccccacagggtgacgaag

SEQ ID NO: 26880 - DNA, 313 bp, Glycine max
  Peptide Sequence Number=SeqID_118565
atgctcgaaagttttaaacaacaagaccaaatgtcagttctggaattgtacatagaaaaggatgtggctggtggttcaatgtttcattctgcaaattcgcttacatcatgtggaaattatttatctaatgatgagacacaaccggcaacaaatttaagcaatttacatattgacgaagacaatgatgatgatgtgtctaactcatacgttgaagagtctttagacgaagatgacagtcttgacggtatatctgatacagacgatgaagtcaccgacattcctcaaccagtaaaaattgttcacccagcagaag

SEQ ID NO: 26881 - DNA, 231 bp, Glycine max
  Peptide Sequence Number=SeqID_118566
atgccatatactgacttaagcccatatctgctcaataatacaatggcagtcataagtccagcaaagatttctcaacctccatttcccagaggatacaaccccaacgtgacatgtgcttatcacgagggagtttcgaggcagtcgattgagcattgtatgaccttgaaacataaggtgcaaagtctgattgatgtaggctggctaagattcgaggaggaaaattgctcatga

SEQ ID NO: 26882 - DNA, 1039 bp, Glycine max
  Peptide Sequence Number=SeqID_118567
atggataagaagatccgcagtattgtaagtaacattctgaaaaatgcctctgttcctgatgctgatgaagatgttccaacatcttccaccccagatgttactgttcctgagaaagatgttccgacatcttccaccccaaatactgaagtcctctcttcacccagcaaagaggaatcaacagaggaagaggatcaagccacacaggagacccctgcaccacgggcaccagaacctgcgccaggtgacctcattgacctggaagaagtagaatctgatgaggaacccattgccaacaaccgaaagggtaaaacccccattaagaggtctggacgaatcaagactatggcacagaagaagagcacaccaatcactcctacctcatccagacgaagcaaagtcgcaattccttccaagaagaggaaagaaatttcctcatctgattctgatgatgatgtcgaactagatgtctcgacatctaagagggccaagacatcagggaagaaggtgcctggtaatgtccctgatgcaccattggacaacatctcattccactccattggcaatgctgaaaggtggaaattcgtgtatcaacgcagacttgccttggaaagagaactgggaagagctgccttggattgcaaggagatcatggacctcatcaaggctgctggactgctgaagactgtcaccaaattgggagactgctatgagagtctagtcagggaatttattgtcaacattccctctgacataacaaacagaaagagtgatgagtatcaaagagtgtttgtcagaggaaaatgtgttagattctcccctgctgtaatcaacaaatacctggacagaccaacagatggagtggtggacattactgtttctgagcatcaaattgccaaggaaatcactgccaaacaaatccagcattggccaaagaaagggaagctgtctgcagggaagctaagtgtgaaatatgcaatcctgcacaggattggagctgcaaactgggtacccaccaatcatacatccactgttgccacag

SEQ ID NO: 26883 - DNA, 426 bp, Glycine max
  Peptide Sequence Number=SeqID_118568
atgaagggcaagtatattgttcaaagcttgttaaagaacttcgaaaaaattaagaacaagcttgttcgcacatcgtttgcgtgtatgacatccactccacaagcttgtggttacgtgagcctgaactactaccaatatatagatgttgtttatacaaatgagcacatcgtaaaagcttactccgcacaatggtggcctcttgggaatgaagcggttattcctccttctaatgacgcatggacacttatccctgatccaacaacaattcgtgcgaaaggtcggccaaaatcaacaaggataaggaatgagatggattgggtcgaaccctctgagcatcgacaaaaatacagtagatgtggagctgaagggcataacaggcgtcactgtccaatgcaatctgagcgtgggagttgttcaactcattga

SEQ ID NO: 26884 - DNA, 339 bp, Glycine max
  Peptide Sequence Number=SeqID_118569
atgatgtttgttgaatggtttatctggggcgcgtggtttgtgccgctgtggctgtggctgagcaaaagcggttttaccgccggggaaatcggctggtcttacgcctgtaccgccattgccgcgatcctctcgccgattctggtcggctcgctgacggaccgcttcttcgccgcgcagaaagtgctgtcagtgctgatgttcgccggagccattctgatgtacttcgccgcacagcaaacccagttcagcaccttcttcccgctgctgctggtttactccctgacctatatgccaaccatcgcgctgaccaacagtatcgcctttgccaacgtggacgac

SEQ ID NO: 26885 - DNA, 165 bp, Glycine max
  Peptide Sequence Number=SeqID_118570
atgaaaaagtccaagccgaggcacttccgtaacgctccgagacgtttccgtgagcgatttcgtgaagattcttcaccattcttcatcgttcttcgttcgttcttcatcgttcttcggtcttcaaccggagcgagggaaacacccttgtcgaccacaaaaagataa

SEQ ID NO: 26886 - DNA, 78 bp, Glycine max
  Peptide Sequence Number=SeqID_118571
atggataagagcttgaaggaaggagaagatgagtggagggagagggagagaaggagcacgaaattcctaaattactaa

SEQ ID NO: 26887 - DNA, 585 bp, Glycine max
  Peptide Sequence Number=SeqID_118572
atgaattgtgatttagctggaggagagcatcacaaggacaattgttatttttattctataaataactttgaccggagacaggaattggtcatgtacgactaccatgagaaagaaagagcccctgatcttgaaagtattttggcaaacttcatgacattccaagctagctctaaaggttactgttattctatgcaacaacagggaactcaatttgaaaggaaccagtcttttgaaagttatcaatgggagtcataccggcaaccctattatcacaataaagcagaaggagttcttaatctggatgatttgttaatgcaattcaaagatacggtaaagtcaatgcaacaggcctttagaaggactgaaactcagattagtaagttggtggatgaaatgactaacgctgcagccagaaaagaggaagagcatgcagagattgaaatacatcaagaaagcattcatcaagttacctcaatccatcatcaattgaccaatgaagaggaaaagcctgaagtctccagtactccagaatatccctacttggccactgttggctatgttggagggaaagataaagtagattag

SEQ ID NO: 26888 - DNA, 1086 bp, Glycine max
  Peptide Sequence Number=SeqID_118573
atgccgcttttcgcgcatgatttcaacatcacgcctgcggccagttcgctgtcgctttccgtttcgacaggctttctcgccttcgcaatcttctgtgctgccgccatatccgagcgcttcggacgcaggacgctgatgttcgtctcgcttctcggctccgcgctctgcacgatagccagcgcgattgtgccggactggcatatgctgctcgccattcgcgcattgcagggcttgttgctgggcggcgttccggcagtcgccatgacctatcttgcggaagaaatcgaccctcgcggccttggcgcatcgatggggctctatatcgccgggaacgctttcggcggcatggcaggccgggtcattgccggaacgcttgccgaatatttctcctggcgtgtcgggctcgcgggcatgggcctgcttggactggctgcatcgatcggttttctcctccttctgcccccatcgcagaacttcattgcgcgtcccggcttcaacgcacgattccacctcggcgcatggctcggccacatccgcaacccggcgctgccgctgctcttcgccatcgggtttctggtgatgggttcgttcgtcaccatctataattatatcggtttccgcctcgttgccgcgccctatagccttagccagacggcgctcggcgctattttcacggtctatctcttcggcatcgcagcctcctggcttgctggcagaatgggtgacaggcttggctatttcactgttcttcccatcggtcttgccatccaggccgctggctgtcttctgacgctgtttgcgccgctcccggtcatcgtcgccggtatcatcctcgtcaccgtcggcttcttcgtcagccattcggtcgccagtgcactggttggaaggctggcgctccagaccaagggtcatgcctcatcgctctatctgcttgcctattatctgggttccagcgttgccggggcagcgggcggctatttctggactgcaaacggatggtccgcggtcgccgaattcaccttcgtcatgctcgcccttgcctttgcagcggcgttgggtgcggcccgtctctcccggcggaaatga

SEQ ID NO: 26889 - DNA, 765 bp, Glycine max
  Peptide Sequence Number=SeqID_118574
atggtaagcatttgggacctagctagggtagaagtctccgtggaaccaattgcctccctcgcccagtattatgatcagccgttgaggtgcttcatctttggggacttccagctatcaccaatggtggaagaatttgaagagatcctaggatgtcctctaaggggaaggaaaccatacctcttctcagggttctacccctcattggccagaatttctaaaaaagtccaaatctcggcgcaggaattagaccgccaaaggcaagtcaaaaatggggtggtcggaataccgagacaatatttggaggtaaaagcaagaatcttggcagataaaggcgagtggaccccattcatagatattctcacactgttgattttcgagggagtcctctttccaaatgtggatgggttggtggacctggaagcgatcgacgtttttctcgcctatcataaccacaaggaaagtccggttgtcgctatgctagccgacctatatgacaccttcgaccgaagatgtgaagaaagcaatgcaaggattgtttgctgtactccagctctctatgtgtggttagtttcacacctttttctccaagaaggtaggcccgtctatccgctacaaagtcaccgctcgtacgttgaaaaaggaaaggggaattgggaccaactcttggctagcatggaggggcgtctgttaattggttcccttgctagaaggaaggaagaatcaggattctatcttcatgcgaaggatttccaaatgttcccttaa

SEQ ID NO: 26890 - DNA, 680 bp, Glycine max
  Peptide Sequence Number=SeqID_118575
gcaaactggatgcattggttaacttggtaacccagctggccttgaatcagaaatctgtacctgtcgcaagggtttgtggtttgtgctcctctgctgaccaccatacagacctttgcccttccatgcagcaacctggagcaattgagcagcctgaagcttatgctgcaaatatttacaatagacctcctcaacctcaacagcaaaatcaaccacagcagaacaattatgacctctccagcaacagatacaaccctggatggaggaatcaccctaatctcagatggtccagccctcagcaacaacaacagcagcctgttccttccttccaaaatgttgctggcccaagcagaccatacattcctccaccaatccaacaacagcaacaaccccagaaacagccaacagttgaggcccctccacaaccttccctcgaagaacttgtgaggcaaatgactatgcagaacatgcagtttcagcaagagaccagagcttccattcagagcttgactaatcagatgggacaattagctacacaattgaatcaacaacatgtcaaaggacctcaacccgtagcaccttcctcatctgcaaatgaacctgccaaacttcactctactccagaaaaaggtgatgacaaaaatttacctaacaatttctgtgcaggtgatcttcttccacag

SEQ ID NO: 26891 - DNA, 501 bp, Glycine max
  Peptide Sequence Number=SeqID_118576
atggagcggcccgacagcagcgagcatccagcaaaagataggcaggtggccagcagcagtacagcggtgatgagcttcattggattcttccagtgcggaggggcgtttcacattaccgtcggtaccaacgatcttgatacagcggccattttctacgatgccctgctgactccgctcggcatgcgccgccgcccggtcacgcccgatggtggcccggccgcggcatgctgggtgacggcgcacgttgcgctgccgcgcttctacgtctacgcgccctatgaccgtgagccggctagccatggaaacggcagcatggtggcgttcctcgcgccctccgcggacgcggtggatgccgcccatgcggcaggcctcgctgccggcggcaccgacgagggcgcgccagggttgcggccgcactacggagctggctactacggcgcgtatctgcgcgatccagatggcaacaaatgccacatcgtccatcgtggagacctggcctag

SEQ ID NO: 26892 - DNA, 366 bp, Glycine max
  Peptide Sequence Number=SeqID_118577
atgtcattgcctagcgctgttcatgtgtcctccaccttcgagtatggagccccgcgaatgtcattgcctagtgctgttcgccaattctccattctccacattttttcggagacccatgaatgtcattgcctagcgctgttcatgcatcctccacccaaagagtttggagctatgcttcatgatttcctagtcgctgttcatgtgtcctccaccttcgagtatggagccccgcgaatgtcattgcctagtgctgttcgccaattctccattctccacattttttcggagacccatgaatgtcattgcctagcgctgttcatgcatcctccacccaaagagtttggagctatgcttcatgattgccta

SEQ ID NO: 26893 - DNA, 159 bp, Glycine max
  Peptide Sequence Number=SeqID_118578
atgattatgaggggccaagacatttatagtagccaagatgagggtactacttcaccttcctctagtgaaagtgaagaaatacttgttagcactgtcacacctcttaggcttgatattattcctcaagtaaaggagttgttggatgagggtttggaataa

SEQ ID NO: 26894 - DNA, 489 bp, Glycine max
  Peptide Sequence Number=SeqID_118579
atgacggagagggagatgatcacaattatggtagatacgttgcctatgttctactatgaaaagctgataggatacatgccagctacctttgcggatatcgtcttcgccggagaaagaattgagtccggattgagaaaaggcaagtttgaatatgcctccaacgtggcccccaacaacaacagaagagccccagtggtgggcgcgaggaaaaaggaaggagatacccacacggtcaccaccgccccaacttccctcccaactcaagtgaaaggaccacccgcagcagaaagaacgtcggcccaacgcacagctccagccactccccggccaacgcttcatctaccaatcgctgcaagcggcctgtatggtctctcgtggcggagacgaaagggacgaatgtttgtttcacctcggggagtcacacgacatggaaacctgtcccgtggtggaagaattgcttcagcggctcatggactgggggcagcttga

SEQ ID NO: 26895 - DNA, 513 bp, Glycine max
  Peptide Sequence Number=SeqID_118580
atgttcgacgatggaggagctgttacaacaattgatggaccaaggccgttggcggacaaagaaagccctgctaaacccaagcctttggtgatacacttcaccagggatgtggcctcccagaaaccccaaggttctcaacctatctcgggtagaaaacctgtccctttcctttaccaaagcgacaaggcgatcctgtggaggtacacccctcagaagccaagcaaaaagaaaaaggaggccactagcattgacttacttttcgccaaaattaccaacatcaccgacctaagtggtgtgacccgtagcagttgtctcttcatagcgcctaacccatcggggcgacccacggatgccaaagggaaagcgaaggtggtcacgaaagaaaccagtgaagcaagccgcactctggaggaggacgttccagccgagagattcgcggagaaaggaggagacttcagcggaaagaaagtgtccatggaagaggccaacgagttcttccggatcattcaatag

SEQ ID NO: 26896 - DNA, 616 bp, Glycine max
  Peptide Sequence Number=SeqID_118581
atggatagggcgaggttattttatggacttgtgatgaagatggacatggacgtgggcttcctcatttcacaccagatttctcagatggcccagtccaactcctcgaggctcggctttccagctctcatcttcgcactctgcgtggtccgaggagtagtctcaggttctctgacctttgagtccctcagccttgccattaatttggcatacataaagaagaactattggaacctggatgatcccacgatcgaatttccagggacccgcaaggcacgtgctcgagccccttcagctactcctgtttcctttgcacctgctccttctccggctccagccccttctacttcagcaccaccactttatcctagtatgcatgactcagctcagcatcggccttttatcagcatggatgagttcatgccacaggtggcctggccaggagtccaaccttctcctttagggggaggtgaggcttccgtagcccaggagcctcaaccagagccagaggttgctcatgaggccactctagaggcggcgcagagtacctgggatccttggcctacagcagcactggagacacctcagccagcccaggatactccttcttcaccttatg

SEQ ID NO: 26897 - DNA, 483 bp, Glycine max
  Peptide Sequence Number=SeqID_118582
atggccttccaatcttttgaggtagtgagcattgcctccatagattccctctctgggcagcctcgcctatccgatacggcaatgatggtggcccaggtgatgttggggtacggctacgagcccggaatgggtttaggcaggaaaaacggcggcaaaaccagcctggtaagcaccagaggaaaccgtgggaagtttgggttaggctatagacccacgcaagctgacataaggaaaagtatcatggaaaagaagaacaaaggccaaggctcgcggttaggacaacaaaccgaaggggccccgccctaccacatcagtagaacctttataagtgagggtctaagacacgaaggccaagtcgccgcgatatgcgaggatgaccccccgaggggatcagttttggtacgaccatgtcctcctggcttccgactaggaaattggcgagtggaggagcgcccgaacgtttacgcgacaagcataatgtaa

SEQ ID NO: 26898 - DNA, 969 bp, Glycine max
  Peptide Sequence Number=SeqID_118583
ggtgttgcgctggaaagacgcggtgcggctggcgatgaccgagaattccgagcgcttggtctctggtccggcgcggtctggagcgaggcgagtgtgggcaccaacggcatcggcacggcgctcgtcgatgagcgttcggtggtggtttatcgcgaccagcatttcttcacgtcgaataccgaactctgctgcaccacggcgcccatccgcgaccacaccggccgggtgacgggcgcactcgatatttccacctgccgcgacgatattaacgagatgaccttttccttcgtcacccaggcggtgaaggatgcggcgcagcgcatcgagggcaatcttttccgccgcgcctttccgggcgcgcgcatcgttgtggtgccgaatggttttggcgctgcgatttctttgcttgcggttgatcaggacgatcttgtgcttggtgcaacccgcgccgcacgccttgcgctgaagcttgatgatacccttatcgcgcagggcctgcccgctgcggatattctgcaggagcagcgccacgacagcggttccgaccttgcggaagcggaacgctcggcgcttcggcgtgtgttgtctcgcaccaacggcaacgtcacgcaggcggcgcggttgcgatccggccgatcacgccggatcaacgcggctttgtcgcagatgatcgttttcatcagggaggatgaaatcatgaatattcaggttcagcagaaagcgggcgaagcgcccttcaagctgaaatacggcaattacattggcggcaagtgggtggagccgaaatccggccgctacatggacaatctctcgccggtgaccggccacaagatctgcgaagtgccgcgttcggatgcagccgacatcgagttcgcgctcgacgcggcccacaaggcccgcgacaaatggggcaagacgagcataaccgagcgctccaacatcctgctcaagatcgcccagcgcatttaa

SEQ ID NO: 26899 - DNA, 198 bp, Glycine max
  Peptide Sequence Number=SeqID_118584
atggaccttttcaggtcttggagaggatcaataataatgcctataggttggacctcccaagagagtggagctgatatagaggaggaggaaccaacagatttgaggtcaaatcctcttcaagggggaggggatgatgcaatcctccctaggaaaggaccagttaccagagccatgagcaagaggctccaagaggattag

SEQ ID NO: 26900 - DNA, 474 bp, Glycine max
  Peptide Sequence Number=SeqID_118585
atggcgttagcaaggaaaagtggatcagagtcgcagagaccctttgtgggagaaaacaagttgatggaggagaagaaaaagaaacaattggaggaagttactaaatctggcagcactgacaccgttattgatcctccatctcccattagacgacacatgaagtggaagatggcccacaccaagaaaactggtcaaatgacgtttgaggtagcaaagaaaattgccaataagattgattccttgaaggagcagacctcacaaggttcctttgtcacccatggacgtcgggatgtactaactgctgccataggccagatgcagtctcagtttcaattgcaaatgcaatcacagagactcgcactgcctcctaagcctaaggttggtccttcagctactcgtgttagcacaaaggagagttgtgttgatcccttagggaatgacccagacacgggtgactcaagagaaatgcgggtt

SEQ ID NO: 26901 - DNA, 859 bp, Glycine max
  misc_feature (11)..(11): n is a, c, g, or t
  Peptide Sequence Number=SeqID_118586
accacctaggncagagagaccagtggtccatgtcgatcctgctaccgggaaggtcgatggtccccacaagaagaaattaaaaacatatgtgggaattgtcgctcgtgataaggttgacgtgacatacgagacttggaaggaagtccctaccgctcaaaaggatttgatatgggaggatattcaggctgaatttgatgtccctgaagcatctgacacacttgcagcctacaaggataatgtggatgacactatttgtgaaaaatatggccctccatctcccatcagacaacacgtgaagtggaagatggcccgcaccaagaaaactaggcagatgatgtctgaggcagcaaacaaaaatgctgagaagattgcatcacagggttcctttgtcccccatggacgtgaggatgtcctcactgctgccattgggcgaccagaacaccctggtcatgtgcgtgttgctggagtcggtgtaaccatcaagcaatactttggatcagctacatggacctcccacacttcttcctccatgactccagaagaactaaagcagctaactcaacaaattagggaccagctggaggagtcgatcacaaaaaaacctaaggttggtccctcagctgctcgtgtcagcacaaaggggagttgtgttgatccctcaccaactgatcatgacacgggtgactcagacaaatgcgggttgtacatcgaagaaaatccttcccgtctagttgccttaggaagaatttatgagggatcaatagcggttcacaacatccctttgttgcatggccaagtgaaggttggtgttgaggaggttaaagatgcagaggctctcgttcctgtacccactgacgag

SEQ ID NO: 26902 - DNA, 702 bp, Glycine max
  Peptide Sequence Number=SeqID_118587
gttgccagtttgcaagaattggggcaattgatggatcaactccaacattatggaaagatcagccgctaagatgcttcacgtgtagggactttcagctaataccaaccgtagaagagtttgaagagatcttgggatgtccgctaagaggaagaaagccagatcatttctctgggttctatccctccatggctaagtacgacccagagatagtcatggagttttatgccaacgcaaggcctacagaggagggagttagagacaaacgctcctgggtgagaggccaatggatccccttcgatgaggatgtcattaatcaatttcaggggcatccactagtcttagaggagggccagcgctgtgagtttagccagaggaagagtctggccttaggcttcaatgaggaggctatcagccagttgctgagcattttggggcaggattctgcccggagcgtagcggggagacaggttcggatcatgcgcaccagcatgaccaccctcacgcagatttggatgatacctccccctgccgaagtgtcaactggtctacgccattctgacttagggatcacgccccctcgacacccagtggacccggagaggtccagtagggccctcgggtttcctgctttgatcagaggcctgtgccaattctatggagtgccggtcaaccccaccaagtgtggaagtaatgtcttccaag

SEQ ID NO: 26903 - DNA, 822 bp, Glycine max
  Peptide Sequence Number=SeqID_118588
atggagttctggcagcgccacagtaccgcgatgctgatcgcctcgattgtgatgctgctgatcgtactggtggtggggagttcggttaacggcgcctcgcgttggatcgcgctcgggccgctgcgtattcagccggcggagtttaccaagctatcgctgttttgctacatcgccaactatctggtgcgtaaagcggatgaggtgcgtaacaacctgcgcggcttcttaaaaccgatgggcgtgattttcgtactggcgattctgctgctggcgcagcctgacctcggtacggttgtcgtactgttcgtgaccacgctggcgatgttgttcctggccggcgccaagctctggcagtttatcgccattatcggcatggggatctcggcggtggtgctgctgatcctcgccgaaccgtatcgtattcgccgcgtcacttccttctggaacccgtgggaagacccgtttggcagcggctatcagctgacccaatcgctgatggcctttggtcgcggcgagatgtggggacagggcctcggcaactcggtgcagaaactggagtatttaccggaagcgcacaccgactttatcttcgccattatcggcgaagaactcggttatatcggtgtggtactcgcgcttttaatggtattcttcgtcgcctttcgcgccatgtcgattggtcgcaaagcgctggagattgaccaccgcttctccggcttcctggcctgtgcaatcggcgtgtggtttagcttccaggcgttggtaacgtcggggcggcggcgggatgctgccgaccaaaggtctgaccctgccattgattag

SEQ ID NO: 26904 - DNA, 375 bp, Glycine max
  Peptide Sequence Number=SeqID_118589
atgaagagagaatctcctctatccctgcattacaaactgtttgaggggacacatgtcccagacattgtctcgacatcagggaaagctgctgattcaggtgctgtatccaaggatgctctgattgctgaactcaaggacacatgcaaggtgctggaagcaaccatcaaagccaccacagagaagaagatggagctggaacggctgatcaaaaggctctcagaaagtggcattgatgatggagaagcagctgagcaagaagatgaagcagctgaggaagaggtagaagcagccgaggaagaagaagaagctgctgaggaagaggaagatgcagcagaggatactgaatcagatgatgattctgaagccaccccatga

SEQ ID NO: 26905 - DNA, 300 bp, Glycine max
  Peptide Sequence Number=SeqID_118590
atggtttttaggtgggaatatggctttgagtgtatttgccttttcctcttctgtttttgtttagtgcgtggcgagaaagtcgctagcgcacaggattttgtcggcaatcaaagggagaggaccacttcaggtcgtgggcaaggattgacattctcaccctgggtcaaggtttatgataacttgggattttggctcaaggcttgtagaatggctggtcatgatatatgtcagagtttggccagcggttcggggataaaggggatgtcctacattatttccatgatacacatgcaacaatga

SEQ ID NO: 26906 - DNA, 177 bp, Glycine max
  Peptide Sequence Number=SeqID_118591
atgccgaaaaccaaaaggaagcattgttacgccatccgtgaggggggtgcaaatagcatccaagccacttgggccttccaggatgttcctccagaaggcggttgcttctggacgaagcaacctagctcgcctgggcgagctgggtggcaagctcctcccccattttcctataaatag

SEQ ID NO: 26907 - DNA, 350 bp, Glycine max
  Peptide Sequence Number=SeqID_118592
atgacattcccttctaccttgaagcggacaagaaaagccacacgcctaagatcattggcgactagaccagttggggaagagagacccctagtccatatggatcttgcaatggggaaagccgacggtccccacagaaagaagttaagaacatatttggggatcgtctctcgcgataaggtagatgtgacatacgagaattggaaacaagtctctactacccagaaggacttgatatgggaggatattcaaccgacaaggacggtgtcgatgatactatttgtgaaaagtacgacattagccaggaaaagtggacccgattttatcaaagccgtagagacccttcgtggaag

SEQ ID NO: 26908 - DNA, 258 bp, Glycine max
  Peptide Sequence Number=SeqID_118593
atgcagaattttgctgtcaaaataggtgcagcaggattttggcttgtgcagaaaaatgcttgtgtgtggttggctgtggaaagagtagtgcagaatgagttctggatgtttgctagtagatcccaacggtcacaatgtaggcttatgcactatagacttccacttgggaggattgatggggacccggtgttgagaggaacgaggatatgggctacgtgggagtacgtgagatcagttggaggtgggcaacaggggatg

SEQ ID NO: 26909 - DNA, 408 bp, Glycine max
  Peptide Sequence Number=SeqID_118594
atgggtgaagtggaggaggtgcaagagcagatgaaggccaacatggaggtcgtgaaagagcaaatggccacaatgatggaggccatgatgagcatgaagaagataatggaagccaatgcggttgcagttgcagctactagcactgttgctaaggtaaacccgatgcccccatctggcctcaaccaaatgaatcatccaaactcagatatggtaggcaaagatttgggaagtacgggcggcccccatgaagtgcaaattcaaaacgagcacgccttcccgccatatgacttgcctctcaactatacaccacccaatgtggcatacactcccaataagaatgtcaataactccactcctatacccattgagagccaacaaccccaaactgatcatgcacatgtctcttaa

SEQ ID NO: 26910 - DNA, 228 bp, Glycine max
  Peptide Sequence Number=SeqID_118595
atgacgaaagacaacgattgtacctatcaccttcagaggactgtacgtcctcaccttatgagggctacacgtcctcgccttcagagggatacacgccctcaccgtcagaggactacaagtcctcgccttcagaggacttcacgtcctcaccttcagagggatacacgccttcgccttcgtaggactagacgtcctcaaattcagaggactgcacgtcctcgcctttaa

SEQ ID NO: 26911 - DNA, 630 bp, Glycine max
  Peptide Sequence Number=SeqID_118596
atgggtgatcaagaggagacacaggaacagatgaaagccgacatgtcggctctgaaagaacaaatggcctccatgatggaggccatgttaggtatgaagcagctcatggagaagagcgcggccactgccgccgctgtcagttcggctgccgaagcagacccgactctcttggcaactacgcaccatcctccctcaaacatagtaggacggggaagggacacactggggcacgatggcagccctcacctgggatacaaccgagcggcttacccttatggattgccgcccaactattcaccacccatcttgcaagaagatgcgggccacattgcttctcccgtccatgaaaaggaacctcctcagcagcccgacgaagtccataaaaaccctcaagattatgctcggagggatgtcgagttttatcccccgatccccgaagggccggcaccaggcacgttgcctcaacccaacctcgcagcatcgccaatagttttgtctatggaagggccgtccccggcaactgaagaaaggaggaagctcgatctccttgaggaaagattgagggctgtggaacgatttggggactatccatttgccgacatgacggatctttgcttagtacccgatgtt

SEQ ID NO: 26912 - DNA, 357 bp, Glycine max
  Peptide Sequence Number=SeqID_118597
atgggacctaactcttcattattaagaggaaaaagctttataagattaatctcaatgaactattgtcgcaacctacccttcggcgggagggcgatgcggggctcatgggtgcgtcttccaagggaggaaaacgcgtggagtcgccaccaatgtttattcgaggaaaaggtcggcaaaaccgaaacgtgtggtctacgaactttaagtgtgaaaggttcgggagttatttttacgcacggggaagggtgtttccctcacttctacgtatcatcaattgcggtgaggaaatcagacttacatagttctttcagaactaaatgttggttaagttgtttttatcctttttcgcaagattga

SEQ ID NO: 26913 - DNA, 448 bp, Glycine max
  Peptide Sequence Number=SeqID_118598
atggcccgcacgaagaagacaggggagatgacgactgaggccgcaaaggaaatcgctgagaagattgagtcctttgaggagcaggccacacagggatcgttcattccccatggacagcaccctggacgtgtacgtgctgctggagctggtgtcaccatcaagcaatactttggatcgactccacggacgtcccgcagcgcttcctccctgcctcctgacgaattgcagcagatggtccaacaaatcagggaccagctagaggagtccatcatagagaaagtgacgacgcaggtcatgacatcctttagccacatacagtcccagcttcagtcgcaaatgcaatctcagggacttgcagtgcctcctaagcctctggttggtcctttcggtcctcgagtgagcacaaaggggagttgtgttgatcccttaggaagcgatcctgagacag

SEQ ID NO: 26914 - DNA, 531 bp, Glycine max
  Peptide Sequence Number=SeqID_118599
atgaagggaatcacaggagcaccctacagggcacgttgtgatggtttgaccgtcacagatgtgtcttggttgccgtacacggagcatcgggggggtcagttcagatggggtcctatggtcgtcacggttcgaccggagagggtggtacgccagttcggttacatccagagtatccctccgccgcctgtatctgtggattacatggagtggtttttccgcatatctcacccattcatgacaccgacccaggcaggtgaccagcagaaggatgcaccagttgcagaccctaaggactacatacagccacctaggccccaggttccagtggcatttgacccccctccacatgtggatgattacgagggatatgaggcgattgcactgaggttggagcgtgtgctcaaccttaggatagtcactgcaggcacagagttatatgacattatgcaggactgcctgacgatcgcgagagggggacccagtgctgatgggacggtcagggctcgtcagagacgccgcacggaccattaa

SEQ ID NO: 26915 - DNA, 302 bp, Glycine max
  Peptide Sequence Number=SeqID_118600
atgacgcaggcgaatctcaccgagacactcttcaaaccccgtttcaaacaccctgaaacgtcgacgctggtccgtcggttcaatccgggtatccagcctgccgtccagtctgccttagacggcaaaaacgtcccccactggtatcgcatgattaaccgcctgatgtggatctggcgcggtattgatccgcgtgaaatcctggatgtgcaggcgcgtatcgtcatgagcgagtcggagcgcacagacagcgaactctacgacacggtggtcggctatcgcggcggcaactggatctatgaatg

SEQ ID NO: 26916 - DNA, 225 bp, Glycine max
  Peptide Sequence Number=SeqID_118601
atgtcggccaggaaagatgaccgatccagccgatgtgatgaggacaagaacaagggcaaggatccacttgaaggacttggaggacctttgacaagggctagagcaaggaaagccaaggaagctcttcaacaagtgttgtccatactatttgaatacaagcccaagtttcaaggagaaaagtccaaggttgtgagttgtatcatggcccaaatggaggaggactaa

SEQ ID NO: 26917 - DNA, 341 bp, Glycine max
  Peptide Sequence Number=SeqID_118602
tgaagttcggtgttgaggagtttaaagatgcagatgctcctgttcctgtacccactgacgaggttaacttagtgggtgcagacactttacaccttccttgcttggccgacacatctcgtaaagcatttatcagaaaaggagttgtgggaccagcaaaacctgcagataggctggatcatgaggttgatgatcccctatatctgatgacactgaccatcccacaactttttttgaagccgttgcaggttatgtcggatgctaccatgttcggggtgtttaatccagacttccccttgtacataaagcatgaagatctgtctgaaatagcacacggtggttaa

SEQ ID NO: 26918 - DNA, 992 bp, Glycine max
  Peptide Sequence Number=SeqID_118603
atggggacaaatcaaaatggcaaaaggttttatcaagtcaaggttaaaagtctagatgtcaccagcctcaaggaattgggacgattaatgggacccctccaaaggcaagccttccgcaaagtgtacgggaagatcctagatttggccgcagcggaggtatttacggaagctgtcgtatccctcgcccaatactatgaccagccgttgaggtgtttcacgtttggggacttccaaatggtaccaactattgaagagtttgaggaaatactaggatgccctctggagggtagaaaaccgtatcttttctccggctttcttccttccttgagcaagattgcagctgtggttggagattcagcaaaagagttggatcgcatgaagcaaactcggggatgtcttgacacgagacagccgtgtctgcttcaaagctatcgctcgtgcgccgaaaaaggaagagtcgattgggaccaacatttggctgggatagggggcagcacgatcaattggtttcctcgttggaaggaaggcaaggaaggagttcttttctcgtgcggggactaccctaatgttccattggtagggactaggggatgtattaattataatcccgcactcgccataagacagctagggtatcccatgaggggagcgccaaccgaagaaagtctctcgcctttccttgtgagggatctaggagtgcaaggtctcaaggttatacaaagaatccacaaggcgtggaggagtccgttgaggaaagacaaggagcttaggggcatccgaaacggcgtcattggaggttatcatgggtggctaaggattcacacgcggggcttagattggctctccaaattgaaagttatcaatgaggagaacttcgaagctccggaggaagatgaagaagtccgagctctaaaattagagttaggaaaggcgagactcgccaaagagaagttcaaatcagctgctacacacatccggaaagagtgcaccga

SEQ ID NO: 26919 - DNA, 378 bp, Glycine max
  Peptide Sequence Number=SeqID_118604
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggtcacatcctgggggtttgctttttacaaagttcggaagtaatcagactgctcttcttgatttggctttcccggctttctctgctacagtaacatctctcccttgttttctttatctatcaggatag

SEQ ID NO: 26920 - DNA, 565 bp, Glycine max
  Peptide Sequence Number=SeqID_118605
atggcgcctgatgcggtattttctccttacgcatctgtgcgccccgacacccgccaacacccgctgacgcgccctgacgggcttgtctgctcccggcatccgcttacagacaagctgaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccg

SEQ ID NO: 26921 - DNA, 432 bp, Glycine max
  Peptide Sequence Number=SeqID_118606
gctctggcacatggaaaggagggtgaggatgacaaagtatgtgaaaagtatgacataagcaaagagaagtggaaccaattttgtcagaatcgtagagatccttcatgggaggccattcaaaaacaaaacactgcccctcatgtgttgtctcatggaggttatgattttctggaacaaaagttgatggaagagaagaaaaagaaacgattggaggaagcaacccaatctaggagcactgacataatcgttgaccctccatctcccattagacgacacatgaagtggaagatggtttgcatgaaaaaatcaggtcaaatgatgtctgaggcagcttcacagttaagctttgtcgtcgatggacgtcaggatgtactgactgctaccattgggcgactagagtaccctagtcgtgtccttgctgctggagttgtt

SEQ ID NO: 26922 - DNA, 657 bp, Glycine max
  Peptide Sequence Number=SeqID_118607
atgacccgggtgccaagtgtgcgtaccatagtggagttcccagacacaacattgactccttcctcccgttcaaatataagaaccaacccgctagctagtcatggaggggctagcgtgaacgccgtcgaagaggatgggccatcacgggcaaagagattaggagaggtagctacttcaagacgcttcatctatcaatcactgcaagcggcatgcatggtctcccgtggcggaggcgaaagggacgaatgtttgtttcacctcggggagtcgcacgacatggaaacctgtcccgcggtagaagaattgcttcagcggctcatggactgggggcagcttgaagtgtccataggagggagggaagaaccacaaatttgcatgcagtcggaagagaagaaggttcctctaacccccaaggccctagtgatatgttttactagaaaagggaccggctccacacccatatacccccgggcagcgcccaagccaacgccatttgcatatcaaagtaataaggtcgttctgtggaagtatacccctcccacgtccagcgaaagagttgcaaccgaaattgactccttatcagctaaggtaaccaacatcataggcagtatatgctcagccataccacgtggcttatttccaaaatggatcccgtga

SEQ ID NO: 26923 - DNA, 183 bp, Glycine max
  Peptide Sequence Number=SeqID_118608
atggtgctggtagtggctattgcagccgcattgacctccattatctcctttatgctcatcatggcctccatcattgtggccatttgctcttttaaggcctccgtgtcggccttcatctgctcttgcaccttctctacttcacccattactttagctctagcacgggttcggacatggggttga

SEQ ID NO: 26924 - DNA, 387 bp, Glycine max
  Peptide Sequence Number=SeqID_118609
atggctgcaagtgatcacactatcttgcgtgatcagactcatattcccaccaaaagaagtttgttggagctttcatcccaggatgcactgttggcacagaacaagttgctttccaagaagcttgagactttaactaaaacattaaatgacacagctcaagaggtaaattacatggagaatcagcccagacccaatttcaatgcaggtgaatattcaggttttcaacatggtcagaattataaccaacaacaaggacaatggaggtctcacccaggaaatcaatttaacaaggaccagggtgggccatctaataggcctcaacaacaagggcctagcctttatggaaggatgaccaagctggaggagacccttgctcagtttatgcag

SEQ ID NO: 26925 - DNA, 132 bp, Glycine max
  Peptide Sequence Number=SeqID_118610
atggagcttgcatcaatatttaacttcagatttcagagctcttttagagcacaaaatttcgttctcttctcttcctctcccttcgttcatctccttcttcctccaagcttttatccatggcctcctatggtg

SEQ ID NO: 26926 - DNA, 550 bp, Glycine max
  Peptide Sequence Number=SeqID_118611
atggctagaccacccccaagtaatcaaaacaatgaccttccaaatatggaggggcaaccaacgcagacatctgtcagtaatgccaatgtaaattctggcataggagcaattcctggccaaactgttggcacgacaagttcgaccgcgtcgacggttatgaatcagacaggggtaacttctcccatgaccaacatgacgttggcaacttcgaccacgtcagcgtctgtttttgccccatggaataaccccagtttagggaatcccagtggaagtccttttcgaccgcttcaaaaccctctgtatggcatgcctacatctttgatggcagggttgcaaaactctcagccaaatatagagaatcttaatatgtcctctccatcagggtctgtagcgggcaatcaaggtaggcaaccaccaattcgacagatccaaatacaggcgcctgtccaagagatacagatgcctaacaatccagggatgcaaatggctcaagcaccacaaccattggctcgcatagagccaccagcccaacaggtcgaaccaaaccctg

SEQ ID NO: 26927 - DNA, 471 bp, Glycine max
  Peptide Sequence Number=SeqID_118612
atggcgcgcagagacaaaaattggtcattatgcacccttgtgtcatccagaggcggcgggcccgatgacacgcggagataccttacggttatccgcgcccttttgtcatccagaggcggtgggcccgatgacacgcggagacaccttacggttatccgcacccttgtgtcatctagaggcggcgggcccgatgacacgcggagataccttatggcggcaggcccgatgacacgcagagacaaaatttggtcattctgcacccttgtgtcatccagaggcggcgggccctatgacacgcggagataccttacggttatctgcacccttttgtcatccagaggcggcgggcccgatgacaagcagcggccaatgtggtcattctgcacccttgtgtcaatccgatggccgacaagcccgttgacacgcggagatttacatcatcttccgcacttacaagatctgtcacactga

SEQ ID NO: 26928 - DNA, 492 bp, Glycine max
  Peptide Sequence Number=SeqID_118613
atggggacaaatcaaaacggcaaaaggttttatcaagtcaaggttaaaaatctagatgtcaccagcctcaaggaattaggacgattgatgggacctctccaaaggcaagcctttcgcaaagtgtacggaaagattctagatttgaccgcggcggaggtatttacggaagctgtcatatccctcgcccaatactatgaccagccgtcgaggtgcttcacgtttggggacttccaaatggtaccgactattgaagagtttgaggagatactaggatgccctcttggggggagaaaaccgtatcttttctccaggtttcttccctccatgagcaagattgcagttgtggttggggattcggcaagagagttggatcgcatgaggcaaactcgcaacggcatagtgggcctgtcacggaaatatttggaaggcaaggcaagggatagggcgagccaagagaagtggggcccgcttgcgtatctggggatcctctag

SEQ ID NO: 26929 - DNA, 797 bp, Glycine max
  Peptide Sequence Number=SeqID_118614
aagcacggtttcttccagcgccggctgttccgccagccctatgtgtgcatctttcgcgaggatcatccgctggcgcgcaccggcgtgtcggcgcggcagttccgcgccgccgagcatgtcgccatcgtgtcggagggcaccggccacggggtggtggaccaggtgatcgagcaggccggcatccgccggcgcctgcgcctgacggtgccgcatttcatggcggtggggccggtgctgcaggccaccgacatgatcgcggtggtgccgcggcgcttcgccgattgcgcctgcaagcccttcggcctggccaccgcggcctgtccggtgaagatccccgagtccgtcatcaacgtgttctggcacgcccgcaaccaccgcgagccggccaaccagtggttgcggcaggtggtggtggagcagttcgcggattaggggaccgccgtgaccttgaaccagccgcgcagggcgttggacagccggatctcgtcggccgcgtgcaggtcggccagggtcagcacgcgttcgctgacgttgccggtatcgagcagttcggcgcgctgcacgccgggcaggcagccgctgtcgaccggtggcgtgtaccagtcgccatccaggcgcaggtagacgttgctgcggctgccttcgcacagctcgccgcgttcgttcaggtagaccaggtcgaagatgtgcggatgggccggcagccattcgatggtcttggtgtacccagggccggtaagtggtcttgtagcgcaacagcggctcggacgaacgcagcgcctcgggcgccagcatga

SEQ ID NO: 26930 - DNA, 417 bp, Glycine max
  Peptide Sequence Number=SeqID_118615
atggcgcctactaggcaccctctggagccagataagtctaacagggccttggggtttttggtgctgattatgggcctctgccagtcctacggagttcccgtcacctccagtaaggccacaggcgcaccgccaccaccttggcaggttgacccagctgggccactgggcgtggagcattatctacagcatttggtttgccagcaggcggccaaccaccatgggcaagggcagggttcctccccttttgtatgccctactccggagcattatggggctgacgtcacatggcctggagactggcccaatgcccaggcaggggaggagtctgcaggatccctcggtgaggcgggtgaatcccatatggatgaagatatgactgacctgctcaatttcttgggagagagcggagccacgtga

SEQ ID NO: 26931 - DNA, 267 bp, Glycine max
  Peptide Sequence Number=SeqID_118616
atgatgacaataatagtagacacattaccaagctttgcggatttggtctttgccagtgaaaggatcgatgtgggtctgaaaagaggcaaatttagtcatcctgcttggacaaatgagaaaactggggcaaatgaagagggtaaggatgaaggagaagcccgtgctgtgactgccattcctatacagccaagtttcccaccaacccaacaatgtcattactcagccaataacaaacatcctccttacccaccaaccagttatctataa

SEQ ID NO: 26932 - DNA, 261 bp, Glycine max
  Peptide Sequence Number=SeqID_118617
atgtcgtgccccttctcttcctccactcatcatctccaaccttcaagctcttatccatggctccctatggtggtgagcttcttcttaactcatcttctccttgaagtgacgtcttcaatcatctttcttccttctccattccgcagccatgatcttcaagaagcaaaagactccattgatgaagaagattcaaggcctacaagctccacatggagctacaccatgtggtatcaagagcatcttcgttctgggatcctctag

SEQ ID NO: 26933 - DNA, 411 bp, Glycine max
  Peptide Sequence Number=SeqID_118618
atggattcctttgcttcttggaagatgaatggcagcggaatggagaaagaagagagagaggaacaccacttcaaggagaacatgagtctagaagaagctcaccaccataagaggccatggataagagcttggaggaagaaggagatgaatgaagggagaggaagagaaaagcacgaaattttgtactctaaaagagctctaaaatctgaagtgttgtcgcaacgtgcccttcgcgggcgagcgagggcaaggctcacgggtgcgctttccaaaggaggaaagatgcgcggagtcgtcaccaacgaaggtattagcacctctcacgtcgacaaaagcggggcttttgctcctacgtaccatcctttggagaggaaatcagacctacgtagttctttcttatgcgtgaatcaa

SEQ ID NO: 26934 - DNA, 2670 bp, Glycine max
  Peptide Sequence Number=SeqID_118619
atggtaatgcccgtgacggcgccgtcgacgccacctctcccctgcgggacccagaatttagacagccacagtgataggttttctgataacctatttaggccttggctgtgtggcattgatgctgtaacgagtacatcttctggcctcagtgatggttatgtggctttgttcgttcgtatgttaggcattgatcgtgatcctctggatagagaacaagctatagttgctctctggaaatattcgcttggtggaaagaagtgtatagacactttaatgcagtttcctggttgtattaatcttgttgtgaacctcctacgatcagagtctaattcagcatgtgaggcagctgcgggtcttctgcgatcactatcttcagtcaatctatatagaaattctgtagctgatagtggagcaatagaagagttaaacagattgctgaggcaatcttccttggcatctgaggtatgggaattggtaaaggagcagagtttgagtacactgtggaatttatctgttgatgagaagctctgcattaaaatttcaaagactgagattctgccattagctattaggtaccttgacgatgaggatataaaagtaaaggaggcttcagggggcattttggcaaatttagcatcgagccgtgttaaccacaacatcatggttgaagcaggtgttataccaaaattggcaaagttcttgacatctaatttggaaggatctaacgttcttaggaaggtcacaaggaatgcattgctggaacttgttaaggacaagtattatagcattcttgttattgaggaaggtctggtccctgtgccattaattgatgctgcagcctttaagtcattcaccccaggcatacatttgtggcccatgttacctgatggtacagaaattgaaaggacttctagacagccatccagatatggtgcttcggaattacttcttggattaaatattgatgacaagaatgctaacttagaggaagcaaaagtcaatgcaattgttggacgaacacaacagcaattccttgctcgtgttggggctttagaaatggaacaaaagactatgcctcattctgaatgctcaaatgatcagaggtttacacttttaccttggatggatggtgttgctcgtttagtactgatactagaacttgaagataggtttgcaataattaaggctgcagagtcaattgctactgcatgtatcaatgaacatatgcgtatagcattcagggaagctggagcaataaagcatttagtaaggcttttaaattgtgatgataattcagtccagttggcagccacacaagccttggaaaggctgtccgttagcaatattgtttgccgggttattgaagctgagggggttttaggtcctttagttagtattttgaaatgctcagagatagctggaactattttggaaaagtctttgaacatacttgctcggatattagaccccagtaaagtgatgcaattaaagttttatgatggaccagttaatggatctgaaaaggcatttggtggaacaaaaggtgactgtgtttcaaccgggtttagtagcactgaacaagctgtatcaaaaacgtacacaaggaatgatatactggattctgttttcattgcacacctggttgagattatgaagtcctctcctcccagtttacaagaaaaagctgctactgtgcttgagtttgtggcattgactgacccaactctggccccaattatatttctggatattgaatctggtctgaattcagcttttcagcaaaaaattttgaaaatttcaggacctactgtccctggtggacctttctgttctgctgcccttctacgtgccaaacaattttggttcctttatcactgcagcatctcttcgttctcacgtgaacagtaccacgagctgctgcaagccttcattggcggttgtcgtgccctcctatctccaaagcgaccacaccccctgagtctccacctcccggcgaagcaactagtctcctacagtgatatggtaaatcaagcggacatggaatctgacgtagaagatcagttttctgaagcatatgcaattgaatttgaagaagctggtcttgcaatagctgcagcatcccggttattaacaagactactcgatcatgagcagttccgccacaaaataaactcctcgcaattcattgatttgcttcggggaatcctcaggtcctgcattcccctccacaataaaaagtgggtagctacttgcctagttaaactaagttctctctctggctccatcacgagcctctatccaatcaatgtggaagttactctctacgagacaatcccaagacttctggaacagatcaaaacatcattctccccagaagcacaggaaacagctgttgttgaacttaatagaataatatctgaaggagtggtagattacacagaagctattatttctgatgaagcaatatattcattggtgaatttgatagaagaaggcagtgatagggctgtggaagcaagcttggcaatactgtataatctgagtatggacagtgagaaccattcagcacttgtggctgctggagcagtgcaggtcttaaaaagaagtgttctagcaaacagaccacactgggaacgggcacttcttttactcaggattttgcaaccgtga

SEQ ID NO: 26935 - DNA, 306 bp, Glycine max
  Peptide Sequence Number=SeqID_118620
atgggacaccttagtgatcaaggggttcccacagaccctaagagaataaaggtcattcctgattggcccactccaccaagtgtcgagggaaggagcctagagtatgaagaatctcgggatttgaggtcagatcctttccaagatggaggggatgatgcaatcctacccccaagggtattggatagaagactccaagaggattgggctagaattgctaaagaaggccatggggttctcatgaacctaagggtagattttttgagcccatgggctaaggttgggtccacttttctttgcaaatattag

SEQ ID NO: 26936 - DNA, 737 bp, Glycine max
  Peptide Sequence Number=SeqID_118621
aggaagagctcgcacctgtcatttcacgagggttcagtgagaccaacgtggagacgcttcagaaggtctgcaaagcatgggaagtggtacaaaagaaggacaaagagctcagaggcagtaacaatgggcccatcggtggctatcgtaagtggttgaaagcccacgtgcaaggtttggattggctcccgagtttgagaactgctaaaagggaggaagttgaggcaccagaggaagacgaagaggtgcaggcccttagggcagaaatcgagcaagcccaaacaatcaaagaaaggttcaaatcagcagctctgaagatccgaaaggagaatgccgaattgagagatataaatacaactaccgcaagagcccttgaacaagaaaccaagagggcttgtagggaagaacacagccggaacaaattccgaggggctctgtggggcagcaacagcgagcttaaactccgaagagaggaaagggaccgatcacgagtagacaatctgatcttgaaagatgagttgaaggtttgctcaaggtccaaaagaaacttgtctcagcgattatgcgagacagagaccaacatgttagccatcatcagtaagtaccaagcagaactaaatctagccatggcccatgagcataaagtggtggatgagtatgcccaagtgtacgcgagtcaagaacttcctcgattgctagccaaggccaaagcgatggcggacacctactccaccgcctga

SEQ ID NO: 26937 - DNA, 503 bp, Glycine max
  Peptide Sequence Number=SeqID_118622
gtttaactaccgaggggtatcggggcatttggggagctgcgtctctggtgaaatatatcactaaaggcttaggctttccaagacctccctcatccgcggactgcatgcatatgtgctgctcttcatccccctcatcgtcgatttccagccgaccttggtctatcatccgttgcaaaaggtcctccactgctaaacatggcctcgtagataaacctcctgggggtcgttacgtccttcaaaggcttggacctgcgtggcctacccgacacgacgacattaattgctcccccttcatgattagcgagcgggttcgttttcacgttgggccggtcctcttgaaatgtcaaccatccggcgtctatcaaatgttggaccttctatttaagggccaggcagcgttcggtggagtggcccggggttttccaatggtatgcgcaggattgcgtcagggttatgccactttgggaaaggaggctggtagatcttcccgggagatatcatag

SEQ ID NO: 26938 - DNA, 279 bp, Glycine max
  Peptide Sequence Number=SeqID_118623
atggaaatttatgtgagtgatcgactaggaaaaagtgtgtgtgtgtgtttcttgatttcagaagttgtcattatcaaaaagggggagattgtagaagcaaagcttcatgatgatgacaaaggtgatgacaaaaagctcaaaggtcaatcaaagaatgagttcaagatattcaagatagaatcaagaacacttcaagattcaagaggaaagttgatttcaagaatcaagaatcaagattcaacagatcaagatttcaagaatcaagattcaacagattaa

SEQ ID NO: 26939 - DNA, 429 bp, Glycine max
  Peptide Sequence Number=SeqID_118624
atggcctctaggaagaggaaagctaccgcttccagaccccgggagccctatgacaccaccagattcattttcgagggcgcctgggagagatatgaccagaacgttcactcccagaacattcttccagagaggaacatcatattatacatttctgagtatgatgagttccgccgagagctcgagaggcatagttggcataaagccttgaccaggcagcctgatggtcacattggtgtggccttggtcaaggagttttatgccaacctctatgatccagaggataagtccctgcgacaagtcagagtccgaggcaagttgattaagggtaccgagctcgaattcgtaatcatggtcatagctgtttcctgtgtgaaattgttatccgctcacaattccacacaacatacgagccggaagcataaagtgtaa

SEQ ID NO: 26940 - DNA, 698 bp, Glycine max
  Peptide Sequence Number=SeqID_118625
gaaacagctatgaccatgattacgaattcgagctcggtacccaccctagggagcccctcgcgtggggcggcggtggctaccacgcgccgggccagggcgatgtggaccccacgtcctacgtccgtgtgtacaccgtggagtccgacgccgacgtggcggggagaacaacctccaagagatgggtaatgagtgatagggatagaggaagagagatgcacgagtcttcttctggtttagtgagtagtaatggtaacagtgagaagtattatcatggttctgagaataatatgatgggtaggtatagtagagggaatagtagagagtgtggtcatactcacgaatttgacgcactcctccgaagaaacaggtacagaagaagagtgctcttcttaggattcagacggttaggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 26941 - DNA, 150 bp, Glycine max
  Peptide Sequence Number=SeqID_118626
gcagtaaacaccataactaaacacactttcaggcacccctatcgaacccattccaaaactagagtcatgggtgacatagaagaggtacaagaacaaatcaaggctgatatagaggccttgaaggatcaagtggcttctgttagtgcttag

SEQ ID NO: 26942 - DNA, 231 bp, Glycine max
  Peptide Sequence Number=SeqID_118627
atgagaataaaaatacacgaaacacaatgtggaccaccatgggtacatagaatgaatcgaaaagcttggttcgagcaaaataggggaggtgcttgccgcccagctagcccaggcgagctcagctcgcccaggcgagccaggttgcttcctccagaagcaacagccttctggaggaatattctggagggcccaagtgggcctgggtgctatttgcatccccatttttactaa

SEQ ID NO: 26943 - DNA, 552 bp, Glycine max
  Peptide Sequence Number=SeqID_118628
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaacgacggccagtgccaagcttgcatgcctgcaggtcgactctagaggatcccccatggaacggagccactgtgaagaagttttacgagttacgaaggaaacttcgagctcatattggtcatgggttgagaacgggaattgaactctatgagctcgaatttcccgttgttcctcagtag

SEQ ID NO: 26944 - DNA, 468 bp, Glycine max
  Peptide Sequence Number=SeqID_118629
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccactcactcacctcacggtgctacaactcccactctttttctcggcctctcactctcactctccttgccgagccattagtggcggagaaggaagggatctggatggtgctcacggaaactttggaggacgggatcctctag

SEQ ID NO: 26945 - DNA, 147 bp, Glycine max
  Peptide Sequence Number=SeqID_118630
atggtgaaagttggaacctcttacgtgccgatcaacgtctcattttcgccaaaagttggcccagggcttcccgctgtccctcctgttcagctactgacggggtggtgcgtaacggcaaaagcaccgccggacatcagcgctggctaa

SEQ ID NO: 26946 - DNA, 477 bp, Glycine max
  Peptide Sequence Number=SeqID_118631
atgcgtcaacatacaaagacgggtttgttagaagagccgtcgttgtatgttttgtacagacacgtggcgggcgtcattcaaagacggtcttttctaggacccgtcattgtatcccaaattgtatcacgtttacggcacgtgcttgttactttctcttactttggcgcgccgtatcacttctttgctccatttttcgactacttgcccttactttggcgccctagctacacagaccttcttctccgacaaagagcttcgtctccgacaaacagcatctcgtgtccgttgcctgttgttccgtttgcagccgccgccgacaaaggccctttgttgttgttggttgtcttcatcgtggtgtacatcatagtgtttaaggaagataagtggggtttacaatccaaagacgagcttcgggaacggcctgctgccatccttcatcagtggtgtcatcctgtgccacattatcagtttcgttga

SEQ ID NO: 26947 - DNA, 930 bp, Glycine max
  Peptide Sequence Number=SeqID_118632
atggccaagtttgatccagaaatagtccttgagttttatgccaatgcttggccaacagaggagggcgtgcgtgacatgagatcctgggttaggggtcagtggatcccgttcgatgccgacgctatcagccagctcctgggatatccgatggtattggaagagggccaggaatgcgaatatggccagaggaggaaccggtctgatgggttcgatgaggaggccatcgcccagctgctatgtataccggggcaggattttgcctggactgctgccggaagacgggtgcggatcatgcgcaccaacatgaccaccctgactcagatatggatgactctgctgctcagcaacatcctgcccaccgatcataattccgacctccccatgccgaagtgccagctggtgcaccctttggacccagataagtccaacagggccctgggattccccgcactgatcacaggactctgccagtcgttcaaagtccccgttgcacctacccaaggtgattcggccgcccatcacccgggcttttattcgagaagtacttcaccccagagacaggctcagggtgatgctccacaggccacaggcgcgccaccaccacctcatcaggctggcccggctgggttgtttgacatggagcagtatttacggcatttggttcgccagcaggcagccaaccaccgggcacatgtacagacccatgattgtctttaccagctgagcctcagcatgcagagccatggcttcgcttttttttcatgccctactccagaccagttcagggcagaggtcgcatggcccggggattggcccgaggcccaagcaggagaggcacccccagaggctcccgacgatggagaggaggcccacgaggacgaggagatggccaatttgcttgacttcttgggagggagtggagttacatga

SEQ ID NO: 26948 - DNA, 537 bp, Glycine max
  Peptide Sequence Number=SeqID_118633
atgaatgctcatccgtgtcaggatggcgtacaccagctggcacttcggcatggggaggtcggaattatgatcggtgggcaggatgttgctgagcagcagagtcatccatatctgagtcagggtggtcatgttggtgcgcatgatccgcacccgtcttccggcagcagtccaggcaaaatcctgccccgaccggttcctcctctggccatattcgcattcctggccctcttccaataccatcggatatcccaggagctggctgatagcgtcggcatcgaacgggatccactgacccctaacccaggatctcatgtcacgcacgccctcctctgttggccaagcattggcataaaactcaaggactatttctggatcaaacttggccatgggagtaaccagtggtgcccaccgccggcgccctatttcctcctggaaatcagtatactcgtcgtccctgagctggacgcgtcgctcccggagaaacgaccatcccttgatggcttcgaagcgctgctggtgcacaatgctcctaaagcg

SEQ ID NO: 26949 - DNA, 393 bp, Glycine max
  Peptide Sequence Number=SeqID_118634
gaacgtcctgaattgaagctattcttccacggaaggaaggttcagaaatttgggaggcctgctcctgaaagtcaagggctagtcgctgtcacaggattaagttctttgatcgcatgttcagtggacacttgtgatcgggaacttatattcgcttttgtggagaggtggcataagaaaactagcagtttccatcctcctgttggagaggtgaccatcaccctagatgatgtgacctctctgcttcatctttctattataggcgcattccaaagctttgagactctgcatgtcgacaaagcggtcttaatgttggtggagttacttgaagtctttggagaggaagctagagttgagacagcacaatgtcatggggcatacatacacatatcgtga

SEQ ID NO: 26950 - DNA, 426 bp, Glycine max
  Peptide Sequence Number=SeqID_118635
atggggacaaatcaaaatagaaaaagattctatcaagtcaagattaagggcctaggtgtcaccagccttaaggagttgggacggctgatgggacccctccaaagtcaagccttccacaaagtgtatggaaagattttagatttgaccacagcggaggtatttacagaagccattgtatccctcgcccaatactatgaccagccgttgagatgcttcacgttcggggacttccaaatagtaccgactgttgaagaatttgaggagattttaggatgccttcttgggggaagaaaaccgtatcttttctccggatttcttccctccttgagcaagattgcagctgtgatcgaagattcggcgagagagttagatcgtataaagcaaactcgaaacggcatagtaggccccgtttggcgagagagttag

SEQ ID NO: 26951 - DNA, 234 bp, Glycine max
  Peptide Sequence Number=SeqID_118636
atggagtggttagcatgcttaggagagattagagccaactttgacagcgaacgctggtccttaagattgatggcagaaaggccttggatcttcttcatcaatgaagtcctttgcttcttgaagatgaatggcagcggaatggagaagaagaaagatgattggaaatgccacttcaaggagaagatgagtcaagaagaagctcaccactataggaagccatggataagaacttga

SEQ ID NO: 26952 - DNA, 222 bp, Glycine max
  Peptide Sequence Number=SeqID_118637
atgtggtaccatgtcagtgaaaacctcgtcggacgcctaggagtacatgacaagacaaaccacacaataataagtcaagtcactctcactagttttaactcgtcacccttaaagggtcttagcattaactcaccgcccttaaagggtcttataattaactcatcgcccttaaagggtcttataattaactcaccgtccttaaagggtcttaaagtcgtgtga

SEQ ID NO: 26953 - DNA, 243 bp, Glycine max
  Peptide Sequence Number=SeqID_118638
atgccaccaaacgcctgcccctcagtggcatatccgaggcaaggctcggagttggctagagtgtggtctcgggttgggaggcaagccatatggtgggaaggaatgcttgttctgaatctgcacaaaatgggggtcgcacgcacttcccaatgctttgcctccctgacctaccatatccaaggctggatgatttacttgattgaagctaggtgggtgagtcgggtccacttttgtggcggttga

SEQ ID NO: 26954 - DNA, 555 bp, Glycine max
  Peptide Sequence Number=SeqID_118639
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccggttagacacgacttatcgccactggcagcagccactg

SEQ ID NO: 26955 - DNA, 180 bp, Glycine max
  Peptide Sequence Number=SeqID_118640
atgacgacaaccaccaccacgcgagtagctcagcgagagtcattttggggggttagtagcttgaacaagattttcataaactcgtggactcgaagtagactcgtgaatctacccaaactcgttcgagtctacacaaaatcggacgagtctactctgatttcgattctacttccgatttaa

SEQ ID NO: 26956 - DNA, 435 bp, Glycine max
  Peptide Sequence Number=SeqID_118641
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttagtgtggagtagcaaaattaacggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 26957 - DNA, 507 bp, Glycine max
  Peptide Sequence Number=SeqID_118642
atgccaatctccccctgcagatgtatcagttgggatcgcgcccataagacgcccagtggacccaaagaagtccaacagggccctagggtttctagctctggttatgggcctctgtcagtcctacagggtgcccatcccccagcgagatcatgccattgtgacatagggatcgcgcccacaagacacccagtggacccgaagaagtccaatagggccctggggtttccagctcttgtttcgagcctctgtcagtcctacagggtgcccgttcccccagcaaggtcatgccatcgtgacataggaatcgcacccacacaaactcccaatggacccagagaagtccaacagggccctggggtttccagctctgggatcgcgcccgcaagaaacccagtggacccgaagaagtccaacagggtcttggagttgccaagctctaattacgggactctgtcagttctacggagtgcctgtcgcccccagcaaggtcatcaggccctctactaa

SEQ ID NO: 26958 - DNA, 183 bp, Glycine max
  Peptide Sequence Number=SeqID_118643
atgcgacaaaaaatccagaggctatctcagggaagtttgactgtggaagaatactacaaggagatggagatggagtatgtggaattggatgacttactgcataaggcagtctgggttgagcagcaactgaagaggaaaagtgcagcaagaaggaactcatccaacactttcaaccagaactag

SEQ ID NO: 26959 - DNA, 336 bp, Glycine max
  Peptide Sequence Number=SeqID_118644
atgacccaagagctggtagcccgcggagacaccttacggttattcgcacctcgtcattcagtgaccccaagtgtgattgacgagcagaggccaatgtggttatccgcacccttgtgtcatccagaggcggcgggcccgatgatacgcggagataccttacggttatccgcacccttgtgtcatccagaggcggcgggcccgatgatacgcggagataccttacggttatccgcacccttgtgtcatccagaggcggcgggcccgatgatacgcggaaatacccaagtggttatccgtataaacattcttttgctatctgtaagacagaacgcttga

SEQ ID NO: 26960 - DNA, 457 bp, Glycine max
  Peptide Sequence Number=SeqID_118645
gtatggcgctactaggcaccctctggacccagataagtccaacagggccctggggtttccggcgctgatcatgggcctctgccagtcctacggatttcccatcacccccagtaaggccgtaggcgcaccgccaccacctcggcaggccgatgggccactaggcatagagcgttatctacagcatttggttctccagcaggcggccaaccaccgtgggcaggtgcagatacatgagtgtctctaccagttcagcctcagtcagcaggggttgcgttccaccacttctatatgccctaccccggagcagtttggggctgaggtcgcatggcctggagactggcccgatgcccagataggggaggagcctgcaggatcccccggtgaggcggatgagtcccatatggatgaagatatgactgacctgctcgatttcttgggagagagcggagccacgtga

SEQ ID NO: 26961 - DNA, 369 bp, Glycine max
  Peptide Sequence Number=SeqID_118646
atgtcacgatggcgtgaccttgttgggggggacgagcacccggtaggactgatagaggcccgtaaccagagctggaaaccccagggccctgttggacttctccagatacttctcagggggagatcggcattgtggtcacttggcagaatgttgctaagtagcaacgtcatccatatctttgtaagagtggtcatgttggtgcgcatgatccgcgctcatctctttgcagcagcacaggtgaaatcttgccccggtatgcatagtggttgcacaatagcctcctcctctggttgtgctcgcacagttggccctcctccaggatcaaggggtggcctaggaactcataaaaggaaactactagccccttaa

SEQ ID NO: 26962 - DNA, 252 bp, Glycine max
  Peptide Sequence Number=SeqID_118647
gtctatggaattttatgacgaggattcctgacaagattaggtctattgatggttcaaaagaaacgcttaagcttgttgttaggatcaccgatctttggtttgttgggactcctaacaagtctgagcaagcggagatggtttttgttgattctgagggtgatcaaattcatgctatttgtaaatcggaccacctcaagtcttggaaagctgatttgaaagagaattgcacttctgctatgcataatttcaggg

SEQ ID NO: 26963 - DNA, 357 bp, Glycine max
  Peptide Sequence Number=SeqID_118648
cgtgagctatgagaaagcgcacgcttcccgaagggagaaagcggacacgtatccggtaagcggcagggtcggaacaggagagcgcacgagggagcttccagggggaaacgcgtgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 26964 - DNA, 453 bp, Glycine max
  Peptide Sequence Number=SeqID_118649
gggacttgggcccggtccgccactgaggacgcttctccagactacaattcggacgccgagggcgacgatttcatgcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggtagatga

SEQ ID NO: 26965 - DNA, 342 bp, Glycine max
  Peptide Sequence Number=SeqID_118650
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtttttggtgtcaacaaaactgagtgggtatatacttccaataggcaccttcttgactgttgttggaaag

SEQ ID NO: 26966 - DNA, 390 bp, Glycine max
  Peptide Sequence Number=SeqID_118651
atggttaagcaactaagggggaaggatattcccttggtcaaagtggtatgggggagtgctttgattgaggatgccacctgggaactagagggtcagatgcgtgacacatatcctaccttgttcgataccggtaaatttcagggccctaacaaagcaaccggaggaggagctctagagagcaccagaaacgtcaacattgctaacaaagaacgcttgagcgactacctcaagccacacaaaaaaataccaaaaggctgtcattgggtggagaattctcatccacttgctgtctcattcggtcataattatgctattggcccaattggagttctaactatagctgcaatctatcccattttggggagaagtgtactccagtggagttggtaa

SEQ ID NO: 26967 - DNA, 306 bp, Glycine max
  Peptide Sequence Number=SeqID_118652
atggtggcagagtatgcaactaggtttgagaacctggtaaggatctttgatgaggatcaactagagaaggtcacattttataggaatgctaatgttagtcatgggaaagagaagaaccttgtgactcacaatcgtgctaagccgtattctgtccctcctgggcaatatggcaaccactttgggggacagaagaccagcgaaggacttcacccagctggtgggagttcccagctagttaacaaggtaagggccacctcactaccagttgcccatattcgaggaagaaaaagaggagtggaagtttga

SEQ ID NO: 26968 - DNA, 396 bp, Glycine max
  Peptide Sequence Number=SeqID_118653
atggcttatagggatgtgaattcatggaattcaatgatattggattttgcaatgcacggtgaggctgaggctgcattggactattatgtcagaatggtgaaggtggagaaacttgtgcctaattcaatcacttttgttgatgtcttgagtgcatgtaaccataggggaatggttgataaagggattgtgcattttgacatgatgactaaggagtacaatgtggaaccaaaattggagcattatggttgccttgttgacggctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaa

SEQ ID NO: 26969 - DNA, 237 bp, Glycine max
  Peptide Sequence Number=SeqID_118654
atgtataatctcaatcatctagttaggaaagacttagtaattggtcttccaaaactcaagtttgagaaaaataaattgtgtggagcttgtaaaaaagttatagtagacaactactcaaggttcacatggactttatttttaaaaaccaaaaaggaagcttttgatgcttttcgcaaacttgccaaggtgattcaaaatgaaaacggtctcaacattgtatcacttagaagtgattga

SEQ ID NO: 26970 - DNA, 844 bp, Glycine max
  Peptide Sequence Number=SeqID_118655
atgattgccgggccatgcagtgctgaaagtgaagctcagatgttggaaactgcgagaaggataaaagaaaccaatgcgcaggtgcctgttttcagggcaggtatctggaaaccacgtacaaaacccaatggatttgagggtgtcggagttattggattaaactggttgaaaaaagtaaaagaagaatacggcttcaaaacagctaccgaggtagccaacgcacatcacgtttttgccgctttggaagcagatgtggatattctttggatcggagcccgttctactgtgaatccattcaccgttcaggaaattgcaatggctttaagaggaacggataaacctgtattggttaaaaatcctgtaaatccggatctggcattatggatcggagctttggaaagacttgtagggcaagggattcacaatctgggagctatacacagaggtttctctacataccagaaaacaaaatacagaaacaatccgaactggcagattgctctggatttcaaaagccagttcccgaatattcctatgctgattgatccttcccatatttgcggaaacagaactggattggcagatattacccaggaggcaatgaacgtaggttaccagggagctatcattgaaagtcactgtaatccagatgaagcatggagcgatgcttcacagcagattacaccggaagttttagctgaacttattggtaatctaaaaatgagaaatgcaggattagcaggatttgacggtgaaatgggaagacacagaacgttgatttctgatctcgattttcagttaattgagcttctttcccaaaggatgaaaatctctgagaaaattg

SEQ ID NO: 26971 - DNA, 318 bp, Glycine max
  Peptide Sequence Number=SeqID_118656
atgatgaaccaagcaattttgatgatgccaaaagcccaagtgattgattcaagacttcaagatccagcatcaagaatccaatccaagattcaagattcaagagaagaaatcaagaagcaacaagtcaaaacttcatataggataactccatttgagcttataggccttggatcttcttcatcaatggagtcctttgcttcttggagatcaatcgcagcagaatggagaaggaagatagatgatcggagaagccacttcaaggagaagatgaatcaagaagaagctcaccaccataggaagccatggataagagcttga

SEQ ID NO: 26972 - DNA, 249 bp, Glycine max
  Peptide Sequence Number=SeqID_118657
atgggggtgcaaatagcaaccaggcccacttgggccctccagaagattcctccagaaggctgttgcttctggaggaagcaacctggctcgctgggcggcaaccatctcccctattttgctataaataggggaggaaccgaggcgcttccgaaacgtttccgtaacgttttccgtgaggaatttcgcaaaggttttgaccgttcttcgacgttcttcattcgttcttcatcgttcttcgatcttgaacgg

SEQ ID NO: 26973 - DNA, 234 bp, Glycine max
  Peptide Sequence Number=SeqID_118658
atggagaaggattttgctgtacatctcaatcaatggtcctcaaacctaaaggaagctttactagctaggtggggaggggtggtttataaccatgatccagctaaatacttactatcaacagttgtatctctagtacctctggtcatcaccactgcagtagaatttaagttaaacttagataagtaccttatgaagaggccagctaccttgtcacagctaacaagtcagaactga

SEQ ID NO: 26974 - DNA, 690 bp, Glycine max
  Peptide Sequence Number=SeqID_118659
atgcagaagaaacataaaaagaaaaaaagaaaaagaactgaactcaaagtcaattcttcaaaggaagactacaaagaaagctctagtgatgatgaaaatgtagagaatttaagcttgatggtgaagaagattagaaaatttctcaaaagatccaaagacagaaaattctctaaacctttgaagaagattcaaagcaacaacaaaaccttcacatgcttcgaatttgggaagcaaggtcacatcaagtgtgaatgtcctatctaccttagaaaagaacttgttgaaaagaaaggaaagaagatcagaaaacagaaaaaggcctacatagcttgggaagacaatgcatccacgttctctgactcttctagtgaagaagatgtttcaaatatgtgcttgatggcagactcaatggatgactcctcaatcattgaagaaactgaggtaaattctgaatttgaagaagatttggaaacatttaatgaaatgcatcaagaagcacaaaggcttgttgtttcaaacaaaaagatgagaagcaatctaaaactacatatcactaaattggcttcaatacaaagtgtgctggataaactgagacaagaaaatgaaaaacttgtttcaagctataaagctactaattgtgtttgtgcttctacttctcttatatggatgattacaaatctttgcaattag

SEQ ID NO: 26975 - DNA, 357 bp, Glycine max
  Peptide Sequence Number=SeqID_118660
atgaggttagacactgatactggtgttcgaggaagagcctcatttctgttgatagcttgtgaaaggagtggtgagtataggcctaagaaacataatttggtaagaatatgcactagcagcagaaaatgtggatgttcgtttaagttgcgtgcgaagccagtttcgggaggaggaggatggatggtgaagttaatttgtggggctcacaatcacgaaatggcaaagtcattagttaggcatccatatgtgggtcgactaacaaaggatgagaagattgttgttgctgatatgaggaagtcgatgtacctacaaaacaaatgttggacatgtggccttaataacataagcggggggtga

SEQ ID NO: 26976 - DNA, 210 bp, Glycine max
  Peptide Sequence Number=SeqID_118661
atggatttggacttggcactgaggacagaacgacccatttccactccaaaaacctctaatgagctctctattccagaggcgtttcggggctatatttctaagggtcaaagtgcaaagaaattccttgaggaaattgagcaacactttgccaaaaatgaaaaatcagatatgagtaaccttttggctaaactcatctccataaagtattaa

SEQ ID NO: 26977 - DNA, 279 bp, Glycine max
  Peptide Sequence Number=SeqID_118662
atgagtcttcatttttcatctagtgttaatggtgagggttctactcctaaggatcccttgtataagatattagatgagttgagatcccttaagttgtggaaagaaaaacaagagagaaatgaaaaaggaacgaaggattcatgggatcctccagtagagtattggaatgatcttaagagtgcccttaggaagagacacattccctcctactatgaaagagagcttatggacaagctccaaaggcttagacaagggagtatgagtgttggaagaatatag

SEQ ID NO: 26978 - DNA, 283 bp, Glycine max
  Peptide Sequence Number=SeqID_118663
atggctaagtttgaccctgaggtagtcctggatttttatgctaatgcttggcccacagaggagggagcgcgagacatgcgttcatgggtaaggggtcagtggattccttttgacgcaaacgcactcagccagttcctgggtgacccgctagtattggaggagggccaggagtgcgagtttcagtcagaagaggaacagggccgacgggttcgacgaggaggccattgcccagctgttatgcacaccggggcaggatttcgcccggactgctgcagggaggcgg

SEQ ID NO: 26979 - DNA, 177 bp, Glycine max
  Peptide Sequence Number=SeqID_118664
atgaagaagatcctaggcctacaagctccaatggagcttacatcatacaagctctacatggagctacatcagcatctttcatggtgcatagttgatcgtggggaattcatgtcaccgctttcatctcgtgtacttggagaccaatgcaagatgctaccgaaattccatgaaatttaa

SEQ ID NO: 26980 - DNA, 166 bp, Glycine max
  Peptide Sequence Number=SeqID_118665
atgggggtgcaaatagcacccaggcccacttgggccctctggaatattcctccagaaggcggcgcttccgaacgtttccgtaacgttttccgtgaggatctcgcaaaggttcaaccgttcttcgacgttcttcattcgttcttcatcgttcttcgatcttcaacgg

SEQ ID NO: 26981 - DNA, 349 bp, Glycine max
  Peptide Sequence Number=SeqID_118666
atgtcaccagccttaaagagttagggcagttgatgggtcagctccagcgccaagcctttcgcaaagcttacggtaaaatctgggacctagccatggtagaagtctccatagaggccattgcctccctcgcccagtattatgatcagtcgttgagatgctttacctttggggacttccagctgtcacccatggtggaagaatttgaagagatcctaggatttcctctagggggaggagaccatacctcttctcaggcaagaaccttggcagctagagacgaatgggtcccgttcatagacgttcttgcactgttgatcttcggaggagcactctttccaaatatggatag

SEQ ID NO: 26982 - DNA, 93 bp, Glycine max
  Peptide Sequence Number=SeqID_118667
atggaggttgatgaaccgttggggttatggctaccattgaattatcaagtggtgtttgtcactggaagtgcggtaggtaggctttgtggttga

SEQ ID NO: 26983 - DNA, 933 bp, Glycine max
  Peptide Sequence Number=SeqID_118668
atgaacaaacaccccaaattgaccgaggccgacgtcacgccggagagcgtattccaccagcggcgcaaagtgctgcaggcgctcggcatcaccgccgcttcgctggcgctgcccaccggcgcacaggcggacctgctgtcgtggttcaagggcaacgatcgccccaaggcaccgccgggcaaagcgctggaattcagcaaaccggccgcctggcaggcgcagttggcgatgacgccggaagacaaggtcaccggctacaacaacttctatgagttcggcctcgacaaggccgatccggccgccaacgccggcgggctgaaaaccgaaggctggaaagtgcgcatcgacggcgaagtggcgaagccgataacgctggatatcgacgatctgatgaagcgtttcccgctggaacagcgcatttaccgcatgcgctgcgtcgaggcctggtcgatggtggtgccgtggatcggtttcgaactgggcaagcttatcaagctggccgagccgaacagcaacgcgcgctacgtggccttccagacgctgtacgatccggagcagatgcccggccagaaagatcgctttatcggcggcggcctgaaatacccctacgtcgaagggctgcggctggacgaggcgatgcatccgctggcgctgctgaccgtcggcgtgtacggcaaaaccctgccgccgcaaaacggcgcgccgctgcggctgatcacgccatggaaatatggcttcaaaggcatcaaatcgatcgtgcatatccgtttggtgcgcgatcggccgccgaccacctggaaccaatccgcgccgaacgagtacggtttttacgccaacgtgaatccgcacgtcgatcatccgcgctggtcgcaggctaccgagcgtttcatcggctccggcggcattctcgacgtcaaacgcgggatcctctag

SEQ ID NO: 26984 - DNA, 282 bp, Glycine max
  Peptide Sequence Number=SeqID_118669
atggtgagaatagatgtgattcgggaacctaccagccaaggatgtactcgtgaagatgctgatgagttcattttttgtagctacaatggacacaactgggtatcttccaaggtagaatgtgatcacattctcggttcccgtatatcctttctctcttctctgtatctcatcagctcacagattgatgccgcactgggcattgtgagtcacaacgatgactttcaatgcggtgttggacccaaattcagagtctctctggtggagcacgctgttgcagcgtga

SEQ ID NO: 26985 - DNA, 234 bp, Glycine max
  Peptide Sequence Number=SeqID_118670
atgacgactctttgcaaatctagtaaaaggtatcaatgggcaataattgtcaattttgtgggaaatctgaacacttccaaaaggattgtcggaagcgtatgtcttggttcgaaaagaaagaaaatccttacaatccaacccataagtccaaatgggaagttagtcttcatagggaatagagtgaaagctccaatagaagcagttgggatttatggtttaaaactaaaaaactag

SEQ ID NO: 26986 - DNA, 987 bp, Glycine max
  Peptide Sequence Number=SeqID_118671
atggcaagccaagagaagtggggcccgtttgcggatatattagctttgttgatttttggggttgtcctctttccgaatgttgacggtttggtagacttagccgccattgatgctttcctcgcatatcatcatagcaaggaaagtccagtggtggctatcttggcagatttgtttgacacctttgaccggaggtgtgagaaaagcagtgcacggattgtctgttgtttacccgttctctgtgtgtggttgatttcacacctattccaacaagacacaagacacccgtgtccgcttcaaagttattgctcatgcgccgaaaaaggaagagtcgattgggaccaacatttggcggagatagggggcagcgcaatcaattggtttcctcgttggaaggaaggcaaggaaggagttcttttctcgtgtggggactaccctaatgttccattgatagggactaaggggtgtattaattataatctcgcgcttgccataagacagctagggtaccccatgaggggagcgccaacggaagggagtctctcacctttccttgtgaaagatttaggcgcgcaggtctcaaggttatacaaagaatccacaaggcgtggagagtccgttgaggaaagacaagagcttaggggcatccgaaacggcgtcatcggaggttatcatggatggctaagaattcacacgcggggcttagattggctctccaaattgaaagttatcgatgaggagaacttcgaagctctagaggaagatgaagaagtccgagctctaaagttagagctagggaaagcgagactcgccaaggagaagttcaaatcagctgctacacacatccggaaggagtgcactgagttacaagaggaaaacgcggccactgcaagagctcttgaacaagaaaccaaaagggcccgcaaggaggaacatggccgagagaaattccgaggagcattgtggggtagcaacaatgagaagagttag

SEQ ID NO: 26987 - DNA, 360 bp, Glycine max
  Peptide Sequence Number=SeqID_118672
ggtgatgcaccacaggccacggacgcgccgccacctcatcaggctggtccagcaggatcgtttgatacggagcagtatttgcggcatttggttcaccagcaggcggccaaccactgggcacatgtacagacccatgattgtcgttatcagatgagtctcagcctgcagagccagggctttacttcttttccgtgccctactccggaccagtacagggcagaggtcgcatggcctggagattggcctgaggcccaggcaggagaggcaccagcagaggctcccgacgaggcagatgaggcccgcgaggacgaggagatcaccgatttactggatttcttaggagggagcggggccacatga

SEQ ID NO: 26988 - DNA, 342 bp, Glycine max
  Peptide Sequence Number=SeqID_118673
atgaatgatgctctcctagacaaggtagaaggagataaactgtacaagctcaaggttcaatcaaacaatcatactttcagcttaaactgggtgcaagggataaatcattcatacacaagagattcatgcaaaaaccattgcttactgctattcgttctctcacaattaaagatcacactctcaccggacaagataataataaaactgttcaaaaagcatggaaataaaaatcctgatcctgtcaatgatcctatgcatgctcattcaggtccagtgctagtgcagatgatgggtcctgagaaagaggcaggtccaacattggtgcaaatggctcaggcttag

SEQ ID NO: 26989 - DNA, 102 bp, Glycine max
  Peptide Sequence Number=SeqID_118674
atggctctggctcaggtggagtgggctctaaggcctctagaatgtcatcctcctaatcctgctgaggcttctgggatgcagaggcctcaccctctcctatag

SEQ ID NO: 26990 - DNA, 924 bp, Glycine max
  Peptide Sequence Number=SeqID_118675
atggcttcaaagagaagaaaatcatctgcttcttattcttcccacattagatttgacagatcaagattccattcacaggaagcttgggacagatataatgacattgttgttcctaggaagctattgctagagagaaatgaggtaatctaccacactgaatttgatgagttcaaggaggaattggagagaagaaaatgggatgaagaactgactagctttgatgaaggcaacattgatgttgccatagtaaaagaattatatgctaacctctatgatccagaggacaaatcaccaaaacaggtgagggtcagaggtcatttgataaaatttgatgaagacaccctcaacacattcctgaagacccctgtgatcattgaggagggggagacattaccaacctactctagatttgcactcttgaggcctgatcctcaagagttagctgctaagctttgcatctcagggaggggatttgagctgaatgctgatggtcagcctttgaagatcttaaggaagaacatgaccaccctcgctcagacttggagtgttctttcttactccaacttggtccctacctcccacacttctgatatcacattggatcggcatgactcctctaggcttggatttccagccttaatcatagctttgagtaaagctagaggagtcacatcatattccagatccttggagagtcttagccctgccattaacttggcatatataaagaagaactgttggaatctagatgatccaatagtgacattcagagggccaaggaaggctaggggtaagagatctgaggctccccctacttcagtagcaccagatgcttctgctccttcttcatctactttaccagatccttctacaataacaccttcttcttttactccaactactcctgctcttataccagtttag

SEQ ID NO: 26991 - DNA, 1203 bp, Glycine max
  Peptide Sequence Number=SeqID_118676
atggaaaagcccactgttgagcgaaaatcaccaagaccctctgccaccccacctgatgttgagagtgagaagctaaaagcagtagatgacttgaaagaagcacaaagagtggatgaggaagcaaatgagaaactcctggaagcattgattgctcaaaaatgccctgaggagaattttgagattgagaagttccgaaagaagaaagaagaatggcagaaaaagattgaaagtgtgaggaaccagcatgcattgaacatggattctcttctctccaccactcaggagcttcagcgggttaaacaacaacttgccttgacttgttatgcaaagaaccaggcattgaatcatgctgatgatgcaactaaaattgtcgagattcttgcagagaaagcagagtttttatcaagtgaattgatgcgattgaaggccttactggattcaaaagtggaaacagaggctagacaaaatcaacttatattgaaacttaaaacagatatagaagctctcaaggaagaacttgaaaaatcaaagggttacgatgataagttgtcagagagagaatcttttattgaactgcttaatgtggagcttgtagcttcgaagatggatgaatcttatgcacgtaccctactagaggagtggcatacaaaggtagaggaactagaaatgaggattgaagaagcaaacaaattggagatatatgcatcagagtatttggaatctataatgaaacgagtagaaggaaacaatgatttgttgcatgaagcagaatctgaagttgatactcttaaagagaaggtggaattattagaaatgacaattgggagacagagagcagatgttgaggattcacaatgccaactttgtaaggctaaggaagaaagtcttgaaaagtcaaaggaagttgaggctctaacatctgaacttgagagggttaaggaagagaaagcacaggctttgaatgattccatgcttgatgaggcacgatatgagattaatgttcttgtatgtattattgaaaattctaagagtgcctttgagaactccaaggctgagtgggagcagagagagcttcaactagttagctgcataaagaaaaatgaagaagagaaggtgtccctggaaaaagaaataaaaagattgctttatttgcttaaagaaactgaggaagaagctaatgccaacagggaggaagaagcttag

SEQ ID NO: 26992 - DNA, 2388 bp, Glycine max
  Peptide Sequence Number=SeqID_118677
atggggtttactttggttgaccttgaaaagtttggttacaaggatgagcctttcatcatggcagcacaagttagacaggggaaaacaagttgtatcccttaccatattgatgcttcaacacttgttgttaatgaactacccaccttttccccacagatgccttccataaatgctgaaaatgaggaggatgatgtagacgcaaattgtaacgatcatgatgaaggtttatgtgagaatacagctacaactgtgtgcgggaaaaaaatcccaattgtacacttgagttcgaaagttgtctcgcaatctctgaagaacctaatatgggatgacattatgggtaaatttgacatccctaaaggatcaactgccaagaagaagggtgaggataaacttgatccttctgctaagtatgctataatcatcgatcctccatctccaattgcaagacatatgaagtggaagatggcccaaacaaagcaatataggcagatgacatctatagaggcacaacaaacctctgaaaaaattgatgatttacaagaacacaccatgcagggtagctttgttcctgatggtcatgaggacatattgaatactgcgcttgggcgaccggagcatcttggtcgtgttcatgtagctggccatggtgtgaccatcaatcagtactttggacaggcattgcgtgcctccaacacttcttcggccacaatcaccccagatcaattgggggctgcccttgctcctaagtatcctcaggggaggctcgcccatgcgagctggttacttagctctaaaggcatgagctcacccaagcgagctggttacttagtcatgaagttatttcatggcccaggtctgacaacctcaaaacactcacccttagtggacgcgcctgatcctcacatattagttgcacatgtcagcaccaaaggaagtcgtgttgaagctgctgtaaatgttttacctgaagagccttctattgttgatggcaccacgatacacaatgtcccttatgcagatggtgtgttgagggtgagtgttgtaacagtttacgacgctgacatgcgggtcccatttccaatgtcaaagattcagtatgtaaggaatgcagttaacacattcattgcatggccgacacatctagtgaaacctttatctgatgattcacacaataatgtgccaaaatcggttggacgtgttgagaggtgtaatttaggtgctggagaggatccattgggagaattgatgaagatcttgtatgacatttacttgaagccagttgcactgacgtgggatgggatgaaatacgagcttccaaatgttgaagcatcctttttcatcacacatgcatatttaactgaaataataccaggtgacaagtgtttgaacatgtctatactacagttgtggatgataagaggtcatggtttccttgagcctcagtctatacccaatgctaaggatagacatcaacaatgtcaacaatacattaaaacatgggtcaaggagtcgcaacgacaactgtacttaggagcttacttgaatcaggataacattgttgtttggttttgttctttgcggaagaagcctgatattaacataaaagttgcaattaacagtgcaatgaagacaataaccagtactttcgaaggtatgttgatcaacctgcacctcggtggattgaagcgaagggtaatgcttgtgggttggggtggaaacaacggctcgaccctcatcggtggcattccatggtctacaaaggacaagattcaacaagccaattactttggggacctcacccaagcctcagccatccgacatggatccttccagggagaggaaatgtatgccccattcaacaccttgcttccaatagttaaccttgacgacattgtgtttggggaatgggatatcaccaacatcaatctgactgaggttcgtggctttctggggcagcaacaacttgagagtgcactcattggcatggacttggtaatcatacttgcaatgagttgccccaatgcaattgtcaacttcattagtaatccagtgaattccacagttgctattgttgcagaggtttttaagaaagtcggtacatatgatccaaagcgactattgggtgttacgaccattgatgttgtgagggaaaatacttttgtggcagaggtacttggagttgaaccaacaaaagttgatgttccaatggttggaggtcatgatggtgtcacaattttgcctcatttgtcacaggtcttggatcattgccgggaagacaaacttaatgggaaaagggctttgaatttagccaatgaggataaaattgatggtgatgatgatgaggccaaggggatcataacttacatggtcatcaccttcgttgtttga

SEQ ID NO: 26993 - DNA, 300 bp, Glycine max
  Peptide Sequence Number=SeqID_118678
atgaaacaccttgtttatggttcagcttcttgcggcggcgctcggccacttggtgtctgcagcgatggtttgggaagaaccatcgtcggggttcttggcgaggaggaacgggatcgtggagaggatgtacttgaggaggcactgcctaatgcaatccgccgccgctgtcattgggtggaagtggtgggggatgtcatggctggtgacgtggaaggtgccccagtgacggcagaggaggaagagagggagttggggagtcacagagggagagtgagaaatgagagacgagagggagattga

SEQ ID NO: 26994 - DNA, 291 bp, Glycine max
  Peptide Sequence Number=SeqID_118679
atgacagcgcagttgatccatgatcgcgtcatgatggagtgcctagagggtgtttgggaggccctcgaaggcaatgagaggtgccgattccgtggcacagttcgactcactgctacttcgctagagttatctcttgaacctgctatggatgcccctgacttaccagaggatgatgaggacccgctccctgatgttgattctccagaggatattatgccagcatctgaggcagactctacggaggagagtggccctggagggacagcgaatagtgacgacacttcatcatag

SEQ ID NO: 26995 - DNA, 678 bp, Glycine max
  Peptide Sequence Number=SeqID_118680
atggtgcccatgaacctgagagtttccggtgcgacattccccgccaatgaattaaagctgatttgggctgggtatgggtcaagcgggtcaggaggggaggaaggctctggaagtgcaacagtggccgcggtgatagcgttcatcgcaattgaagcaaagcccacgctctctgcggaggaggggagaaaagggtggggtgatcgttctgagaggggaaggttgagtcagggaggggtggtgggcgagcatccaggagcttttcttcctgtagacgcgccaagccggccacatggacgagggttaaaggctgatgagcctgaacctcgcggcgaatggggtggggaggccaatggtgcaattggcgagatcctcgaaggttgcaagatattccgccaccgtgccacgctgagtcaacttaaacaaggttccggtggggtcttcgtactacaacggagcaaagcgcgtctggagggcttggagaaacgctggccaggaagtgaattggccattaccggccatccaatggaaccaggagaaagcacgaccatccatataaaacgacgcgacggtggaggtccagaggatggggaaggagaggaagtgtgtgggtcagtgagggcgggtggaagggtgggagaggagtcagccatggaaggagcaacgagagcaccaagatga

SEQ ID NO: 26996 - DNA, 1314 bp, Glycine max
  Peptide Sequence Number=SeqID_118681
atggcaacacaaatctgtagactacaatatcttcgtactttgacagtttttattgttggcaaacaagatggattaagtatcagagatttaagaaaatttccttatttgttgggcaagctttccattctgaacctgcaaaatgttgtcaatcctgtggatgcatttcgggccaacttaaagaacaaagagcaaattgaggagcttatgctggagtggggaagcaatccacaagatccacagatcgaaaaagattccttaatgtcagtcagtgattgcaacaactgcttgttacttccaccctttggacaactaccttccctgaaggagcttgttatcaaaaggatgaaaatggtgaaaacagttggttacgagttctacggcagcaatgcaggctcacagttgtttcatccgtttccatcactagagagtctggaatttgaagatatgtcagagtggcaggagtggctaccatttgaaagtgaaggcagaaactttccttttccttgtcttaagcgtttgtacttatacaagtgcccccagttgagaggaaccttgcccgattatctaccttcactgacaaatgttagtttctcagagtgcaaccagctagtgccaaacttatctgatgtgcactggaatatatcaattgaagtaatgcatataagagagggacaagaaggcttgttgtctattcttgacaacttctcttattgtgaactattgatcgaaaaagctttatatccgttttattccaaacttggaagcaattactactcaaggtggaggagcagcttccaaattagttgttttattgtcactgattgtgagaaacttagatcactgccagatcagattgatctccccgcccttgaacacttggattccgaagctagattgtccccaaggtgttttccttccggtttacgatcactttacgttgatgttcgagtactatcagctatgtctagacaagagttaggtttgctattccaacacctaacttctctgtcacatcttttagttaagggtctccgtaatgatgaagatcttattaacacccttttgaaggagcatggtttaaagttgttggatggaaaagggcttcaaaatctcacttctctccaaatgcttcacatgtacaattgtccaagctttgagtcctcacctgaggatcagcttccatcctctcttgtaatactcagtttaaggaagtgtcctttactggaagcaaggtaccgaggtcagaatgggaaatactggtctaagattgctcacattcctgcaatccagataaatgaaaaagtgataatatga

SEQ ID NO: 26997 - DNA, 309 bp, Glycine max
  Peptide Sequence Number=SeqID_118682
atggtttatgataaaatccaaactgagaacgggttttcaaagctatcaactgtagaaagacaagaaattcaaatgaagaaagccaaactaattggtatgcttgatgaggtatttgaaattgagtatgggtattgtgcagagtatcatctcgggcagctcaaggcaaaaatagcaaaactgaggacacaattattggagcctccaaaaggatggtatcatggtggtcatgatgaaggtgttaaatttatcaatattgaagaagaacaagaaattcatcaagctgagatagatgaaacatgctctagctga

SEQ ID NO: 26998 - DNA, 645 bp, Glycine max
  Peptide Sequence Number=SeqID_118683
atgggaagttggtgcttcccttcctcttgtatgagggtggagctaacgacttcgtcaactattgagagatataagaggaagggtactcctggtccaggtcgactcaaaactggtgcaacttgtagaatgacttcagtttttcaacgagcttggggaggaacttggacatggatgctagtttgccgtttaacttttggacttcctagatgggttggcttctattccccgatgtgtgatgataaagcccaggaacttgcctccgccgaccctgaaaatttctctgaatacctcttccaagtctgccacatgttgggctatgctacgggatttgacaaccatgttgttaatgtagacctcgacatttcatccgatatgcttttgaagatacgatccattaatctctggacacaccctgttaaggtcggtgtagttagtgcatattcccatttgcagttggcctttttgaccatgatgatgttggcaaaccagcatgtcagatggctgccaagcaaacaggttcgtgttcctgtttatgacattagctatgcatctctgctcatggctggtgaggtctctgctgagctgcatgcactacccgagtttgggtccgagctgcagcttgacaagttcttcaataggctttag

SEQ ID NO: 26999 - DNA, 642 bp, Glycine max
  Peptide Sequence Number=SeqID_118684
atggttagaactagaggtttgggtcgatctttaagcagggttataggaagagccctaaggagagaagttagttgtgattcggatgaagcccccgagcggcgaaggcccacagcatctgcactccatgaacaacatgaagaagcaactaatgatgatgtagtcattgatatcaagggtttttcaagcgggccccacaacacatcaattttgagtggctatgttcatcatgttgcagtgactatttggaatggagaggaacatcctgagttgaattttcatcttcctgtaggagaggtgattatcaccctcgatgatgtggcatcgttgcttcatctgcctattataggcaccttccatagcttcgaggctcttcatatggacaaagtcgtcttcctgttagttgaattgcttgaagttagttcaaaagaagtaagagctgagacagtacaatgccatggcccatatgttaggctattgtggctgcaagacacttatcgtagcaaatgtgacgtagcacagtggactatagcagctcgagcatatctcttgcatctggtaggttgcacactatttgctaacaagagtgccacacacgtgtatgtggtattcttggatgcctttcgtgacctcacccagagttga

SEQ ID NO: 27000 - DNA, 1344 bp, Glycine max
  Peptide Sequence Number=SeqID_118685
atgggtttcgagctacgaccgtcgttacaaggcatcaaaagtggttgcacgcgcagtcgcgcagtcgacgaacatgttcgtcgcctgcggatcacgggggtggggctctgtgagaggcttcaaaccattggagaagaactctccgtttatgcaaacaatttgggcgtcaacttggagttctgggtggtggagaagaatttggaaaatatgaaaccagaggacataaaagtgagggaagaagaggttcttgtggtgaatagcattctgcagctgcattgcgtggtgaaggaaagtcatagggctttgaattcggtgctgcagatgattcacgggctaggaattttggttgttcttacccgtagttttctttcacagccacaaacagagatggaagctgtgtgtggaagtttttgggtcacatcctctcttccacgctcacccaacgttgttgtgattgttaactattctaattctaattctaatgcgcaggaacaagttgaccagacttacataatggtcaagcccgacggcatgcaacgtggcctcgggtttaagttaaccgacttgaagctcttcaagtgctcaaaggaattagctgaggagcattacaaggacctaaaacaaaagtcattcttccccaagctgattgactatattacttcaggtcctgttgtgtgtatgggtgttggggtagtcgcatcggcccgtaaacttataggtgctacatatcctcttcaagctgaaccagacacaataagaggagaccttactgttcagacacgaaagaatgttgttcatggcagtgacaatcctgagaatggcaagcatgaaatagacaatatgttcggcatatttgatgtggtggaagctattgtagttgctcccgggaaaattatcctaaccggcgaacatgctgtggttcatggatccaccgctgttgcttcttctattgacttgtatacctatgtttctctctgcttctccactccttccgacaacgaggattcgttgaaactgaagctgaaggaggcagcgttggagttctcgtggtcaatcacgaaaataagagcagcatttcctgaatccacgactcagctatcttccccgccaaactcatgctctgtggaaaatgccaaggtaattgccacactcgttgaagagcttaacattccagaggccaaactcggactcgcctatggagtcacaaatatctttgctaatgattatttttatccacagggaaaatcctctgctgttatcttgaagtttgagctctttcacactccaacacctgaaatacggttagttaatgatgctctttctcctcttctgttcattaactga

SEQ ID NO: 27001 - DNA, 279 bp, Glycine max
  Peptide Sequence Number=SeqID_118686
atgcatcaccgaaagagggaaactctagatgaggcttcacagttatcaagcgagtcagggacccaacatgaccatagatggacctctactccctatggcaaacacatacccgggtatagggcccaatatctcaaagggaagctcacccaagcgagccaattgcttaggcttgaaggtattagctcacccaaacaagctggttgcttaaggatgaaggcattccatatcccaggcaagccaaatgctggcgtaggtgagctcgggtctagaaagttctag

SEQ ID NO: 27002 - DNA, 342 bp, Glycine max
  Peptide Sequence Number=SeqID_118687
atgttcacaggatatggtgtttgctcattacggcaacggtggaagttgcttaggaaactaagcaacttgcacatgcttggaggaaaagctgttgatgattgggcccaagttcgaaatgaagagatagggtacatgcttcgtgcaatgcatgattgtagcaagagaggttcggagtcgaacgagttcaaggacatggtggttgagctcatgaccgttgctgggtacttcaacattggtgacttcataccctttttggcaaagttggacttgcaaggcatagagcgtgggatgaagcagctgcacaagaagtttaatttgatgcgttgtgttgcaatgttctaa

SEQ ID NO: 27003 - DNA, 603 bp, Glycine max
  Peptide Sequence Number=SeqID_118688
atgagaccgttttgggtttctgcgggaaaggaaaaagctacaatgcgaaaggactctaaattggatgtgactattggtccatatgaaacttatgaggataaactttttggatataagtctaaattcactggaaacttgctagcattatcccccttgaaaagacctatgatgctatctttaacttgtgaatcagtattagtaattgcgttgcaattcttttgcgctacctttgaagcatatattggaatcagggatgatgaagcaacagctcaattgaaactcttaggtgattatctgctggatgtcaagggaccacaaactctagctttcaatcttccaaatgatgagcatattgtaaaagaccggggatcatcaatggtcatgcttaagaatgtttcggaggctaagtttaagcatattcttcttcctatagctgctgcctgtgttgcaaaggagcaacaagaacatgtagattttgaatcattctttacgcgttcaatttgccatgaatgctgccatggaattggaccacataccataacacttccaaatggccaaaagtccactgtcagattgctcagttccacaatatgcttcacttaa

SEQ ID NO: 27004 - DNA, 591 bp, Glycine max
  Peptide Sequence Number=SeqID_118689
atggtgtctgctagggtttacggagatgatgttagtgaaggggcaacttatgcccaagaagaggatttgttggataaaattaagaaaaaaattaaagagagtgaaacactattgagtgagggtgtcgtgggtgtgaatgaaggtgttgtgggtgcaaatgagggtgattccccgtatagagagaagcttttgacagagattggaggagatgagattgattttgtggagaaccatgatgaaaacgattgtgatatgatggaaattcattcgttgggagttgagaaaaagaaggagtttgtgcatgtcaaggatggtgtggaaattcctgtgtctgatgaagatcatttaggccataagaaggatggttgcagtgaacctatcatgggtatgaagaaggtgactagaaaggtagctaacgtcactaaagacatgaaagaggtgacaaatgaaggtgttaatgaggcacaaggaggtgatgggaatgttgtgatggaggctaggtttgggctttggatgatggtcacccaaagagatgttaaaaataatgataacgggaacttcagtgctggtgaagaagacttgtcgatgtag

SEQ ID NO: 27005 - DNA, 1281 bp, Glycine max
  Peptide Sequence Number=SeqID_118690
atggtttctgattccaacacttccaggagacaaatagagattgtgtatgaccctgaaggaaggataaacaagttggctgatgaagtagacagggaagcttctctttcaaggcttactttgttctctccttgcaagataaatgtttttttgagaataaccaacaagagggaagatgggtatcatgatttggcatccctttttcatgtgataagtctaggtgacataattaagttctctttgtcaccttcaaaaaccaaggatagcctgtcaaccaatgtgtctggcgtgccccttgatgatagaaatttgattattaaggcgcttaatctttataggaagaagactggcagcgacaagtacttttggattcatcttgataaacgggtgcctactggggcagggcttggcggtggaagtagcaatgctgcaactgcactatgggcagcaaatcaatttagtggctgtcctgcctctgagaaagaactccaagaatggtcaagtgagattggatcagacattcccttctttttctctcagggagcagcctattgcactggtcgaggagaggttgttcagaatattcctccaccagtatctctggatgttccaatggttctcataaagcccccagaagcatgttcaactgctgaagtctacaagactagtaatgtcgatcctttaacattgctggagaagatctcaaagattggtatctcacaagatgtttgtattaatgatttagaacctccagcatttgaagttctcccttctctcaaaagactgaagcagcgaattagtgcagctggtcgtggagaatatgatgctgtttttatgtcaggaaggaagatcccacgaatcatcttctatcgacatcgtctgcttactgttaccgtacgctcttcttacccaacccaaatcatctggtactttgtccgctctccctttcctggtgaaggagagagagttttacaggctgatgcagctaagaaagtcttgttgaaagcaggaacgaagactggtagggatttgaaaccggaggcctctcctcatctagttctttcgttacgccgagaagaagcagaaagaagcttggaagaaggatgtggaagcaccattgttggaattggttctcctgatcccccacaatttgtttatgatgatgatgaatacaaagatgtcttcttgtcagatgcctattttctcactcgagaggcaaatcagtggtaccaagaacctgcttcaagtccttctgcctctcctgttgtttcggagtctgtttaa

SEQ ID NO: 27006 - DNA, 2244 bp, Glycine max
  Peptide Sequence Number=SeqID_118691
atggaaggtcagtattgtacgccttttatggtggttggaaatcttttgattgggaaaggttctgttgggtatctgcaaacagttaaaagttatcaggtggcagagggtgtaggaaacttgattcattgcattttgtgctggaaaaatattggattggatgtgaaattcataaacctgatttatttctctcgctccttgctagaaatttctttcttttttaacaaagaatttattgagatagaggagaaagttacaaatgcaattgcaagagggggcatatttgctactgaagagatgtctcctgcttccaaatctaagtccaaagacaaaaaggccgtcaaggaagctcaaaagtcttctgccaagtcttcaggatctggtaatgctgtggctggtgtaccagctagtgcatacaaccctttattgggaacatttcatactttggagacgtcaccaacatctacttctcaagtaaattctaatggtcgttttcggaacatagatgagacagatgaacatcctgcaggctcagtggtagctggtgtggagtatgattctgtttctaacaatggtagttggtctggtgagtcagaggaccataaagacaaagctgcttctaatcctcctgctcgactggaagcagtaccaggagctgataatgataaacgtgagaaaatccgccagaagaatgaaaagaagcaccaacgacagaaggaaaggcgggcacaagagttgcatgatcgttgcactggatatattatgtcaaggaaacttgaggcacttgctcaacagcttgtggcaatggggttttctcatgagcgtgcaacagtagcattgatactgaatgaaggaagggtggaggaatcagtagcatggctgtttgaaggtggtgaagaagcagataatcataaagaaacaaatataggtgggggtaatttgaaaatcgatatatcagaagaacttgctcgaattgcagacctagaaatcaggtacaattgctcaaaacaggaggttgaaagagcagttgttgcttgtgagggtgatcttgataaggctgcagagtctttgagagagttgaagctggatcgaccatctggtccaccaaagccagaggaaattggtgatcttccttccctcaccaataagcagtcagaagctgtgaatcagaatgctaggacacagacaaaacccatactttctccaaatcaacccaaaaaagatgaaaaggattttaactatgcaaagcaagcagttatgctaggaggatctacagaatccagcaacagacttgtgcagcctctcaagagaatcttacccaagtctgaatgggcaaagccccaacaagctgctgtaccagctgacaagaggtggccaggtgcaggatctaatccttcagtttctttttcattggcttcaccgttgcaagtgtcatccacacctgctaaaacagaagcttcttatatggctgtgggaggtgattacaagaaccttcaacctggagcaactagggagccagtaattgtgatgcagcgacctcaaactgtaaatgcaaagcagattccagctgccagcatgagttcatctcctcccggagtagctgccagttggtatccaactaatagtgttgaagtcatgaggtccaatggctttatgtctcatcctcctagcactagaagcctcagttcaaactatttcagttctaatcaactgtaccaccaacttcaatgtcaacctcctcagcagtttgtggctggcaacagcagttcagtagatctccaagcaaccaatcaagggaataacttatggaatagaacatctgcatctccaacgcttgccgctgcttcttctcttggactcttttccgggctaggatcagcagctacatcaggggcaacttctccggtagactggagcactggtggaacaatgcaatttgattataccaacatagactggtccttggatagaggtttatctccacccaggtctaatgcattattgtttgggctttctccttttacaaagagtagtagtactctatatggctcaaatgcttctggcacggttgctcagcaagcaattagatcattaccctctaatggtagcatggttcccttgcctggattgcaagaaggtggagtatcttctgctgaaccatcaggatctcgggattggagttctccatttgaaggaaaagacctttttagtttaccaagacagtttgtttcttctccttctctgtag

SEQ ID NO: 27007 - DNA, 351 bp, Glycine max
  Peptide Sequence Number=SeqID_118692
atgataacaaaaaatgatgacaaaggtgatgacaaaaagctcaaaggtcaatcaaagaatgagttcaagatattcaacatagaatcaagaacacttcaagattcaagagggaagttgatttcaagaatcaagaatcaagattcaagagatcaagatttcaagaatcaagattcaagagatcaagattcaagactcaagattcaagaatcaagagaaggcttaatcaagataagtatgaaaaggttttctcaaaaattgagtagcacatggatttttctcaaaacatgtttaccaaagagtttttactctctggtaatcgattaccagattgttgtaatcaattaccagtag

SEQ ID NO: 27008 - DNA, 303 bp, Glycine max
  Peptide Sequence Number=SeqID_118693
atgaatgctaaccaaaatagaaattctatcaggggtgtattcattgatggttcatggactgacgacccacacaaggtgaaggaagaggtgaaatcctttttctttcataggttccaagaaccaattgaaaaggctggcttgggcatcaaggatattgaaacattcaacctcgcactacttggaaaatggaagtggcaattaatgcaagaaaatggtgagctgtggaccagagttctgaaatcgaaatatggtggatggaggaaccttgaagaaacaggaaactcagcaaagcaatctgtttag

SEQ ID NO: 27009 - DNA, 1227 bp, Glycine max
  Peptide Sequence Number=SeqID_118694
atggctagtgaggtccctactgagttgcatgcactgctcgggtttgggtccgagctgcaacttgatgagctcttcaatatgctttggggctctgtcaagagtgttatcacatggatctatatcgaattcatcgtccaggcttgcatggtagacaatcaagacttggactggagacccttagtccatgctcatgacttaagtggtaccatcctctgtggggtaaggcttggcaggctccctgtcttgacagtcacgatctctcccatcaaggtggggaacttcctcattagaagtggtgtaaagacgatggctccgagctcgttgagcattttcctaccaatcaaagtcgacatagcctttggtctatactctttctcctacgaagccagggaatggaccggtgtgaggctgaatggtgaccttggacaccatcaagttggcaattatgatggagacaaccaaggggtcgtcatggtttatggggttgatacccttgaagtctctatcaatgaaattgatgtcgatgtcccggatggcgtgaaggtgacacttgcgagactgactggactgccttccgctcatgttcttatggaggttgtcgatcgcgtctttgttggtggtgtctttatcttcctcgatttctgctctatttcttcttctgtctgtgttgtgattcctatgttgatcctcttggtgtcctccgggtcttgcttctacttggtggttaagggtgtcaaacaggaccctcacccttctattttgatttcgaaccccatcaacctcacgtctttgattggacttcgagagcctcaccctcagtccctcacaacctccctccatgacggcagctccgtgtcagcctcactctcacagcctccctctctctcaagacccttaccctcgacctcgagccctcacccttctctttcgatttcgaaccccaacattagcctcacatcttcgattggacttcgagcctcaccatcagtccctcagagcctccctccgtggcggcggctccgcgtcagcctcaccctcacggcctccctctgtggctctgtgtcatcctcatcctccccttcatgccaaacacttatctttgtggctgtgcatctctgtgccaccacttatctttttttccacactgtaagtcctacttctttctcttttcctatttgttgtttgaaactgttcttctctgaccttacaatgtggaatgctgcttaa

SEQ ID NO: 27010 - DNA, 216 bp, Glycine max
  Peptide Sequence Number=SeqID_118695
atggagcatccggttccaagtgcaaccagcccatctaatgatcctttacatgggactggaggtcctatgacaaggtccaagactaagaggataaaacaagctttgcaaggctttattataaagatcaaagagaaagaagaccaatgtgaattaagggttgtacctaactgggtcgctctcctacaaattgatgaagatgctttgggactaacttga

SEQ ID NO: 27011 - DNA, 414 bp, Glycine max
  Peptide Sequence Number=SeqID_118696
atggagttgattgaaaatatggtagcaatgaccatgccatcccttgtgatcgagcctacacacctacaaaagaagagtcttctcaagttcacatcacaagacgcaccactagccgagaacaagctcctagccaagaaactagagatcctcacaaagacattgagcaagcttcctcaacatttgcaggcagtgcaacctgcccattcttcagtcatgcacattgggggatgcaacatttgtggtgggggctatgagtcaggcatgtgcatggtttctctatcaaatcccaagagcactgagtctgccatcaggaatctagaggtacaagtgggccaattagctaaacagttggctatagcgtccacgaacagttttgaggccaacacggagaagaatcccaaggtggagtgcaag

SEQ ID NO: 27012 - DNA, 882 bp, Glycine max
  Peptide Sequence Number=SeqID_118697
atgtctctggtgaggaagagtctgacttcaagagtggagaatgttgaggaaagccttgacatgtcagtgttggacttgcctgagttggccttggattgcattcttgagaggcttcccccctcttcgctgtgtcgaatcgccgccgtgtgccgcaccttgagggagaggtgtgtgagtgatcacctttgggagaagcacatgaggaagaagtggggtagagttattggccctgctgcttatagggagtggaaatggcatgttgcttccaaaaggaatgttgggggtcttaaacatggcaggcaaaagggtttgatgagatttatgtctcttcattggcctttccaatggattagaccaaaggttgatgcaaattataataacccaaagctgaggagctctctgcctgttgactcagtcatgaactggtatcttgctcttgagtctggcaatttttggttccctgctcaagtctataaccgtgagaatggtcatgttggattcatgctatcttgctatgatgctgaacttagctatgatccgcgaactgatacctttcaagccagatatcctccacatggaagaagggcagatgctagagagtgtggcatcccatgggaaaggctaagagcacctcctattgatacttctccgcatgatcttcatgtctccgactgtttaaatgatttgtatccggacactgtggtgctagagttcaatcattacactcctggctcacgatggaggctgaccactgtcagtaggaaagatcatagggaggaggggaacgaggctgatggattttatggcggaataagaaagattaccagcgaggctgagattgccacttggaaatgcctttggccatctgaagtcttggattag

SEQ ID NO: 27013 - DNA, 417 bp, Glycine max
  Peptide Sequence Number=SeqID_118698
atgtgggcttttcatacaggccaacaaattgattgggcacacttagtccgatatcgcatgcataaggcattgcgattaaatgctcaatttccatatccacacctagtcactctcttccttcaacactttaacatccctcttgattctaaaccctatgttccaatcaagagatccttcttaatcggtgccgctgtgattgcttcttttggttaccgtaaagagcatgatggctcttggattttggacaggttcgatggttttcaaacctttgttggtgaaaggtttgatgctttggagttacaagtggacatgcgattcgatgagatggattcaaggatcaccaaggttgaaggagatgtctattacatccgcacatgctttgatctaccaccaccaccaccaccaccatcatcttag

SEQ ID NO: 27014 - DNA, 417 bp, Glycine max
  Peptide Sequence Number=SeqID_118699
gatttgcctcttgaggtaattctgcctcacagcaacaattcgaatataaagaagaaaagcagggtcaatgttccctttggtcaatatgacttaaaggtagcaagtgaggaagtgggtcagcggataagtggcccaactcattctgccacaaaggtttatgtgagaagaaaggaggtgttgagaagtaatggaaaggcccaacagtttaaggaaccagctgtggactcaaactcagtttctaaaactgattccatgccttcaatacaacaggacccaatagagctacaatgtgctcttttaaacgaaatgggcttgacttatggggaagatgccaataaggttaaggggcttatattggatatggaaaatagagatgatatgatggcagctgagaggggaattaaaaaacatcaatag

SEQ ID NO: 27015 - DNA, 129 bp, Glycine max
  Peptide Sequence Number=SeqID_118700
atgtgggatcggcacagacttaaaggaacactcaaaccaggtgtatttaaccccaaggcctacactccgaagagtctgtcagggcctctccctcctgattcagttttatctcgtcgtgcttgtgattaa

SEQ ID NO: 27016 - DNA, 174 bp, Glycine max
  Peptide Sequence Number=SeqID_118701
gcatggcaacgagttgaaacggggacgagtattgcatttcccacccccgcccccgactttttgactaatccccgaccccgcccccgacccccgccagggttaaaaaatccatacccacccccgtccccgttggaggtcgggtttcctcgccccgcccccgctagaattgattaa

SEQ ID NO: 27017 - DNA, 57 bp, Glycine max
  Peptide Sequence Number=SeqID_118702
atggggaaagggagcttacgacggcggcttccggaagatccattaaggattttataa

SEQ ID NO: 27018 - DNA, 207 bp, Glycine max
  Peptide Sequence Number=SeqID_118703
atgacaggagctggtgacggtggtggtgaatatcatcaactggatggatctcaacacttattactggacgtgatgactacacaaatgccatgtttgttgaaccgtaacaatgaagaactctacagacaaatagaaggactggagcaccaaatgctgggagaccttatggtggcaacagaagggtcaatgatggaccgaaccgaatag

SEQ ID NO: 27019 - DNA, 210 bp, Glycine max
  Peptide Sequence Number=SeqID_118704
atgcaggagatgacaagaatgaaaagaacaccattgtcttcaagctacatgttcattgtcaagtgggtcaacctcgtattactggttattcaacattgtattttctacatcgttggattgaggaccgatgtcaaaacgtttaactatcaacgacgtcgtattctacatctgttgaccaccgatttagaatggcgttttccaccgatgtaa

SEQ ID NO: 27020 - DNA, 723 bp, Glycine max
  Peptide Sequence Number=SeqID_118705
atggctgttgtgccagcagagaagcttgctgtccacttccatgacacttatgggcaatcccttccaaatattcttgtgtcccttcaaatggggatcagtgcagttgattcttcagttgctggtctaggtggctgtccttatgccaagggagcttcaggaaatgtagctaccgaagatgttgtgtacatgctgaatggacttggggtgaaaaccaacgttgatctcggaaagctcatgttagccggtgagttcatcggcaagcatttggggcgcccatctggctcaaagaccgcggtgaaagtgatatcggtcggtggtgattgttgcagtggtaggttcgatagtgacgtcgtcggagtgttgtatgtttgtgatgtggaaaattttgaatctattgttaagatggatgaagatcaatggatgtatgacaatataatgtctgaagaagttgatacaaatgatgaaaatgaacacgacgttggtgtgaatgaagaaccacattgggctcgatcagttgctcatgaaatcggatttgtggcggtgattatgaggtcagacacaaacattggtatgagaggaaggacttcatttgtgttaattggttatgagatgagtggtcagtataggtctaggaagaaagattttgttagaagagatactgggagtaggaaatgtgggtgtccctttcaagtttcatgggaaacccagtggttggagggcaag

SEQ ID NO: 27021 - DNA, 702 bp, Glycine max
  Peptide Sequence Number=SeqID_118706
atgcaatcacagggacttgaattgcctcctgaggctgaggttggtccttctgtttctcgtgttagcacaaaggaaatgttccccgactggttgcccttggaagagtttatgagggatcgacgaccgaccgtccacaacattcctttggacaatgatctagtgaaggtcggtgttgaggaagtccaagatgtcgatgctcacattcctgtacccactcaaaaggttcagttagtggggcaggcacttaacatcttccttgcttggccgacacatcttgataaacagggagttgagggatcggcaaaacctgtagatatgttggatcttgatgtcaatcccctgtacctgatgacattgtccatcccacagcttttccttaagtttgttggattcaacaacaatcaaggaagtaagtctaaggctgctgctagatggattataattaaatgtaataaggataaaggaagtactgaatgtagactcggcaagtcttcgtactcggtggccaaccgagtagcttactgggaatctagagaatctgatatctataattatgtagctaatctaggtcttgggcgttttggccaaccctatcagcaaaaaagagagagtgaacttcagccgatagctatcaagaaagcggcactactggggaatggagggattatgccaaacggacttgactttcaattaagcggataa

SEQ ID NO: 27022 - DNA, 273 bp, Glycine max
  Peptide Sequence Number=SeqID_118707
atggttgttggtgtatctggtggtgcaatgattggtgcggatgatgctggatttgtggggaaaactatgtttgttgggaaggataactgtgctttttattgtcagaacaataggaacatccttgcaaggaagaatggaagcagcaagagtggctcgtttgatgatagcatgaacaaatgtcaactactactcaacagaataggaggtaatgagaaaggagaagagaaacaagaggcacagataagcttccttagccattatccaaaagtgtaa

SEQ ID NO: 27023 - DNA, 720 bp, Glycine max
  Peptide Sequence Number=SeqID_118708
atggaagacgcacccgtgagccctcgcgtcgccctcccgtcgaaggcattcgatttaaggatgaagaagaaaatacttcagactgtaggtgagcggtgtaaacagtttaagttagatttgacgctgaaatgggcacttatagacgacaaagagggcgatgatgatacagtatgtgaaaagtacgacattaggaatgagaagtggaaccagttttgtcagagccgtaaagacccttcgtgggaggcctcacagggaagctttgtcgctcatggttgccaggatgtactgacttctaccattgggcgaccagaacaccttggttgtattcgtgctgctggagtcggtatcatgatcaaacaatactttgaaccagttccaaggacctcctgcacgtcttcatccatgactcccgaagacctggagcaactgacacaagaaatcagggaccagttggaggagtcgatcatagaaaaaggactcgcactgcctcttgagcccgaggacccagacatgggtgagtcagagaaatgtggattgtacgtcgatgaaaatccttcctacctggttgcccttggaagactttatgaagggtcgaacatcattcaaaacatccctttgggcaatgatcaagttaaggtcggtattgaggaagttcaagatgctgatgctcgcaatcttgtacccactgaagaggataaacagagagctgaggaatcataa

SEQ ID NO: 27024 - DNA, 222 bp, Glycine max
  Peptide Sequence Number=SeqID_118709
atggctctggcgactagtcccttcctagggaggattacatcatgggctcagaaatctaccctgagggaggattgcatcatgggctcagaaatctaccttgaggttcatgagaaccctagagccttcttcagcaactctagcttaatcctcttggagcctcttgcatatggctctggtgactggtcccttcctagggaggattacatcactctttctctttaa

SEQ ID NO: 27025 - DNA, 282 bp, Glycine max
  Peptide Sequence Number=SeqID_118710
atggcctatctacattataaatggatacaaatttcaaacataagtaaaattgagcaagaggctccataccaagatgatgagcttgtagggcttcaagaagtattggaacttgaccctgatgtcattaatgaatctcttgcggatgttgatggaggtggagaagagatagatgcagatttactcaaacaactagacttggttgaactagacgaggatgaatgcatgttaagtgagaatgatcatgacattgagagtgattttgatgatacagatacttcttag

SEQ ID NO: 27026 - DNA, 783 bp, Glycine max
  Peptide Sequence Number=SeqID_118711
atgttgcacgtacaccggtgcacttgcccaagaactgctgacaagacaaaaaacttagacatccatggccttgtgcttgcaagtccaagacttgactctttcatggacaataacacaaaagttgaattcgctcaccaacgaacacttatatcaaatgaactatacgagtcaattaaatctaattgcaatggtgattatgttaatcttgatcctaacaacacaaaatgtatgtcagattatgaagcctacactgagttagttcgttacataaatgaatatcaaattttggaaccaagttgtgtgattgcacctaaggagaatcaaagaattctttctcaagaattaaattatatccaccaaactaaatttaggtgtcgggatgacttatatgcaattggagaattatgggcaaatgatccacatgttcagaaggctcttcaagttagagagggaacaaaagatcacttccaacgatgcaatcgcagcgctgcatatacatggaacgttcctagtgtggttcaataccttcataatcttacaaacacaaacatgcgatctctaatttattgcacggatcttgacatgtcgataccgtatcttagttcactttctattgtcaagtcacttaatttgaaatttgatatgacttggcatccatggttcgttgatggtcaagtggcaggatatgccgaggaatacaaaaaaagtgagtatcacctaacttacgccattgtgaaggaaaaaggagtgagggtcagtctcgaccctagcccaccaccatga

SEQ ID NO: 27027 - DNA, 324 bp, Glycine max
  Peptide Sequence Number=SeqID_118712
atgcctctctacatgtggccaaatcaggaaaacagcacactactccaatatgatgctttgtatgatccaaggatgctctccagtaaacccacagtagctggggagatccaaattttttactgtaagaattgtgaatataatcaacatgagtgctttgcatgtggcacactaggttgttctgataaattttctggtgctaaggtcttcaaatgcgcttccgcaacctgtggtttcttttatcatccacattgtgttgcaaagttacttcatgggatagttgaggatgctccaaaggaacatgagaaaaaaattgctaaggggtga

SEQ ID NO: 27028 - DNA, 354 bp, Glycine max
  Peptide Sequence Number=SeqID_118713
atggtgttgaatatcagtgcatctcatatatgtactactcgacaagggaacgagttgaatgcgaagcagattaaggaatataggcagaaggttgaattggagctatcgaacatctgtaatgatgttatgagagtgattgatgagcaccttatccctttggctgcagctgggatgttgaaatgttctgcttgcaagaaaggagattattattgttatcttgccgaatttaagtcaggcaatgagaaaaaggaagctgttgatcagtctatgaaagcatatgagttgaacaaggctgttagtggaccaagaagcccaggagttattggtgaacggggatcaagagaaagtgagtaa

SEQ ID NO: 27029 - DNA, 933 bp, Glycine max
  Peptide Sequence Number=SeqID_118714
atgcatggagttaaggaccagaggataaggtcgtgccttaggtcaggtcactggcaaaggtgtgggcagaggagtcctactgcatccgcacggaggcagcgagtcactgtgactgcggatcacgtcgatgagccagtcatccctgacccagatgttcaggatgactcgatggaggcaccagctgttgtggaggacattcctacggacatttctgcgaacacaggcgcagaggcggctgaggatcagcctcaaggatttccgggtggtcagagcgacccatctgtgttgacagcgtatgcggatcacattgcttgcagcgtatggacgggagaggagtgtcctgaattgaagctatcctctcatgggaggaaggtccacagtttaggcaggtctgtccctgccattgagggacttattgctggtacaggactaagtcctctgatcgcgtgttcggtagacaccggcgatcggggacttttgtctgcgtttgtggagcggtggcaccgggagacgtctagtttccatctcccggtgggagagctcaccatcacattggacgacgtctcctctcttatccatcttcccgttattggcgacttacacgcatttcagtccttgcatgtggacgatgcggttcagatgctggtggacttgttgatggtcattggacagctgcggctcacgcatatcttcttcacttactgggttgctaacaagagtgcaaccaatgtccatgttgtctacttggaggcccttcgtgacctcagtatgacaaagaggtacgcctggggagtggctgctttggttcatatgtatgaccagctgaacgatgcatctatgagccacagtcgacaacttggcggttacatcacactgctgcagtgctggatttacgagcactttccctcggttgcggagtccaccgctgattag

SEQ ID NO: 27030 - DNA, 216 bp, Glycine max
  Peptide Sequence Number=SeqID_118715
atggctgatactactggaaggattcctcctcaacttttgactattgtttcttgtgatactctccttcaggaacttgcagttcctcatgctacacctcttgtgctctgtgacaatttaagtgttgttcaattagcacacaatccagttctgcatgctagaaccaaacacatggagttggatgtgttctttgttagggaaaaagttctaactaagtag

SEQ ID NO: 27031 - DNA, 585 bp, Glycine max
  Peptide Sequence Number=SeqID_118716
atgggaagcaggaatggttcaggttatgaagctgaaatggtatccatattctctcaaattgagtcccctgacagatcacttcatgaccatataattgaagctcttggaaagctcactgttgaacaaagaattccttatgtattgagcaacattgtggaaccggcattgctatctcaagatggctctgatttggataagcctgtttctcaagagacatttttggaggaatttaagatagtcacaatgagtgtggctaatcgaaggttccctgttaacacccatagcggagacgaagacgaagaggaacttacctcgacaatgccgatgcgaggacgcagcaacaccaccgtcaacacccacacaagacgaacgaagcacacgattggaaggtcacgaagaagaccaacgaatgtcacgaagaagacgcacaagaagacgcagccaagctttttcgagaggaagaagaaggatgcgaaggtcaccaatgaaggtcacgaagaagcaacaatggcgaggaagaagaggaatggcgaggaagaggaagaagcaacagaaatcgcgaagaagaagaaatggcggaaatga

SEQ ID NO: 27032 - DNA, 260 bp, Glycine max
  Peptide Sequence Number=SeqID_118717
ttggtgttgatgtcacaatccagcaatgcaccgagctagttccacagggaaagagcaaatgggcagtgaagaataagatgtgccctattgttgtttgtgaggaagaaattaaagatgatgtagatggatgtgagttccctaatcttgattgtggagtcgtggtggagggtgaaagagatgtgtggggagggatttatgagctatccaaaacggtgtcatttggaggcgtgaaagtggtgcacattggcaaggagttgtga

SEQ ID NO: 27033 - DNA, 609 bp, Glycine max
  Peptide Sequence Number=SeqID_118718
atggacgatgaggttcaacataaagatattaaagcacctctatctcatatctaccttgatagatttcaacatcaaggacctcctactagagaccccaatctttctaatgacaccattgcaaggcttctaagaaggattcaccaacaaggatcaaagttcttcctcttccaaagtggaagtgacttcaccccaagggagaacaagaggagacaaccatggaagcaagggcttgtggaaagagcttgcgacaaatatgtctctatgttggcaataagagatggtcactttattcaagagtatacaaacaagatagatgtgcttttcaaggacaaaagtgaagcacaaaatgaggagaaagctaaggaaaaggaggataaggaattgctaccgcttgctttgccgacacctcttatgcaaggaatggggggaggttatgccccttccccaccaccacctatgggtggaatagggatgctgatgcaagctccattggagcttgtaggcctaggatcttcttcatcaatggattcctttgcttcttggaagatgaatggcagcggaatggagaaagggagagagagaggagacgccacttcaaggagaagatga

SEQ ID NO: 27034 - DNA, 804 bp, Glycine max
  misc_feature (735)..(735): n is a, c, g, or t
  Peptide Sequence Number=SeqID_118719
atggcatctatgaagaggaaagcaccctctacacctacccaagccaaatttgatagatctaggttcacatcccaagaggcttgggagaggtataccgacattgtggtacttaggaagatttttcctaaaaggaatgccattcttcatcacactgagttcgatgaatttactgaagaactcgagcgtagaaactggaacaaggagttgacaaactttgtggatggtagtattgatctggccatcgtaaaagagttttatgcgaacctctatgaccctgaggataaaccacctaaactggtgaaggtgagaggttgtttggtgaaattcgatgtagacaccttgaactcattcttgaagaccccagtgatacttgaggagggggagaactttctagtatactctaggttttgtcgttcgaagctagaaccacaggaattggcagctcgattatgcatccctggaaggggattcgagttaaacgctgatggattgccattaaagatcttacggaagaatttgactacgctcgctcagacatggagcattctttctttctctaacctggtccctacctctcacacctctgacatcacattagacacgaccaagttgatttatggaatcattcagaagatggatatgaacctgggctatattatttcagctcaaatttctatgattgcccagcatgactcttctaggcttgggtttccagccttaatcactgctctgtgncaagccaggggagtcatttctgattctttgacattagagagcctcggtccagctattaatgtggcttat

SEQ ID NO: 27035 - DNA, 312 bp, Glycine max
  Peptide Sequence Number=SeqID_118720
atgccctctattggtggacttcccttgttagggaaagaaggattcatgggaatcctccagctccaagaagattgggccagagttgcaggagaaggccctagtgttctcatgagccttaggggctctatagtcttgggagggtacccgagtaattggcgtctccaatcacctttcctccttctctattctgctgccattgatcttcaaaatgcaaaggactctattgatgaagaagatccaaggcctagaagctccacatggagccacatcaataatcttgccaaagatcttgcattcaacatcatgagatga

SEQ ID NO: 27036 - DNA, 2109 bp, Glycine max
  Peptide Sequence Number=SeqID_118721
atggttcgtgctggtgttaagcctgatgagtgcacctacacttttgtcccgaaggttcgcaagggtagggaggttcatggggttgcgtttaagcttggctttgatggggatgtctttgttgggaatacccttttgtccatttatgggaattgtgggctttttggtgatgcgatgaaggtgtttgatgaaattcctgagggggataaggtgtcgtggaatactgttattgggctgtgttctcttcatgggttttacgaggaggcacttgggtttttaagaaaaatggttgcggtcaaaccggggattcaaccagacttggttactgttgctagtgtgttgccggtgtgtgcagagactgaggacgaggtgatggtgaggatcgtgcactgttatgctatgaaggttggcttgttgggccatgtaaaggttggaaatgcgttggttgatgtttatgggaaatgtgggagtgagaaggcttccaagaaagtttttgatgatattgatgagaggaatgtggtttcctggaatcctattattactagtttttcttttagagggaagtatatggatgctttggatgtatttaggttgatgattgatgtgggaatgggaccaaactttgtcaccatttctagtatgctacatgtgttaggagaattaggacttttcaagttgggagcggaagtccatgggtcacgatgttttgcgagaatgctccaaccatatgagatcagcataggcttaaaggagcactcaaacccggtgacccccaaggcctacactccgaagagtccgtcagggcctctccctcctgattcagacagctctgggtttctgcgggaaagaaaaaggctacaatgcgaagggtgtttctctcagttcagacatgatatcgaaattcccaacggtgagaatgctcggaattccgttgcaaacatgatactcaaatttcacgacgatccaacggtgaacgggttcaagatcgtcgtttttctgagactgaacaggcttgagtatgaagctgtagaattagtgaggcaaatgcaagccaagggagaaacccccaacaatgtaaccttcacaaatgttcttccagtttgtgcaaggtcaggtttcctgaatgttggaaaagaaattcatgcccagattattcgggttggatcctccttggatttgtttgtctctaatgctctgacaaaatgtggatgcataaaccttgctcagaatgttttgaatatttctgtcagggaagaagtttcctacaatatactaattataggctattctcgaacaaatgacagctcagagtctctaagtttgttttcagaaatgagactcttgggcatgaggcctgatattgtttcattcatgggtgttatatcagcttgtgcaaatctagcttccataaaacaaggcaaagaggtccatggtctgctggtgagaaagctttttcacattcatctttttgcagtgaactcactctttgatttgtataccaggtgtggacgaatagatctcgctactaaggtctttgatcatattcaaaacaaggatgcggcctcttggaacactatgattttgggctatggtatgcaaggtgagttgaacactgcaatcaacctttttgaagcaatgaaggaagacagtgtggaatataattcagtttcatttattgcggttttgtctgcgtgtagccatggagggctaattgggaagggaagaaaatactttaagatgatgcgcgatctaaatattgaaccaacacatacacactatgcttgtatggttgatctccttggaagggccgatctaatggaagaagctgcagaccttattagaggcctctctattgtactggatactaatatatggggtgcattgcttggagcatgccgaatacatgggaacatagaattggggatgtgggcagccgaacatttgtttgaattaaagcctcagcactgtggatactatatactcctttcaaatatgtatgcagaagctgtaagatgggatgaggcaaacaaggttaggaaattgatgaagtcaaggggagctaagaaaaatccaggttgcagttgggttcaaattggagatcagaagccttga

SEQ ID NO: 27037 - DNA, 516 bp, Glycine max
  Peptide Sequence Number=SeqID_118722
atgggctcaaaaatctaccctaaggttcatgagagccctagggccttctttagtagctctagcccaatcctcttggagcctcttgctcatggctctggatatgaaccagcagaagactggaatgtgatcttctatgaggattgtttttcattcattggccaaaacaaacctgatcctgtcactatccttcctattcctcataattccattgatcaatctaacggtgtctcatcagaatcaccagttgatcatatcatgcatgtgccaaataatactaattctgatcccttgactttagagcagtcctctaatagaaccagaagatctctaagacaggcacatagaccgcaactatatggactgaaacaagccagcaggcagtggtatgccaggctgtctttctttctaatctcacatgggtacaagcaatgtgcttcatatcattctttgtttctcaagcatggattcaacactatcattgctctgttagtttatgtggatgatattgctttgtaa

SEQ ID NO: 27038 - DNA, 360 bp, Glycine max
  Peptide Sequence Number=SeqID_118723
atgaaggatggagatgtaattgatggattgaggaatatgtcagaaaatctatctatctgcagtagttgtgaatggacaagtttaaagaagcaagtccaggcactgactctcaaaaattcaacacttgaagatagagtcacccatctagatagtgcacttaaggagtgtgttaggcagctaagacaaacaagaacaacattgctggtcacttcaatcttgaagagtgcaattgatgaatggatagcccagaagaaagcaaaccaccaaggtagaggtagaggtagaggtagaggtattccctacgccttgcaactaaatctgccacagagaagcaaccaaaagccaaagaagagaaaataa

SEQ ID NO: 27039 - DNA, 315 bp, Glycine max
  Peptide Sequence Number=SeqID_118724
atggtggcggggcacactactgcgactgaggcgttgattagtgaagcgcccgagttgagatgctggaaagttacaacaatgctggattccgtgattgaggttggtgcgacaagggtgatggtgaagtgcggcgagagtgacaacggagaaacgcgaggaactggaaccagagaaatggcacgcaaaccgaggcaggattttagcgtttcaaaggtcagatttttctcactgtttgtggctgagtatgagtcacaatcaaaagggaaagtgagcccttcttgctccactcaaatggagacatgtggcatagcttaa

SEQ ID NO: 27040 - DNA, 249 bp, Glycine max
  Peptide Sequence Number=SeqID_118725
atggtgttttttccaagactttacaccaaactacctcgtcgatctgaagctttccagtcttgcacgatggctttaactcaacacctccaaggctttttggggattatcaaattgaaagccaatctaagaaaagttgagagcttcctcaacttcaccttaaacgctaacatcactctagctagcgcaaatgcatatttgaagggacgtgtttccaattttgaaggagagatgaaaggtttggagacatga

SEQ ID NO: 27041 - DNA, 195 bp, Glycine max
  Peptide Sequence Number=SeqID_118726
atgggcaaggaagagaaaaaaccagaggaaaataaagtggaggagaaaaaagcagaggaagaagaaaagaaagaagaagagaaaaaaccagaggaatcaaaagatgacaaggaattcaaggaggaatctgcgccaccagaaatcgtgcaaggcacagcctttgcaatgcatggacactttaagcacgatttctga

SEQ ID NO: 27042 - DNA, 297 bp, Glycine max
  Peptide Sequence Number=SeqID_118727
atgcacggcggaaaggaaagggaagaatcaaaagaattctcaaactgtgtcgttttgaattctttgacaagggagaagggagacacaaaagaatttaggcggttagtcctttgttcttttggaaaagggagaagagacacacaaaaagaattcaggcggttagtccttggcgaattctttttggcaaagggagaagagaatgaaaagatgaatagcacaagttttcaaggtttggaaaaccagaaagcttttggtacaaaaaagaagaagaagttcaaagagactcaaggcttgtaa

SEQ ID NO: 27043 - DNA, 168 bp, Glycine max
  Peptide Sequence Number=SeqID_118728
atgagtgagagaattgggccttgctgttgggacttgttgcaccagcgatctacatgtcctgaatggtgcattctctgggatcagtgggaggctctagcgtgtggatggaggagagggatttggtggagaaggcaacgtggtggcgatgcagaggtggcagtgcaatga

SEQ ID NO: 27044 - DNA, 336 bp, Glycine max
  Peptide Sequence Number=SeqID_118729
atggaaaaagctaaaatcatcaaaacaagcctaaggcttaatacaataagccaaaatcttcataagcatgacgtggccacccaacaatcccttggttacagctacgtcaatttcagcaactctcatgatgccgcaaaagcaattgatgtgctgaatttcactccgttgaatggcaaaatcattaggataatgtactctattcgggaccctagtgctcaaaagagtggtgcaactaatgttttcataaaagaatttggacaagatgcttctggccagtctaaaggccatggttttgtgaagtttaagagtgaagaatttgtaggattcaatgactga

SEQ ID NO: 27045 - DNA, 240 bp, Glycine max
  Peptide Sequence Number=SeqID_118730
atggaacttattgagaatatgactgctagtgatcatgctattttgcgtgatagaactcataacatgctattagctaagcagcttgaatcactccccgagacacttagcaagttgccaacacagttacaagcggctcaatcctctcattcagttattatacaagttggagttgtagtatttatggaggagctcatgaatctgactgttgtataccccaagatgatgctgctaaagaagtaa

SEQ ID NO: 27046 - DNA, 213 bp, Glycine max
  Peptide Sequence Number=SeqID_118731
atggcgtctcctctttctcttccttatccattctacttccattcatcttccaagaagcaaagaaatccattgatgaagaagatcctaggcctacaagctccaatggagcttacatcagaggtactaagcctattctcgcttctgcagcacatacctggactctcaggagctggtagcaaaattatgtattccaaggcggggtttcgtacttaa

SEQ ID NO: 27047 - DNA, 567 bp, Glycine max
  Peptide Sequence Number=SeqID_118732
atggcgaatgaacaccagcagagagttacccttgaggactattcaagcagttcagtgctgcaattctttacctgcattgcacatcctgaagggaacttattccaaggattaccaaatgaggacccctatgcacatttggcaacattcattgaaatttgtaacactataaaaattacagggggaaaaataaagttgaagacccctgaagaggcaactgagctaattgagaatatgtcagccagcgatcatgccattatgcgcaacagagttcatcaacccacaaagaaaagcttgttacaagttgtgccatctatggtgaggctcatgaaacaggccagtgcattcccattgaagaaaacactcaagaagtttactatatgggaaatcaatagagacaaggatatactcaaggaggattttcgggcttccagcagggtccttataatcaacaaggacagtggagaaaagaatcccaaggaggaatgcaaagctgtgatgacaaagagtaagaggtttatggaggcggaggatgaggatagtgtagtgtccaagaagaaagctgtttaa

SEQ ID NO: 27048 - DNA, 234 bp, Glycine max
  Peptide Sequence Number=SeqID_118733
atggtggctgatgtggaggtggcagttgtgcatctgcggtcggctgctgctgctagtcatgccccggttgttgtgcctgccttggcatgtaaactggcagagacctatgatcaatgctgggaatctcagtgccatgttggacttttctgggtccactgggtgtcgcgaaggtgtgatacctacaaactggtagatggcattcgagataagctgtgctacatgaaacgacgctga

SEQ ID NO: 27049 - DNA, 942 bp, Glycine max
  Peptide Sequence Number=SeqID_118734
atgtctacatctgataagtcagaagtggtggaaaggggtgctaaggatgatgaaaagccaaaggaagaacatgagaagggtggatttcttgatacagtgaaggatttcattcaagacattggtgagaagattgagggagcagttgggtttgggaagccaactgcagatgtcactgggatacacattccatcaattaatcttgagaaggcagagctagttgttgatgttcttataaagaacccgaatccggtgccaattcccctaattgacataaactacttggtcgagagtgatgggaggaaactagtttcgggattgataccagattcgggcacaatccatgcacatggagaggagacagtcaagattcctcttactttgatttttgatgacataaggaatacctatgatgatattaaaccaggaagcatcattccttatagggtgaaggttgatctcattgtggatgttcctgtctttggaaggctcactctacctttggagaaaactggagaaatccccattccatacaagcctgatattgatctcgataaaattcagtttgagaggttttcttttgaagagacagttgctattcttcatttgaagttggacaacaagaatgactttgaccttggcctcaatgctcttgattatgaggtctggcttggtgatgttagcattggaggagcagaacttgccaaatctgcaaagctcgtgaaaagtgggattagtgacattgatgttccaattaccttcaggcctaaggattttggctctgctctttgggacatgattagaggaagggggacaggctacacttttaaaggacatattgatgttgacactccctttggagcaatgaaactgcccatcacgaaagaaggtggtactacccgtctcaagaagaatgaagacagtggagatgacgaggtatgttaa

SEQ ID NO: 27050 - DNA, 597 bp, Glycine max
  Peptide Sequence Number=SeqID_118735
atggcaaacaacatatgctcctttggccaattaagttctgccagctcagcactccttgtcgaattagttatagaaatccctcaaatgttgaggtttgatgattttccttatgacctctgcattattccattgctgagtccattgttgttgctttattcctttcataacattccctggctcatcacaaacaccttgtcctcaaggtgttgggacctcaaatccagacctcgaaacaacttgatggcacagttcaaaaacaaaatagctaaaacacgagccacgaagggaactcaccaaattgaagagatattgttgttgcatggtctaaagaagaagccacaagagggagcgagagttgtgaacagcagtttgcacggcgaagaccttgatggccaaacatcactacccatgaagtgcaaacccgcattgaccgtggtggtggtggaggcgatggcttcggtggtggtggtggaggtgacagcggccgatacggtggtcatgggagggatgcaggggaggagccaaggggcacaaggtggtgttgtgcgacaacatgcagaacattacgaaactcgggattcgttgtttggctcgtag

SEQ ID NO: 27051 - DNA, 177 bp, Glycine max
  Peptide Sequence Number=SeqID_118736
atgagtctagaagaagctcaccaccataggaggccatggataagagcttggaggaagaaggagatgaatgaagggagagggagagaagagcacgaaattttgtgctctaaaagagctctaaaatctgaacccactaatccaagatcaattccaagattctccactaagtgtgcttag

SEQ ID NO: 27052 - DNA, 1437 bp, Glycine max
  Peptide Sequence Number=SeqID_118737
atgcgtgcggacgcacagggtgctgatagtggtgaggggtcagatggtgatgatgctgtagagggattccctggtggtccacgtgacccgtcagtgctgacatcatttgccgagcatgttgcacatgctgtgtggagtggacatgtgacactgattgggaggccagtgcctgagattgaaggcatggtggctaccacaggattaagtccactgatagattgttcagttattactggcgatcctggacttatatccgcatttgtggagaggtggcacagtgagactagcaccttccaccttcctgtaggagagctgacgatcacattggatgatgtgtcgtccatcctacatttgcccatcactggcgccttgcacagtttccacgctctttctacggaggaggccagattcttgcttacggagttgctggaagtgtctgccgaggaggccagagccgagacagcactcacacgtggagcatatgtacgattaggatgggttcgtgacatttatgagaccagatgtcaggcccggcagtggattgtcgcagctcgcgcttatctgctgcaccttgtcggggttgcggcgctggttcatatgtatgaccagttagatgaggcttgtaggaccaccacccgacagcttgcggggtacttgacgctacttcagtgctggatctatgagcacttccctagtgtgcaccagtgcgtgactgacgatacataccaggagacgtccccatgtgcttcccggtggttgacgtcgaaggcgcacatgaagggcatcacaggagcaccctacagggcacgttgtgatggtttgaccgtcacagatgtgtcctggttgccgtacacggagcatcggggtgttagggcgtttcaggagatttcatcgttccagggtcagctcagatggggtcctatgatcgtcacagttcgaccggagagggtggtacgccagttcggttacatccagagcatccctccgccgcctgttagtgcacgattgtcacacgatcagatagatgacaagtggatggagtttgcggatcacttactacctgcgggtcagctttgtctagtgcctgggcaggtatctgcggattacattgagtggtttttccgcatatctcaccctttcatgacaccgacccaggcagctgaccagcagagggatgcaccagctgcagaccctgaggactacatacagctgcccagcccccaggttccagtggcatttgacccccctccacatgtggatgattacgagggatatggggcgattgcacagaggttggagtgtgtgctcaaccttaggatagtcactgcaggcacagagttatatgacattatgcaggactgcctgacgatcgcgagagggggatccagtgctgatgagacggtcagggctcgtcagagacgccgcacggaccattga

SEQ ID NO: 27053 - DNA, 150 bp, Glycine max
  Peptide Sequence Number=SeqID_118738
atggtgctctgcaaatcatatccctctgagtttgtgtcgtacttccactattgctcatcactgcaatttgaggacaagccattcattaacaggtttccatcaatgtgcagttgtcatttgttgatcaaaattcgcagggaaaaaaattga

SEQ ID NO: 27054 - DNA, 177 bp, Glycine max
  Peptide Sequence Number=SeqID_118739
atggagacaacaaaaaaagaaagaggagtagttgttgttaacggtgccttggtcgtcccattggggctcttaagcgagggttcacaagagcttgggtggaatggagaaagagggtttgaaaagcctagggttcttcttagggagtcccacacggagaaagagaaatataatatgtaa

SEQ ID NO: 27055 - DNA, 546 bp, Glycine max
  Peptide Sequence Number=SeqID_118740
atggaggttgattatgcaacacactatccttgggccaaggaggaggttatcaaagcgaggtcaatgtattatgattggccgtcactagagcgtgtaagggacgacttcgttttgaccattgacggttatgatgagaatgtgatcataaaaccatgcttggttagtgagctagcttacaccgacaccgacaccgacaccgacaaaggaatgagaataattttatgttatatttttgaaatagtgctttctaaattaggaattaggtttccattgaccgaatttgaaagtgggatgttactaatgctaaacgtggcctccactcaactacaccctaatagttgggcctttgtgaaggtctttctactgccgtgtaaaatcttcggccttacattgacgataacacctatgaagggggccttagctcataatgcagaggtactagataggtttcctaagtattggactagtaacccccaaaattatgggaatttagatttggaacgaatgttggatgctgagcaagctgggatcgaagatatcaaatag

SEQ ID NO: 27056 - DNA, 1272 bp, Glycine max
  Peptide Sequence Number=SeqID_118741
atgggttcggatagagagagagaaagctgcaactctcgccacttcgcatggctcatgaagtcatgcttccccaacccaaacgacgccgtcgcgaaactcgcgtcaccgccgcaatcccaccgtaactcccctgtacccgcaaccaccatatcctccctccccgatgacatcgttttagactgcctctcccgcgtgcccacctcctccctccccgccctctccctcgtctgccgccgctggtcccgcctcctcagctcccccgacttctccgacctccgccgccaccgcctcctcctccgtcacaccgccgtcgccatcgccggcaccaatcttggcctgtcctccgccacgctcctcgacggcgcgtggcacccctccctcttcgtcccttgctacgacgcacactctctagataatttccactccttactcgcccacgcgcgcgcgtgctccgtcggtccgagaatttacctcgtcggaagaaacaacaccttgctatacgacacgtggaccgctacggtctccacccgcgcatccatgatcttcccgcgcaaaaagttcgccctcgccgccgtcggtggaaaaatctacgtttccggcggaagttctggaacctccgctgtcgaagaatatgatcccgagactgacacgtggagcgtggtttgcaacgcgccgaggaagaggtatggctgccttggaacatctttccaaggggtgttctatgtcattggcgggttgagaattggcgccacggaacagaatttaccgaatttgttcccacgtgcttctcgcggagttgaggctcacgcagcgtacgccagctcgatggatttgttcgacgtggaggcgcgcgtgtggctccggagtcggaccgtacccggtggaggctgcgtggtggcggcttgtgctgcggtcgggtgcgtgtatgtactcactagccatgcggtggagctttcattttggagttttcacgcccgacgaaaaaatcacaacaattataatggtaatgataattacaataacaatgtgtttggagaatggtgtaggataaagagcccgccgctaccggcgcaagttagagtggacagtagaattaggtttagttgtgtgggaattggggataaggtgattttaattcaaagtttgaatgaagtgagaggagttaaagaagggtttgtttttgtttatgattgcgtcgccgaagagtgggggagaggggtggatttgccggaggtttatcgacgcgctgcctatgtgggtgtggaatgctaa

SEQ ID NO: 27057 - DNA, 402 bp, Glycine max
  Peptide Sequence Number=SeqID_118742
tttagagacatgccggaaatcaaaaggaagcattgttatgcaatctgtgaaattccgtaacatgccggaaatcaaaaggaagtattgttacgcaatccgtgaaattccgatgttcctccagaaggcatttgcttctggaggaagcaacctggctcgcctgggcgagctgggtggcaagctcctcccctattttcctataaatagagggaggagtgaaggtgaaaggggttcaacccttctggtacttcataatcacttaaaattagtgaggaaaattgtttccgtgaagaaaatccaagccgaggcgcttccaaaacgtttccgtaacattttcgtgggtgatttcacgaagattttcaatcgttcttcgtcgttcgtcgttcgttcttcggtcttcaaccg

SEQ ID NO: 27058 - DNA, 360 bp, Glycine max
  Peptide Sequence Number=SeqID_118743
atggatgtggaggaagaccatgaggttccagtcattttgggacgtccctatatgtcaactgcaacatgtataatcgatatgggaaaaaagacactagagatgggttttgaagatcagaagatcaattttgatctttttgaagaaaacaagtcggtgccagagcataatatttgctttcctttcgctaagcacaagcctcgcgctaagcgcatcttttgtcatgtgctaagcggagagtctctagcgcttagcactcaacccttgcatctcaagctgatttggtccgctaagctggccaaggctaagctaagcccatttcaattcgatctaaattcggctaagcgatggcctgctcactaa

SEQ ID NO: 27059 - DNA, 570 bp, Glycine max
  Peptide Sequence Number=SeqID_118744
atgtcgacttcctctttgtccccatgttttgacatcaagtttgggtctttcgagggatttcccaaaggggtcgccaacacatacggtggcaccacggatgagtgcaatagcacggtggaaccaagaaaggatgatgaggccaaggaggtttctgaggtggagggactccacagtggggttgaagctgtagtagactataaggggtggcagtgtcaagcacacgttgtggagtcgttcgttgttgtgacaaaggcaaaggcaaactgtccctcttttgagacaatgaacatgccatctctgtcaatccaattcattttagaaccatttattactcctggtgagacacttccaaaatattcccaattaaacaaactttgcacaagagaaaaaaggtacccgtgtaaaagcaaagactttgcctttgatgttttgatgatgccatatgatcgtgatgttttgatgccttatgaaaatgcacttctcaagtttaattcaagacaaaaattcaagaatacaagatacaacatcaagaagatctctagtgtttttaggaagggaattccaaattga

SEQ ID NO: 27060 - DNA, 376 bp, Glycine max
  Peptide Sequence Number=SeqID_118745
atgacagaatcgtcaaagaagcgaaagggatcatcctccaccactgctgttgttggccatcaccgccacggaccatctgaagcacccacaacaccaattcatccttccttatcatctccaagatcatctactctattttctttagatgatcaacgtctatggtacaactctcaattttcttctaggatcatcttagaccctaagtccctagacacaaatttctttaatgatgagacatttgactgttatcaagtgtttcaaaactctggattagttgattttatgtccttaaaattgccttactatcctaaaattgttaaagtcttttacagcaatttaaaaattcaggatggtattatttcttctgaggtggatg

SEQ ID NO: 27061 - DNA, 617 bp, Glycine max
  Peptide Sequence Number=SeqID_118746
taaccctcgaggattattcaagttctactgtgccacaatttttcaccagtattgcacagccagaagttcaagctcagacaattacatatcctccttctttgatacagatgactcaaaataatctatttcatggtctatccaatgaagatccttatgcccaattggccacctatatagagatatgcaatactatcaggctagcgggagagatagtggcaaaatcacttggtaaccaattcaacagagaccagggtggttcatctacaaggccacaacaacagatgccaagtctctatgaccgaaccacaaagctggaagagactctagctcaattcatgcaagtgtcaatgtctaaccaaaagagcaccgagtctgcaattaagaatctagaagtccagttagctgaaagaccatcagacaactttatagtaaacacagagaaaaatcctaaagaagagtgcaaagctgtgatgactaggagcaaaatggcaattcaagcggaggaaagtagagctgatcagaaggtggagggatttaaacaacaattggctgatgaattggcgctgaaaccggttgatgatttagttgaacttgaagaaattgttgaggaagcataa

SEQ ID NO: 27062 - DNA, 462 bp, Glycine max
  Peptide Sequence Number=SeqID_118747
atggcacatcctagacctcactcccattggagagaaaaggaaagaaagcctcaagaggctaacattaacctcctatacttccatgggaaggacaatgtagaggctaacttagattgggaaataaggaaagaccaaggtcaagccatcttaggggtgacaccttctaagcccaaagatgataaggggaaggcaatagaaaatcaaccccttaaggctagtatgcaagagaagactagctccgtaaagtgctttaaatgtcttggaagagggcacattacttctcaatgccccaccaagaaaaccatgattatgaggtgccaagaaatttatagtagccaagataaggctactacttcaccttcctctagtaaaagtgaagtagcaaaaagggaagaatctagtaaagagatctacccccaagaagaaggacaacctttaatagttaaggaggagtgtaaagag

SEQ ID NO: 27063 - DNA, 109 bp, Glycine max
  Peptide Sequence Number=SeqID_118748
atggaagctcttaatatctcccacactttttgtggtgggccattcttggatggccttgaaggaggtagcccagggggtatctctttggaaaatatatcaccaaattcat

SEQ ID NO: 27064 - DNA, 417 bp, Glycine max
  Peptide Sequence Number=SeqID_118749
atgacgactaggaacgggcaaatcaaaatttcacttcgatttcgacctcaacatcctgctgctcatgtgcggcacgaagccgctgacgccgagtcggctcctatgccgctagctatgccctgcttggtcccccggcacggtggaggacagaagggagaaggttgtgaaggtggcctcgttatccacacctccgcgttggcgggtcctggagtgcctgtcaagggcgctagcgcataccccgggaacgcagcagcgagggacaacccgcccatacacagccagcggggaggatggcactactggcaaagaccgtccggcgaaaacgccgcaggcgcgaagcgtggtaggccggtgccgggggagcatagcataggtaggaaagggagccaggacggtggaagagccagggggggccgg

SEQ ID NO: 27065 - DNA, 693 bp, Glycine max
  Peptide Sequence Number=SeqID_118750
atgtgttacttgtgtgattgtaatttcaaactgttaaatatccttttagatttagggattgaggttagatcagttttgactcctattggacaagggagttcacaggttttagggtcatctcaattatcatcaaaagatgcatttctgtcaaaggctgaagtaaaaaatatctctcagattaatgccatttgcgaggaaattatttatgttactgtcgccaagattacaactatagtggtggacaactattcatggtgctatccagcttgcggtcaatgttacaaaaaaactgacatagaaactgtgcggttcacatgtccgtgtggcaaagagaacgatcaacctgtactaaggttgctatccattttcattcttctttttccgcgcaaggatgacgatgttgatttaaatgcctctcctcaagcactagataggctattgggttgtttccttgcattcaaagtgaaggtgcaaccaaggttcaggaatgttgttgttcttaaatattcagatgaatcaaacttgatcaatgttgtgctggatatgcttcccgatagtgagccatgttgcaagatcgagagttcaatacttgagtcgaccgatcctacagagcttgaatatcaatctgtctctgttactgctgatgatgatcgttcaatgcttgactcgactgagcctacagagcttgaatct

SEQ ID NO: 27066 - DNA, 186 bp, Glycine max
  Peptide Sequence Number=SeqID_118751
atgtcacctgacttcacgggtcaggatgacaatggtgtagaagacgacatgctgacatctccggaaagggtgcagatgaccacattggtctctgcttgtcaatcggacttggggtctccgaatgatgaggtgcggataattgtaaggtgtctccgcattctaccggactcttgggtcgctggatag

SEQ ID NO: 27067 - DNA, 198 bp, Glycine max
  Peptide Sequence Number=SeqID_118752
atggagcttgcatcacacaacaaagccttgcatgcatctgtcaaatgtttggactacatagtggccaaaatggttatcaaaaatggctcttccctcgatggcatgcccaaggctactttggacaagtttccttttaatgcatcacacctaagaccgagctctatggtagtgcaggcttttgaaggcagtcgtcgggat

SEQ ID NO: 27068 - DNA, 281 bp, Glycine max
  Peptide Sequence Number=SeqID_118753
cgctgttcatgtgtcctccaccatcgagtctggacacccgcgaattcattgtctagcgatgttcatgtgtcctccaccaacgacgctgttcatgtgtcctccaccaacgagtctggaaccccgtgaatcattgcctagcgctgttcgcaatttttccattctcaattttattcggagacccatgaactcattgcctagcgctgttcatgtgtcctccaccatcgagtctggacacccgcgaattcattgtctagcgctgttcatgtgtcctccaccaacga

SEQ ID NO: 27069 - DNA, 513 bp, Glycine max
  Peptide Sequence Number=SeqID_118754
atggctaacgatggagacaaatctgattccaatagctcttactctcttcaccattctgatcatcctggaatggtcctatcagcacatgttcaaccccttgtgaatggattgactgaattacaattacaacaaattttgtctattatgcaggacaatggagcatctcaatcagctactcctaaggcaaataatttcaatttttcttcaagtttgtctgtacccaagttgataattgatagtggtacaaaaaatcacataacttctccatctctacttgtcaacaataaagaaaacagttctttaccaccagttgttatgccaaatggagatcaagctccaattatttctactggaaatttacctttgagtcctattatttgtttaaagaatgtacttggggtaccatcttgtaaggtggatttgatgtttgatttgatgatggggatgacaattggtttgcgtgaacaacgagatggactttattacttggtttcaatgaataagacacacaaa

SEQ ID NO: 27070 - DNA, 453 bp, Glycine max
  Peptide Sequence Number=SeqID_118755
atgcccttaccttcagaggaatacacgtcctcccttttagagggctacacgccctcgcctttcagagggctacacgccctcaccttcaaaggactacacgtcctcgccttaagagtgctgcacgccctcgccttcagaggactggacgtcctcaccttcagagggctgcacgccctcaccttcaaagggcgacacgtcctgaacttcagagggctgcacgctctcgcctttagagggctgcacactctcgccttcaaagggagacacgtcctaaactttagagggctgcacgccctcgcctttaaagggctacgtgtcctcgcctttattactgggccaccccctgatcctggaggagggccaactatgcgagcacaaccagagagggaggctatcacgcgactactatgcataccagggcaagattccacccgtgccgctgcaaagagacga

SEQ ID NO: 27071 - DNA, 276 bp, Glycine max
  Peptide Sequence Number=SeqID_118756
atgggcagaagagagagtatattccgaaaggttgggcgaagtctctcgacctttgtgaacaagattgaaccaaaaacttcttatgagctgggcagtcggacaagtagtgagttgagtattatcctgtgtagggcttaccagtcaattagagtgatggggcatttaacaggggcgtacaatcccaagggagaacggacacgagggaaagtaatgctaactcaattcccgggattagggttaggatcagtctttgaaaaagacaactttcttgactag

SEQ ID NO: 27072 - DNA, 567 bp, Glycine max
  Peptide Sequence Number=SeqID_118757
atgtttgcacattcgattaaaggctgtcgtcccttgggacgggcgtgtggggtgctaataccttccccgtgcgtaaatacaactcccgaacctttaaacttaaaaattcgtagatcgcgtcttttccggtttttccgacgttttcctcaaataaacgttggtggcgactccgcgcgtattcctttcgtggaacacgcatcccgcgagtcacgcgtcgccctcccgccgaagggcaggttgcgacatatatcttttgatcattctgagcattccattactggtgaatctatgcattctgttattggtgattttgaacatcctgatcttgaacattataattttgagcattctgattctgagcattctgattttgcacattctgagaacatggcacaatctccaccctgtgagaggactctaagggaaatggctgcacctgatttcacctacgaaagcttatgcatccaataccctgatgaggatgtcccatatgttcttaaaactggactgattcatttgcttccaaagttcatggccttgcaggtgaagacccgcacaaacatttga

SEQ ID NO: 27073 - DNA, 186 bp, Glycine max
  Peptide Sequence Number=SeqID_118758
atgcaagaacaactctatatggagcttgtaggccttggatcttcttcatcaatggagtcctttgcttcttggatatcaatggcagtggaatggagaaggaagaaagatgattggagatgccacttcaaggagaagatgagtcaagaaaaagctcaccaccgtaggaagccatggataagagcttga

SEQ ID NO: 27074 - DNA, 667 bp, Glycine max
  Peptide Sequence Number=SeqID_118759
atgcgtcttgaagtcttctgtgaagaccgtctcggtctgacccgcgagttactcgatcttcttgttttacgtagcattgatttacgtggcattgagatcgatcctgtcgggcgaatttacctcaattttgccgaaattgaattcaatacctttagcagtctgatggctgaaatccgccgtatcgctggcgttacggatgtgcgcactatcccctggatgccctccgagcgagagcacctggcactgagcgcgctgctggaagccatgcctgaaccgttcctctctctggatctgaaaagtaaagtcgagcgcgttaaccacgcaagctgtcagctatttgcacagagccaggagaagctcagcaatcaacatgccgcacagctggtcccgggttttaacttccagcgctggctggacagcaacccgcagaatacccacagcgagcatgtagtgataaacgggcagaatttcctgatggagatcacaccgggtttatctgaaaggggaaagcgacactcgcgtactaaccggctgcaaaacctctccagccaggatgtcggcgcattcagccagattattgccgtcagcccgaaaatgcgtcatgtggttgaccaggcgcgcaagctcgccagcctgaccgcgccgctgctgattactggcgatacag

SEQ ID NO: 27075 - DNA, 660 bp, Glycine max
  Peptide Sequence Number=SeqID_118760
atgacaggggcttttgctcatggagctatattttttattagagattataatccagaacagaatgaagataatgtcttagcaagaatgttagaccataaagaagctatcatatcccacttaagttgggctagcctctttctggggttccatactctgggactttatgtccataatgatgtcatgcttgcttttggtactccggagaaacaaatcttgattgaacctatatttgcccaatggatacaatctgctcatggtaaaacttcctatgggttcgatatacttttatcttcaacgaacagtccggcgttcaatgcaggacgaagcatatggttgcctggttggttaaacgctgttaatgagaatagtaattctctattcttaacaatagggcctggagacttcttggttcatcatgctattgctcttggtttacatacaactacattgatcttagtaaagggtgctttggatgcgcgtggttctaagttaatgccagataaaaaagattttggttatagttttccttgcgatggcccgggacgaggcgggaatgtttcacagtttaatgaatcttctacctatttgatgggatggttaagagattatctatggttgaactcttcacaacttatcaacggatataacccttttgtatga

SEQ ID NO: 27076 - DNA, 747 bp, Glycine max
  Peptide Sequence Number=SeqID_118761
atggctccaaggaagcttgcctcaaagagatctaggaaggacgccgcggccgcagggactagtgccgctcccgagttcgatagccatcgtttcaggagcgctgagcaccagcagcgtttcgaagccatcaagggatggtccttccaccgagagagacgcgtccagctcagggacgacgagtacacggatttccaggaggagatagctcgtcggtgttggacgtcgctggtcactcccatggccaagttcgatccagatacaatcctcgagttttacgccaatgcttggcctacagaggagggcgtacgggacctccggtcatgggagggccaggagtgcgaatacggtcagaggaggaaccgggccgatggatttgatgaggaggccattgctcagctgctatgcataccaggtcaggattttgcccggaccgctgccgggagacgagtgcggatcatgcgcaccaacatgactaccctgactcagacatggatgacgttgctgcttagcaacatcctgcccagcgatcataattccgacctccccctgccgaagtgtcaattggtgtattccatcctgacacggatgagcgttcatgtggctcagttgatcgctgatgccatttatctatttgcaggtatgccgcctaccaggcaccctctagacccagataagtctaacagggccctgggttttccagcattgatcacgggtctctgccagtcgttcgggttcctgtcacaccta

SEQ ID NO: 27077 - DNA, 585 bp, Glycine max
  Peptide Sequence Number=SeqID_118762
atgtcgcttatcctgcaaaactacgcccagctaagccagggcccgcgccagcaaggggttcctaccatgctggacggcgttattcgtctgcatctgggcgatgggttcgttcagataacctacaccaaggtatttattctgctcgcctcgtttaccggcatgctggtgctcacctggataatcaaccatacccggctgggacgaatgtgccgggcagtgcagcaggatcgtaaaatggcctccattctgggcattaataccgaccggatcatttcgctggtctttgttatcggcgcggcgatggctggcctggcaggcgtgctgatcaccatgaattacggcacctttgatttctacgtcgggtttgtgattggcattaaagcctttacggcggcggtactgggcggcatcggttccctgcccggcgcgatgctcggtggcctgatcctcggcgtggcggaagcgcagttctccggcatggtgaactcggactataaggatgtgttctcgtttgggctgctggtgatgatcctgattttccgtccccaggggctgcttggccgcccgattgtggccaaagtgtga

SEQ ID NO: 27078 - DNA, 693 bp, Glycine max
  Peptide Sequence Number=SeqID_118763
atgactacaattttgggtattcacttaatcttgttaggtataggtgcgtttcttctagtattcaaggctctttattttggagggtggattggtagtgtggacgatttggaagatagagttggggggcatgtatggttgggttccatttgtatacttggtggaatctggcatatcttaaccaaaccttttgcatgggctcggcgtgcacttgtatggtctggagaagcttacttatcttatagtttaggtgctttatctgtttttggttttattgcttgttgctttgtctggtttaataataccgcttatcctagtgagttttacgggcccactgggccagaagcttctcaagctcaagcatttacttttctagttagagaccaacgtcttggggctaatgtaggatctgctcaaggacctacagacttgagtagactgaaaaaagatatacagccttggcaagaacgccgttctgcggaatatatgactcatgctcctttaggttccttaaattccgtgggtggcgtagctacagagattaatgcagtcaattatgtttctcctagaagttggttagctacttctcattttgttctaggattcttcctatttgtaggccatttatggcacgcgggaagagctcgcgcagctgccgcaggatttgaaaaaggaattgatcgagattttgaacca

SEQ ID NO: 27079 - DNA, 314 bp, Glycine max
  Peptide Sequence Number=SeqID_118764
atgctccagtggcttctgtttctatcagctgtcctcctgttcagctactgacggggtggtgcgtaacggcaaaaagcaaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagtgttttccccagtcacgacgttgtaa

SEQ ID NO: 27080 - DNA, 240 bp, Glycine max
  Peptide Sequence Number=SeqID_118765
atgaaattagcaaggatgcaaagaaaagagaagacaggaaagagttggtttgtggaactcgtggtcgctgcaaggatttggttcgtggaagtcgtggtcattggtagggctgtttgggatttcactcgtgctcgcaagttagtgatgcaatcctaccccgcaaggccattggatagaaaactcgaagtagattgggccagagatacaagagaaggccctaggattcttatgagccttacg

SEQ ID NO: 27081 - DNA, 219 bp, Glycine max
  Peptide Sequence Number=SeqID_118766
atgggggtgcaaatagcacccaggcccatttgggccctccagaagattcctccagaaggcggttgcttctggaggaagcaaccctgctcgcctgggcgagctgagctcgcctgggcgagctgggcggcaaccacctcccctatttttgctataaataggggaggaaggcaagaaggaagggaaaatctaagccgaggcgcttccgaaacgtttccgtaa

SEQ ID NO: 27082 - DNA, 544 bp, Glycine max
  Peptide Sequence Number=SeqID_118767
atgatgaacaaaatgatgaaaaccgcctgcgccctcgctgtgctggcggcctcggccaacgtaatggctgaaagcatagagctgaaagtaatcggaacgattactccgccagcgtgtaagccgatgcttgccggtagcggtacggttgattttggtactatcgcgccagcgtctctcagtaaagacaattataccgtcctagcggataaagagaccacgctgaatatcgtgtgtgatgcacctgcaaaagtggcgattaaagcggttagcggacgtaaaaataccactttatcagatggtgccgaaggcactaacggcgcagcgaaaccgctggtgaatctgggtcagtcagccgacttcggcgtggccggtttgggcatggacggcgagaaaaaaattggtgcctacggcgtggtagtgagcgatgtagtagtagacggtgtcaacggtcggccaattaaatccgaagataagcagacctggtccgacagcaatgcaaacggcctttatcaggctagtggcaatgacaatttcatcacatgga

SEQ ID NO: 27083 - DNA, 355 bp, Glycine max
  Peptide Sequence Number=SeqID_118768
atgtctcccgaacaatttcagtacatatggcgcaagacgattccacatatcgaggtcggaatgggatcgggtgttttcacgtctcaccgtagtgcccgcccgcattccagcaagctagccccgttgggggaagagggcttttccatcgcgaaggattccatccagccacaggttcccctacggctaccttgttacgacttcaccccagtcgaagaccccaccgtggtatgcgccaataagaccaccaaaagcctttgtggcactagtggtacacagaagtcatgggtgatcattggtccgatgcttcgggcgaaaccaattgcagggtgtgacgggcggtgtgtacagggcccgg

SEQ ID NO: 27084 - DNA, 934 bp, Glycine max
  Peptide Sequence Number=SeqID_118769
gaaggaaaagaaggagtccttttctcatgtggaagatacccaaacattccgctggtaggaacgaggggttgtattaactacaatcccgcgctcgctatgagacaactagggtactccatgaggggagcaccgacggaagaaagcatgtctcctttccttgtgagggatttcggcgcacaaaattccaagactatacaaagaatccataaggcatgggaaaccccgttaaggaaagatcaagagcttagaggcattcgtaatggcatcattggtgggtaccacgaatggctgaaagttcgcatacgaggtttaggttggctcgccaagttaaaagtcgtcagcgaagagaattttgaagcaccggaagaggacgaagaagtccaagctctcaaaagcgagttaggaaaggcaaaactcgccaaggagaagttcaagttggctgctacacacgttcggaaggagtgcgccgggttacgggaagagaatgcaattaccgcaagagcccttgaacaagagaccaagagggctcgcaaggaagagtatggccggaacaaatttcgcggagctctatggggtagcaataatgaactcaagttgcgaagggaagaaagggaccagtccaaaagaagcttgtctcagcgtctatgcgagacagagaccaacatgttagctatcatcgccaagtaccaagaagagttaggtctagccacggcccatgagcatagaatcgcggatgagtatgcccaagtatatgcggaaagagaggctagaggaagggtgatcgactctttacaccaagaggcaaccatgtggatggatcggtttgctcttaccttgaacgggagtcaagaacttccccgattactagccaaggccaaggcgatggcagacacctactccgcccccgaagagattcatgggcttctcggctatt

SEQ ID NO: 27085 - DNA, 627 bp, Glycine max
  Peptide Sequence Number=SeqID_118770
atgtgcaatgccaccgattataaaactaaatccatcggaggtatgtgcatcttactacaaatgtgggcttgggaacgatgtccaaccttggctccaaagaggactccttcccaagtagaaaatacatcactggggcacaggtggctgcgacgtggaaaccaacatatcggcaatgatgatgtgagagtttttcgtcgcaagttggatattatgaaacgtcatgagtttgtgtgggagcacccatcaaccgttatatcactgttgcctcccgtttgtttagtcggaagtctcgcgtggtacgcggtggtgccactaatttgtttccaagttattgagtggcaccaaccggacagagtattgagacaatttgggatgcagcaaccaattccagagtctccttcacaacccttaaacattcatggcataacattaaaagggaaacatgacgaaaattgggggcaattgttcgccccaatgattcataagtggaataatcgtcatgcatttagggtcgtcgcttatccccgacaagaaggcctattaagctttaactcggactacatggtctggtataggcaaaagacaaagatgtttgttgacccacaaaatgcaaagacggctacattg

SEQ ID NO: 27086 - DNA, 123 bp, Glycine max
  Peptide Sequence Number=SeqID_118771
atggagctggaacgcctgatcaaaagactctcagacagtggcattgatgatgctgatagaagctgccgcagtgaactgcttcacagcagtagaagcatggagacagggggagcagaaagctga

SEQ ID NO: 27087 - DNA, 333 bp, Glycine max
  Peptide Sequence Number=SeqID_118772
atgcagtcgagtgacaaaagcccaagtaagcgtaaacctttggtaattcatttcactagagatattaccactcagatacctcgaggtttccagctctctgtagcaaagatgctagtgctcgtcccttataagagtgacaaggcagtaccgtggaggtatggcatacaaggattcaacgggaggcaggacatgtccgtcatgcgtgttgggactagcatgccagctgctaagatcacgaatatttttggtacaagtggcatgactcgtagtggatgtatttttgctcctcccgaaccccggcaaggtcaaaagacaaggggaaggcaaaggtag

SEQ ID NO: 27088 - DNA, 252 bp, Glycine max
  Peptide Sequence Number=SeqID_118773
atgagagtacatccggaggaacccgcacgcacacttcagcagcctgtggagtggatactacctacacctactccatatcgactagtggagccagttcaagtgatagaggtgtcatcctctgaagaggatcctgaagaggacccagaggagtacctcttgagccctgctgtagatgctcttgactttccagaggatgatgaggacccactccctgacgtggattctcttagaggatatcatgtcagcatctaa

SEQ ID NO: 27089 - DNA, 245 bp, Glycine max
  Peptide Sequence Number=SeqID_118774
atggctccaaagaaactctccgcgaagaggtctagaagagacgccacaggagaaggatccagtgctgcctcagagtttgatagtcatcgtttccggagtgtcaagcaccaacgacgcttcgaggccatcaagggatggtcattccatagggagaggcgtgtccagctcagggaggatgagtatacagactttcaggaggagatagctcgcaaacgttggacactgctagtgactcccacggccaa

SEQ ID NO: 27090 - DNA, 191 bp, Glycine max
  Peptide Sequence Number=SeqID_118775
atgtttgcacattcgattaaaggctgccgtcccttggggcggacgtgtggggtgccaataccttccccatatgagggtcgattctttgaggatcctaacaacgagggtttgacaatcgatttcgatcgagatataaggcaaacgataaacgaggaagaggaagaggacgtcctatcgccagagttggagag

SEQ ID NO: 27091 - DNA, 458 bp, Glycine max
  Peptide Sequence Number=SeqID_118776
atggaagcaagaaaatgtcttattagattggtccctatatgtgtagggtttttaatttggtgcctacaagtaaggaaccaattaggaatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttaccgcaccacccc

SEQ ID NO: 27092 - DNA, 843 bp, Glycine max
  Peptide Sequence Number=SeqID_118777
atgtctcctttccttgtgagggatctcggcgcacaaaattccaagactatacaaagaatccataaggcatgggaaaccccgttaaggaaagatcaagagcttagaggcattcgtaatggcatcattggtgggtaccacgaatgggctgaaacgaagagaattttgaagcaccggaagaggacgaagaaagtccaagctctcaaaagcgagttaggaaaggcaaaactcgccaaggagaagttcaagttggctgctacacacattcggaaggagtgcgccgggttacgggaagagaatgcaattaccgcaaaagcccttgaacaagagaccaagagggctcgcaaggaagagtacggccggaacaaatttcgcggagctctatggggtagcaataatgaactcaagttgcgaagggaagaaagggaccagtcgcgagcacatagcatggttctgaaagaggagttgatggcttgttcaaagtccaaaagaagcttgtctcagcgtttatgcgagacggagaccaacatgctagctatcatcgccaagtaccaagaagagttgggtctagccacggcccacgagcatagaatcacggatgagtatgcccaagtatatgcggaaaaagaggctagaggaagggtgatcgactctttacaccaagaggcaaccatgtggatggatcggtttgctcttaccttgaacgggagtcaagaacttccccgattgttagccaaggccaaggcaatggcagacacctactccgcccccgaagagattcatgggcttctcggctattgtcagcatatgatagacttaatggcccacataattagaaatcgttag

SEQ ID NO: 27093 - DNA, 300 bp, Glycine max
  Peptide Sequence Number=SeqID_118778
gctgaatttgatatccctaaagcttctgatggtaggacaaagaagaaagtacttcagactgtcagcgagcggtggagacagtttaaatttggtttgacgaggaaatgggcacttgcagctgataaggacagtgtggatgacactgttcgtgaaaaatacagcattagcaaggagaaattggcccagttttgtcagaccctcagagacccctcgtgggaggatgtgtggaaaaaggcacaagccatccaaaagcaaaacactgccccccacgtgttgtcttgtgggggttatgaatattaa

SEQ ID NO: 27094 - DNA, 1039 bp, Glycine max
  Peptide Sequence Number=SeqID_118779
atggctacctcaccaaaagaaacttcagctcctggttcaccctctgtaccatcatccccatcatccaccaaagcgccatcaatccaggaacaacctgaattccatatccaacccatacagatgattcctggtcaagcccctgttcctgaaaaactggttcccaaacgacaacagggtgtgaagatttctgaaaaccctagccttgcaacaagtcctagggaagtagacacagagatggataagaagatccgcagtattgtgagtaacattctgaaaaatgcctctgttcctgatgctgatgaagatgttccaacatcttccaccccaaatgcttctgtgcctgatgttgagaaagatgttccaacatcttccgctccaaatgctgaagccgtcccttcacccagtgaagaggaatcaacggaagaagaggatcaagccgcagaggagacccctgcaccaagggcaccagaacctgctccaggtgacctcattgacctggaagaagtcgaatctgatgaagaacccattgccaacaggttggcacctggcattgcggaaagacttcaaaacagaaagggaaaaaccccccttaagaggtctggacgaatcaagacaatggcacagaagaagagtactccaatcactcctgccacatccagaagaagcaaggttgctatcccctccaagaagaggaaagaaatttcctcatctgattctgatgatgatgtcgaactagatgtctcgacatctaagagggccaagacatcaggtaagaaggtgcctggaaatgttcctgatgcaccattggacaacatctctttccactccattggcaatgcagaaaggtggaaattcgtgtatcaacggagacttgccttggaaagagaactgggaagagctgccttggattgcaaggagaccatggacctcatcaaggctgctggactactgaagacagtcaccaagttgggagactgttatgaaggactagtcagggaattcattgtcaacattccctctgacatatcaaacagaaaaa

SEQ ID NO: 27095 - DNA, 861 bp, Glycine max
  Peptide Sequence Number=SeqID_118780
atgctgaccggctacggccagtgggaatatcagatcgccgccaaccacacggaatccgacggcactaaagacaccaaaacgcgtctgggcttcgccggtctgaaatataaggatctcggttccttcgactacggccgcaactacggcatcatttacgacgtcggcgcctggacggatatgatccctgaattcggcgacgatgcttatatcaagaccgacaactttatgaacggccgtaccaacggcgtcgccacctaccgtaataacaacttcttcggactggtcgacggcttgaaatttgccgtgcagtaccaaggcaagaacgaaaacgacggccgctccgccagcaaggcgaacggcgacggctggggcctctcctccagctacgaaatcatcgacggcctgagcgtgggcgccgcctatgcctcttccaaccgcaccaccacgcaaaaagcgggcaccttcggtaaaggcgacaaggccgatatctgggccggtggtctgaaatacgacaacaacaacgtctacctggccgcgacttattcgcagagccgcaatatcgcgcctatttccggcaccgccaccatcaataacaacgccacttccgttagcggcttcgccaataaagcggaagggattgaattggtcgcgcaatatcagttcgacttcggtctgcgcccatcgctgggttacgttcagcagaaaggcaaagatattgaaggcatcggcgacgtcgatctggtgaaatatttcgacgtagcggcaacctattacttcaacaaaaacatgtccacttatgtcgaatataaaatcaaccagctcgatgacgacaacaagctgggtctgaaaaacgacgacgtg

SEQ ID NO: 27096 - DNA, 513 bp, Glycine max
  Peptide Sequence Number=SeqID_118781
atgaagcacttcactgacaccctcatcagtgccaacatagtaagccagtatacactcccgctagcgcccaatacgcaaaccgcctctccccgcgcgttggccgattcattaatgcagctggcacgacaggtttcccgactggaaagcgggcacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 27097 - DNA, 113 bp, Glycine max
  Peptide Sequence Number=SeqID_118782
gaacagaagcctatactgttgctaaagaatgtccgagcattgcaagaagctacattggccaaccaactataggtcacagatcgaggcgtaggcggcgtatggatggtcattga

SEQ ID NO: 27098 - DNA, 770 bp, Glycine max
  Peptide Sequence Number=SeqID_118783
ggctacacgccctcacctttagaggaccacacgtcctcaccttcagagggctacacgccctcgccatcagaggaccacacgtcctcaccttcagagggctacacgccctcgccatcagaggactgcatgtcctcaccttcgtagggctacacgccctcacctttagaggactacacgtcctcgctttcgtagggctacacgtcctcgccttcgtagggctacacgccctcaccttcgtagggctacacgctctcacctttagaggactacacgtcctcgccttcgtagggctacacgccctcacctttagaggaccacacgtcctcaccttcagagggctacacaccctcgccatcagaggactatatgtcctcaccttcgtagggctacacgccctcacctttagaggactacacgtcctcgccttcgtagggctacacgccctcaccttcgtagggctacacgccctcacctttagaggactacacgtcctcgccttcgtaggactacacgccctcacctttagaggactacacgtcctcgccaacagagggctacacgccctcacctttagaggactacacgtcctcgccatcagagggctgcacgccctcaccttcagagggctacacgccctcgccatcagagaactgcatgtcctcaccttcgtagggctacacgccctcacctttagaggactacacgtcctcacccaaacagagggctgctcgccctcaccttcaaagggttgcacgccttcaccattatag

SEQ ID NO: 27099 - DNA, 456 bp, Glycine max
  Peptide Sequence Number=SeqID_118784
atgcccccgactgtccctgttaatcattactccgatcccgaaggccaacacaataggatcagaatcctgtggtgttatcccatgctaatcaccggaggcacgacccggccagttaaaggacaggagcgcatcgccggcagaagggacgagccgaccggtgcacaccggagcggaccgatcgacccaacccaaggtccaactacgagcttttactgcaacaacttaaatatacgctatgagctggaataccgcggctgctggcaccagactgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcaggctccctctccggaatcgaaccctaa

SEQ ID NO: 27100 - DNA, 525 bp, Glycine max
  Peptide Sequence Number=SeqID_118785
atggccccgaggaaacttgcctcaaagagatccaggaaggataaagcggccgaaggaactagttctgctcccgagtatgatagtcaccattttaggagcgctgaacaccagcagcgcttcgaggccatcaagggatggtcgccggcggtggcatcactggttacccccatggccaagtttgatccagacatagtcctcgaattttatgccaatgcttggccaacagaggagggcggccaggagtgcgagtatggccagaggaggaaccggtctgatgggttcgatgaggaggccatcgccccagcttgctatgtataccggggcaagatttttgcccggactgctgtcgggagacgggtgcggatcatgcgcaccaacatgaccaccctgactcagatatggatgactttgctgctcagcaacatcctgcccaccgatcataattctgacctccccctgccgaagtgtcagctggtgtacgccatcctagcggatgagcatccatgtggctcagttaatcgctga

SEQ ID NO: 27101 - DNA, 568 bp, Glycine max
  Peptide Sequence Number=SeqID_118786
accaactgaaggagtggtggatcttgttgtttctgagcatcaaattgccaaggaaatcactgccaaacaagtccagcattggccaaagaaagggaagctttcttcagggaagctgagtgtgaagtatgcaattctgcataggattggcgctgcaaactgggtacccaccaatcatacttccactgttgccacagagaatctcctctatccctgcactacaaactgtttgagggggacacatgtcccagacattgtctcgacatcagggaaagctgctgcttcaggtgctgtgtccaaggatgctttgattgctgaactcaaggacacatgcaaggtgctggaagcaaccatcaaagccaccacagagaagaaaatggagctggaacgcctgatcaaagactctcagacaatggcgttgatgatggagaagcagctgaggaagaagaagatgcagcagaggatacagaatcagatgatgatgattctgatgccaccccatgaccatcagacctttatttttttactcttaacaattgattgttattggtctgtaatatttgcacattaa

SEQ ID NO: 27102 - DNA, 321 bp, Glycine max
  Peptide Sequence Number=SeqID_118787
atgacatttgagggcggtgatctggaagccatcccagtggaggttagtccaatgactgacttctgcatcagtctttgtcgggctattcgcctggcgaaacggattgacagatcgatattgaaatcgatagtcaccccttccaccggtctgccaagacagtctcaattaaaaaatgatattgtcgctttctctaaagacctgatcctaagggggtacgttgggagccaacttggaaagcgagaccttcgtggaggccgtaaagccattgtgactatgatgcagggtttcctcaatggtcccccttatccgatacccttatga

SEQ ID NO: 27103 - DNA, 300 bp, Glycine max
  Peptide Sequence Number=SeqID_118788
atggttattactagtactattagtattgctcaagttgatgttatggatgagtttatacaatttgaagatcaagatatgtcacaagtgggtaaatctcaactaaatatcatcccaatcttgatgttttgcaatattgggaaggacaatcaagctcagtttccagatctttcactattggcttgtgatattttaagcatccaaattacaacggtggcttccgaatcagcatttagtattggctcacgggaaaagaagatgaagatatggagatggagaaggctcaagctacttcaaatatga

SEQ ID NO: 27104 - DNA, 817 bp, Glycine max
  Peptide Sequence Number=SeqID_118789
gagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcgggctccagcttggagcgaactgcctacccggaactgagtgtcaggcgtggaatgagacaaacgcggcccataacagcggaatgacaccggtaaaccgaaaggcaggaacaggagagcgcccgagggagccgccagggggaaacgcctg

SEQ ID NO: 27105 - DNA, 147 bp, Glycine max
  Peptide Sequence Number=SeqID_118790
atggttgcgtcatccgtaatgtttgtgacattacggaaagaaaacaagtatcgttaccaattcgagtctaggcccttctggaacattttggaagttgggttgcttaaggaggaagcaactgagtggcaagctcctccacgtttttga

SEQ ID NO: 27106 - DNA, 810 bp, Glycine max
  Peptide Sequence Number=SeqID_118791
atgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcacctccttttcatctttccctcgcggtacttgttcgctatcggtctctcgccagtatttagccttggacggaatttaccgcccgattggggctgcattcccaaacaacccgactcgccgacagcgcctcgtggggacttgggcccggtccgccactgaggacgcttctccagactacaattcggacgccgagggcgaccgattttcatggtgggcttttcccggtctcgttgggagcgtgcgtgcacgcaaagggtcgtcgatgggtccagaactgaccggctcgcacgtgattggtctcgagcgtggctcatcccaccattttatcacggcgaagtcggccatgaacccagatttcaaaccaacccacgaggcgggtgctcgcgggaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggtagatga

SEQ ID NO: 27107 - DNA, 414 bp, Glycine max
  Peptide Sequence Number=SeqID_118792
ttcctgaaggatgactacacctatctggccgtggaaattattcgcggtgagtccatcagctacgcgctgctggagatcccgtctgacaaggtgccgcgctttgtgaacctgccgccggaaaccccgcgcagacgcaagccaatgatcctgctggataacatcctgcgttactgtctggacgacatcttcaaaggcttcttcgactacgatgcgctaaacgcctactcgatgaagatgacccgtgacgccgaatacgacctggtccacgagatggaagccagcctgatggagctgatgtcctccagcctgaaacaacgcctgacggccgagccggtgcgctttgtttatcagcgcgatatgccggacgccatggtggagaatgctgcgcgagaaactgaccatttcgcgctatga

SEQ ID NO: 27108 - DNA, 231 bp, Glycine max
  Peptide Sequence Number=SeqID_118793
atggcagcggaatggagaaggaagagagagaggagacgccacttcaaggagaagatgagtctagaagaagctcaccaccataggaggccatggataagagcttggaggaagaaggagatgaatgaagggagagggagagaagagcacgaaattttgtgctcaaaaagagctttgaaatctgaacccactaatccaagatcaattccaagattctccactaagtgtgcttag

SEQ ID NO: 27109 - DNA, 189 bp, Glycine max
  Peptide Sequence Number=SeqID_118794
atggaaatgttcgcctttggaatgaagatggatgagcagagcgcgcatcctcttgctgggagaggacgaactttctcaaagtcaagtttctcgcttgtttggaacggaaccctatacaaggggcttttccccaacctatatatacaaggtgctggtctcgatctcgcttggcggtgcccctctcgatga

SEQ ID NO: 27110 - DNA, 80 bp, Glycine max
  Peptide Sequence Number=SeqID_118795
atgggtgccaagcacctcccaagaccaaagaaaggtcgcatgtcaccaagcaatacatggggtccccggacgaaattagg

SEQ ID NO: 27111 - DNA, 264 bp, Glycine max
  Peptide Sequence Number=SeqID_118796
atggcttctccacctacctcccctcctccttctcttcctcctcctcttgctccttctgacacatcggcttcgccgtctgccgtgaagcgaacacgaaaagcctcacgtctacgatcgttgtctactagaccacttggtgctaagagaccagtggtccatgttgatcctgctattggcaaggccgacggtccccataggaagaaattaacaacatatttggggattgtggcgcgtgataaggtggacgtcacctatgagaactag

SEQ ID NO: 27112 - DNA, 323 bp, Glycine max
  Peptide Sequence Number=SeqID_118797
ttgaactcaacagctctcgaaaaattctaacagccaaaacttttgactcgggtgtatgtgtgaggccaatgatatatcgtgatgcaagctccattggagcttgtaggcctaggatcttcttcatcaatggattcctttgcttcttggaagatgaatggcagcggaatggagaaagggagagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 27113 - DNA, 750 bp, Glycine max
  Peptide Sequence Number=SeqID_118798
atggcgcaggtgccgcgattaaaacgtttcctgcacgtcggtaccgtcatgtcctgttcaccggagccgggttcgctggtggcggagagcggcgagtttgaggaagacgccgagcatctggtggaatacacccgttccaaatccaccatcgaacagctgatgcgccagcgctgcccgcaactgccgctgaccatcgcccgtccgtcgatcgtggtgggccacacccgcctgggctgccagccttccagcagcattttctgggtgttcggcatggcgctgatgctgcgcaaattcatgtgctcgctgcaggacaatatcgacgtgatcccggcggactactgcgcggatgcgcaggtgatgctgatgaacagcgaaacgttggagaacgacgtttatcacatctccgccggtgaggagagcagcgtcagctttgccgaaatcgaccgcgccatggcggcggcgctggaaaaggcgccggtgggcgatgagtatgcgcaggtgacctatgacgcgttggtgaaaatgcgccgccagctgaaagacattttcggcccgtgcaacgagcggctgatgctcaaggcgatgcgcctgtacggatcgttcgccatgctcaacgtgcgtttcagcaacgaaaagatcctcaagctgggcatgccgaagccgccgcgctttaccgactatatcgccggctgcgtgcagtcgacccgcgggctgtctatccagcagcagatggtggtggacttcaaataa

SEQ ID NO: 27114 - DNA, 318 bp, Glycine max
  Peptide Sequence Number=SeqID_118799
atgggattcacaaccaagggggctgccctgccaggtcatcgggcgtaccctatcttgaatctgggggaatccgtctcggcatctgtcctactggctgttgaagagctagtggaatggaccctttcctcatgccagcgggggaaagaaaagaggcccactacgagaggagagagtgattcagctgctaacaagcgcaggaaacctgggctccgttcgaagagacgaagtttggtccttctccctcacatgctccttcccatgagctactcggttggcttcgtgaacgagaacgctgatcaccctcacgcgggaagatga

SEQ ID NO: 27115 - DNA, 303 bp, Glycine max
  Peptide Sequence Number=SeqID_118800
gatcccactaagatttgggacctagctagggtagacgtctccatggaaccgattgcgtccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagtttccaaggaagtgtttggaggaaagggcaaaggccttggcaaaatcaaggcgaatgggcttcttttattgacatcttggcgcttttga

SEQ ID NO: 27116 - DNA, 823 bp, Glycine max
  Peptide Sequence Number=SeqID_118801
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaagattttgccaactttggcttgcgccccgttggctaagtctgtgcctcggcacaaagggggaggaggggcttggtcgtccgtccgcctcgggcacacacctagggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggaagagcctgttcgaaggatcaaaaagcaacgtcgctatgaacgcttggctgccacaagccagttatccctgtg

SEQ ID NO: 27117 - DNA, 387 bp, Glycine max
  Peptide Sequence Number=SeqID_118802
atgttgctagctggagttgagggcatgttagctattggagtaggcaaggtcagtacactagtagtagcgattggagtacaggatcgcatgagacagggtccgctcgcggggacatggttgctcattcaagtagttgagtattatagtagtagtagacggagtagacctggggttgaaacgactgggtcgtacagggcaggaggtacagtagtggagttgagagcagatggtagctgttcatctcaagtagtggaacaggaagcagatgaggtacgcctacaggttgacgtttcatttcatccaagtaggcatgggtcagttgagagtacaccaacccgttatcaactcgtgctcttgttagtcctagtagtagtgatagtagtatag

SEQ ID NO: 27118 - DNA, 111 bp, Glycine max
  Peptide Sequence Number=SeqID_118803
atgggggaaagcaaaaaaggaaagagaattctcgatcaaagatcagaagagaaaagaagaaatatgcagaaaggaaatgatttgcaagatcaagtcatgacatacctatga

SEQ ID NO: 27119 - DNA, 450 bp, Glycine max
  Peptide Sequence Number=SeqID_118804
gcttccggtatcacagggacaccaggattatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgcggtttgcgtattgggcgctagcggagtgtatactggcttactatgttggcactgatgagggtgtcagtgaagtgcttcatgtggcaggagaaaaaaggctgccaccggtgcgtcagcagaatatgtga

SEQ ID NO: 27120 - DNA, 240 bp, Glycine max
  Peptide Sequence Number=SeqID_118805
ctgtcctcctgttcagctactgacggggtggtgcgtaacggcaaaagcaccgccggacatcagcgctggcaagtgtagcggtcacgctgcgcgtaacaccacacccgccgcgcttaatgcgccgctacagggcgcggcgatcggtgcgggcctcttcgctattacgccagctggcgaaagggggatgtgctgcaaggcgattaagttgggtaacgccagggttttcccagtcacgacgtt

SEQ ID NO: 27121 - DNA, 674 bp, Glycine max
  Peptide Sequence Number=SeqID_118806
atgcagaatcagaattgcaaaatgctctcgatgaattgcagaaggtttcaagtccctattatcagcatcctggagagaatccagaataagtttaagttcgttgaccaaacgatttctattccgtatcagagtagttcgatctatgatgcatgggaacgatgcaatgtcatggtgatttcttgtatcactagaacccaaattccaaaaatagcaccaagcaagaccttgtgggacgagttggaggagttgcaacctactctgagctgcacttgtgcggcagaggtctacaattctatgaaaacacaaatattgttgatggagcctttaccatcaatcaacagagtatattttcttgttttgcaacaagaaagacaactgactggaggtagtcttaataattctagagttctttctagctccattgagaatcaaaatggttggaaaccacagggaagaggaaatggaagaggaggaagtcgatcttctcatggaagaagtaacaattacacaagcaagcagtgtgcctactgtaataaacatggccaaactgtagtcagtgttgggttaagcattgtttaccccctggctataagcctaaggataagcactgtaaatagttgcacagtgtcagaggaaggagcaaattcacttgaaactgataaaactttgcctcg

SEQ ID NO: 27122 - DNA, 690 bp, Glycine max
  Peptide Sequence Number=SeqID_118807
atgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcctactgggaggaaggaagccatatcttttctctgggttctatccctccacgacaagagttgccaaggaagtgtttggaggaaagggcaaaggccttggcaaaatcaaggcgaatgggcttcttttattgacatctggcgcttttgatctttggaggtgtcctctttccgaatatggaagggttagtggacctagcacgctctctatgtgtggctggtttcgcacctttttctccaagaaggtaggcccgtctatccgctacaaggtcaccgctcgaaggaagaatcaggattctatcttcatgcgaaggatgtccaaatgttcccttgatggaacaaggggttgtattaattataaccccgtcctcgccataagacagcttggctaccccatgagaggagtgccatcagacgaaagcatcacgcccttcatcgcacagggtttcagtgaccacaacgcgagggtactccaaggagttcgcaaggcatgggatgcggcgtga

SEQ ID NO: 27123 - DNA, 47 bp, Glycine max
  Peptide Sequence Number=SeqID_118808
gattttggctcagacttgtagaatggctaggcatgatacatgtcagg

SEQ ID NO: 27124 - DNA, 168 bp, Glycine max
  Peptide Sequence Number=SeqID_118809
atgactaaagcacgtcaaaaggggtacggaaagaaaatgaaggagagagcttgccacccagctcgcccaggcgagctaggttgcttcctccagaaggcaccccttctggagaacttcctggaaggcccaagtggccctggttggtatttgcacccccctatttactaa

SEQ ID NO: 27125 - DNA, 309 bp, Glycine max
  Peptide Sequence Number=SeqID_118810
aagttccagaaatttgtcaagagaaaaagaatagaaaggcgtcaaaactttaacaatggaagaagatcacaagaagactctcaagttcttagatgttacaaatgcaatcaacttggtcacatcaaagctaattgtccttcaaatgaagaatggcctgagaaaagtgctaagaaaatgtatgatgaaagaagaaccaagaaggcctacattgcatgggacaacaatgattcatccgatggttcagaaaaggagatcaatcttctaaccaaggattatgagagtgatgaaaacatctctcaagaaggttaa

SEQ ID NO: 27126 - DNA, 439 bp, Glycine max
  Peptide Sequence Number=SeqID_118811
ggcgcagaagacgacgttagtctctgcgtgctatctggcttttcgtcttatagacaccaaaaatgtttatacggataaccactcgggtatttccgcccgtcagcgtgactcaaaagtcagtatgacagatcttgtgagcgcggaagatgacataaatctccacgtgtcaacgggcttgtcggccggattgacgaaggtcgcagaagacgacgttagtctctgcgtgttatcaggcttttcgtcttacagaatgcaaaaagtttatacggataaccactcgggtatttccgcccgtcagcgtgactcaaaagtcagtatgacagatcttgtgagcacggaagatgaccaaaaagtttatacggataaccactcgggtattttcgcccgtcagcgtgactcaaaagtcagtatgacagatcttatgagcgcggaagataac

SEQ ID NO: 27127 - DNA, 195 bp, Glycine max
  Peptide Sequence Number=SeqID_118812
atggcatctaacataatctcaaaattaatcagctcagtagaggaaaatcaaggatttcaaatcacagaatacactctatctctcaagcttttaaggggtcctctaggagcgaccaggacaaggtatggaaaaatatggaataagtggctgaatcccaaaggaatagaggagcaatggggaataagtgcatattaa

SEQ ID NO: 27128 - DNA, 401 bp, Glycine max
  Peptide Sequence Number=SeqID_118813
agaatgcaactaccgcaagagcccttgaacaagaggccaagagggctcgcaaggaagagtatggccgtaacaaatttcgcggagctctgtggggtagcaacaatgaactcaagctgcgaagggaagagagggaccagtcgcgagcacatagcatggtcttgaaagaggatttagttgcctgttcaaggtccaaaaggagcttgtctcagtgtttatgcgagacggagaccaacatgctagctatcatcgccaagtaccaagaagagttaggtctagccacggcccacgagcataaggtcgcggacgagtatgcccaagtatacgcggagaaagaggctagaggaagggtgatcgactctttacaccaagaggctagctatcattgtgatgttggatcttaa

SEQ ID NO: 27129 - DNA, 552 bp, Glycine max
  Peptide Sequence Number=SeqID_118814
atgggtaaagcagaggaggtgcaagagaaggtgaaggccgacatggaggccatgaaagagaaaatggccacaatgatggaggccatgatgagcatgaagaagataatggaagccaatgcggttacaattgccgctaccagcactgttgctaaggtgaacccgatgcccccatctggcctcaaccaaatgaatcatccaacctcagctatgacacttgaaattccccaccacaatctagccgacttcgagccttgcctcagatatgccactaaagagcaagcagttggtggtatacccctgcaaaacactttggagggtcctcagtatcacccacaactacacctcttgcattccacaaaaagtaaaacccctcatgctatggcagaaatgggaaagttggatcatctagaggaaaggctcagagccagtgaaggaggtgaagattatgcctttgctaacctagaagagttgttcctagtacccaatatcatcacccctcccaagttcaaggtgctagactttgacaagtacaaggggactacttgcccctaa

SEQ ID NO: 27130 - DNA, 48 bp, Glycine max
  Peptide Sequence Number=SeqID_118815
atgggggtgcaaatagcaaccaggcccacttgggccctccagaaggct

SEQ ID NO: 27131 - DNA, 402 bp, Glycine max
  Peptide Sequence Number=SeqID_118816
atgacgttgctacttagcaacattctgcccagcgaccgtaatgccgatctccccctgggaaagtatcagttggggtcgcgcccacaagacacccagtggacccggaaaagtccaacagggccctggggttttcagctctggttacgggcctctgtcagtcctatagggtgctcgtccccccagcaagggatcacgcccgcaagacactcagtggacctggagaagtccataagggtcctggggttttcagctctgatgacaggcctttttaagcgcccgtcgcccccaacaaggtcattaggccccccattaatcgggctttcatcgagaagtattgcgcccccaggcaggcgcagggcgagacaccacagcagcattgggatggccggtagcgggcaatag

SEQ ID NO: 27132 - DNA, 518 bp, Glycine max
  Peptide Sequence Number=SeqID_118817
ggaggcgggatgggggccggccatgtttcccgttcggattggaacggtgagagccggtccgccgatcgactcgggacattgaccgccgcggattgcgatggtggccccaagcccgggctgttgatatgctcgtggagacgtcatcatcgcgattgtggatggcagcgcgcgccccttgggcgtgcctcggcacctgcgcgctccctggcgtcggcctgtgggctccccattcggcccgtcttgaaaacacggaccaaggagtctgacatgtgggcgagtcaacgggcgagtaaaccccatacctgtcgggacccgaaagatggtgaactatgcctgagcggggcgaagccagaggaaactctggtggaggcccgcagcgatactgacgtgcaaatcgttcgtctgacttgggtaggacggtgcggctgctctgttgagccgcgccatggaatcgagaagcttccaagtgggccatttttggtagcagaactggcgatgcgggatgaaccggaagctgg

SEQ ID NO: 27133 - DNA, 795 bp, Glycine max
  Peptide Sequence Number=SeqID_118818
atggcacagaagaagagtactccaatcactcctgccacatccagaagaagcaaggttgctatcccctccaagaaaaggaaagaaatttcctcatccgattctgatgatgatgtcgaactagatgtgctcgactctaagagggccaagaaatctggaagaaagaactgggaagatgggatccttggatctgcaaggagaccatgcgctactgcaaggtgctggatacgtgcccaagacgaatcacaactaagtgggagcactgttatgaagcctacaaagcagggaattcagttgtcacacgctccctctacattcttcattcagaaatttatatgcttggattcaagagtagaagataacttgcagctcctagtttcacccgctgtaccatcatctccgcaccaggaacaaccagaattcaacatccaacccatacaaataattcctggtcaagcttcagtccctgcgaaactgattcccagaagaccacagggagtgaagattgctgaaaaccctagccttgcaacaagtcctagggaagtagacacggagatggacaataaaatccgcagtattgtgagtagcattctgaaagatgcttctgttcctgaagctgatgaagatgtcccaacatcgtccaacccgaatgtttctgtgcctgatgtcaagaaagatgttccaacatcctccgctccaaatgctgaagccctcccttcacccagtgaagaggaatcacagaagagaggatcaagcctcagaggagactcctgcacacgggcaccagacctgctccag

SEQ ID NO: 27134 - DNA, 421 bp, Glycine max
  Peptide Sequence Number=SeqID_118819
atgatactctccaaatctaggactagccagttggcggcgcaaaagctggatattctccgatgtaggtcgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaaaatacttaacaggaa

SEQ ID NO: 27135 - DNA, 207 bp, Glycine max
  Peptide Sequence Number=SeqID_118820
atgccggaaaaccaaaaaatattgatgcacaatccgggggtgtacttagtaaaaatgggggtgcaaatagcacccaggcccatttgggccctccagaagattcctccagaaggcggttgcttctggaggaagcaaccctgctcgcctgggcgagctgagctcgcctgggcgagctgggcggcaagcatctcccctattttgctataa

SEQ ID NO: 27136 - DNA, 363 bp, Glycine max
  Peptide Sequence Number=SeqID_118821
atgtccaaatcttgtggatttcggatgaccggccctctcgatgagtcgatctcttgctttctcataagggtggacccttgggtactagttaccctcaccgttgagaggactacacgactacacgtcctcgccaacagagggctgcacgccctcacctccagaggactacatgtcctcgccttgagagggctacacgccctcaccttgggtactagttacctcacgagagacactcctcgccttggaggactacacgtcctcgccaacagagggctgcacgccctcaccttcagaggactacatgtcctcgccttgagagggctacacgccctcaccttgggtactagttaccctcaccgttga

SEQ ID NO: 27137 - DNA, 444 bp, Glycine max
  Peptide Sequence Number=SeqID_118822
atggatatgaatgtggggtaccttatctcccaccagatctctattactgcacagcacgattcctccagactgggattcttatccttgatcatagctctgtgtaaggctagagcagtccaatcagattctagatccatggagagcctgtgccctgccattaacttggcacacattaagaagaactgttggaatctagataatccaacagtgaaattcagagggccaaggaaggccagggagcctccacagagggcagatatacctatggctcaggaggaggaaacttctccaaatcccatgccaaagccatcccttgcaccagctcctgaggagaccttgccatcagtaccaattttggagcctgagcccaccattcaggattcatcagtagctccagtattggatatgaatgaagatcaaccacgggatgagcaggatgtttaa

SEQ ID NO: 27138 - DNA, 219 bp, Glycine max
  Peptide Sequence Number=SeqID_118823
atggctgaagcagacgctagaaatggcgataatggaggcaatgctgaggaattgggaattttgtctaatgtgagcaagaatacttgtcgcaacctacccttcggcgggagggcgacgcggggctcacaggtgcgtcttccaagaaaggaaaatgcgcggagttgccaccaacgtttatttgaggaagacgtcggaaaaaccagaaaatgtgtggtctaa

SEQ ID NO: 27139 - DNA, 1000 bp, Glycine max
  Peptide Sequence Number=SeqID_118824
atggattgggaccagctcttggccgggataggaggtagaacaatcagttggttcccccgatggaaggaaggaaaagaaggagtccttttctcatgtggaaggtacccaaacattccgctgataggaacgaggggttgtattaattacaatcccacgctcgctataagacaactagggtaccccatgaggggagcaccgacggaagaaagcatgtctccttttccttgcatgggaaaccccgttaaggaaagatcaagacttagaggcattcgtaatggcatcattggtgggtaccacgaatggctgaaagttcatatacgaggtttagattggctcgccaagttaaaagtcgtcagcgaagagagttttgaagcaccggaagaggacgaagaagtccaagctctcaaaagcgagttaggaaaggcgaaatttgccaaggagaagttcaagttggccgcaacacacattcggaaggagtgtgccgggttacgggaggagaatgcaattaccgcaagagcccttgaacaagagaccaagagggctcgcaaggaagagtatggccggaataaatttcgcggagctctatggggtagcaatagtgaactcaagttgcgaagggaagaaagggaccagtcgcgagcacatagcatggttctgaaagaggagttaattgcttgttcgaggtccaaaagaagcttgtctcagcgtttatacgagacggagaccaacatgctagctatcatcgccaagtaccaagaagagttaggtctagccgcggcccacgggcatagaatcgcggacgagtatgctcaagtatacgcggaaaaagaggctagaggaagggtgatcgactctttacaccaagaggcaaccatgtggatggatcggtttgctcttaccttgaacgagagtcaagaacttcccggcttgttagccaaggccaaggcgatggcagacacctactccacccccgaagagattcatgggcttctcggctatt

SEQ ID NO: 27140 - DNA, 138 bp, Glycine max
  Peptide Sequence Number=SeqID_118825
atggaggttgaggaaccttggttggggttatggctaccattgaattatcgagtggatatgggatcaagtttagcatatgacaacggaatttggggtggtcttcgcattggaagtgcggtagacaggctttgtggttga

SEQ ID NO: 27141 - DNA, 288 bp, Glycine max
  Peptide Sequence Number=SeqID_118826
atgaccaaaggtgcggataaccgtaaggtgtctccgcgtgctaccggactctcgggtcgttggatagcaatgggtgtgtgcgggttaccgtcgggtgtctccacatgccaccagactctcgggtcgctggatagcaaagggtgtttgcgggttatctttgggtgtctccgcatgccacagaactcttgggtcacagtagcaaaaggtggggtggtcgacaaaagcagggcttttgctcctacatatcctcaatttgtgatgaggaactcatacctacgtagttcttga

SEQ ID NO: 27142 - DNA, 490 bp, Glycine max
  Peptide Sequence Number=SeqID_118827
gtgtgaagcgatctcgtactaaactccggttcggtaagccgaagcctatatcgctaatgccaaagaagcccaatcacgctagcgtggttttcaacctccgccttcgcttcgggtgcctgtcagctccaccagcagccgctgctgtgcttgatattggacaaattgaactaaaggaccgatgggggatctccgaagatgaggaagaggagcgtagaagaccagggcggatattgcaaagagatcaccagcagcggttagaagagcttctatttcaccaagagcttatgccataccagctgattcaagttgttgcttctccccgcgggggatatcgattactggtcgtaaggggtgggatatctggttcagcagcagatcctaattacccttctggtgactcccggagaagcgttaactactgggatatcggggagttcctctccagctactggaacttccctcgctacatgagcttattgtataagtacag

SEQ ID NO: 27143 - DNA, 822 bp, Glycine max
  Peptide Sequence Number=SeqID_118828
atgtttggagacttccaattagtaccaactgtcgaagaatttgaggagattctaggatgtcctcttgggggaaggaaaccgtatcttttctccgggtttcttccctccttgagcaagattgcagttgtggtcagggattcggcgagaggattggatcgtgtaaagcaaactcgaaacgccgtagtgggcctaccacagaagtacttagaaggcaaggcaagggatatggagaatcaagaggagtgggtcccgtttatggacgtattagcattgctaatctttggggttgtcctctttccaaacatggatggtttggtggacctagacgcgattgatgctttccttgcatatcaccatagcaaagagagctcggtggtagttatcttggcggacttatttgatacatttgaccgaaggaaggaaaggagggagttctcttctcatgtgggggctacccaaacatcccgtgataggaacgaagggtgcattaactacaatcccacacttgctatagacagtagggtaccccatgaggggagcaccgacggaagaaagcctgcctcctttccttgtgagagattttggcgcgcaaaattcaaggttatacaaagaggccataaggcgtgggaaagcccgttaaggaaagataaagagcttaggggcattcgtaatggcatcattggtggttatcatgaatggctgaaagttcgtacacgaggaagacttaccaaagaaaaattcaagttcgtcgctacagatgtccggaaaaagtgtgccgggttacgagaagaaaatgcagctaccgcgaaagcccttgaataa

SEQ ID NO: 27144 - DNA, 1612 bp, Glycine max
  Peptide Sequence Number=SeqID_118829
atgcctgtacttcccgatcgtgacgtgattgatcagatcatctccggccattacgccgacccctttgctctgcttggcatgcatgcgaccgataacggtctgcaggtgcgcgcgctgctgccggacgctggcgcagtctggctggtggaacagcaaaccggccggcggctggtgcagttgaactgcgacgatccgcgcggcttcttcagtgccgtggtgccgcggcgcaaaaatcctttccgctatcagctgcaggtcagctggcgcgatcaccaacagaccgtcgacgatccctatcggttcggcccgctgctgcaggacatcgacagctggctattggccgagggcacgcacctgcgcccctatgaacgcctgggatctcacctcgccacgttggatgacgtcgacggcgtcagctttgccgtttgggcgcccaacgcccagcgcgtctcggtggtgggggagttcaacttctgggacggccgccgccatccgatgcgtctgcggcgtgaaaacggcatctgggagctgttcctgcccggcgtgcgggccggccagctgtacaaatatgaaatcgtcgattgctacggcaatacccagttgaaagccgatccttacgccttcgaggcgcagatgcgcccggacaccgcctcgctggtggcgccgctgccggaggtggtgccgtcgacgcaggcgcgccgccgcgccaacgattttgaccagccgatcgccatctacgaggtgcatctcggctcatggcgccgccacaccgacaaccatttctggctcagctacggcgagctggcggtgcagcttatcgactatgtgaaggacatgggatttacccatatcgagctgctgccgatcaacgagcacccgttcgacggcagctggggctaccagccgctggggctgtatgcaccgacccggcgcttcggcacgccggccgatttccgggcgttcgtggcggcggcgcatgaggcgggcatcaacgtgatcctcgattgggtgccggggcatttcccgagcgacgcctacggcctggcgaattttgacggcaccgcgctgtacgaatacgccgatccgcgcgaaggctaccaccaggactggaatacgctgatctacaactacggccgccacgaggtgcgcaactacctggcgggcaacgcgctgtattggctggagcgcttcggtatcgacgcgctgcgggtcgatgcggtggcgtcgatgatctatcgcgactacagccgcgccgacggcgagtgggtgccgaattactacggcggcaacgagaacctggaggcgatcgccttcctgcgttataccaaccagactatcggccaggcgcagccgggcgcggtgacattggcggaggagtccaccgactatcccggcgtcaccctgccgccggacgccaacggcctggggttccactacaagtggaacctcggctggatgcacgacacgctcaattacatgaagtgcgatccggtgcaccgcaagtatcaccacaaccagatgaccttcggcatgctgtacgcatacaccgagaacttcgtgttgcctatctcgcacgatgaagtggtgcacggcaaaaaatcgatcctcgacc

SEQ ID NO: 27145 - DNA, 279 bp, Glycine max
  Peptide Sequence Number=SeqID_118830
atggatacacacaggattctgatcctattgtgtgccttcgggatcggagtaatgattaacagggacaaacgaaagttgggggctcgaagacgatcagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 27146 - DNA, 516 bp, Glycine max
  Peptide Sequence Number=SeqID_118831
atgaaggcttctggtaatcgattaccaagggggtgtaatcgattaccagaggaatgggtcactggtaatcgattaccagatcgtgatgcggcacagctaatccatgatcgagtggagatggagtgcctagagggagatctgggagaccctcgaaggcaacacgaggtgccaatttcgggcaccattcgatttacggctacttctttggtgcatccagatgaacctgcacgaacgcttcagcgcacggtggagtggatactacccacgcctacaccatatcgtctagtggagccagtccaattgattgaggtaacgtcgtccgaggaagaccctgaggaggatcccgaggagctacctcctgagcctgttgtggatgctcttgactttctagagggtgatgaggatccacttcttgaggtggattctcccgaggaagtcatgtcggcatctgaggcagattctacggaggatagtggcccgggggagatggcgatcagcggaggctcttcatcctag

SEQ ID NO: 27147 - DNA, 204 bp, Glycine max
  Peptide Sequence Number=SeqID_118832
atggctccgaaaaagctttccgcgaagagatctaggagggacgccgcgactgaagggacaagtgccgcccccgagtttgatagccaccgtttcaggagcgctgagcaccagcagtgcttcaaagccatcaaaggatggtcattccacagagaaagacgcgtccagcttagggacgatgagtacaccgacttggggatcctctag

SEQ ID NO: 27148 - DNA, 435 bp, Glycine max
  Peptide Sequence Number=SeqID_118833
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccggggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgattttagaggagttagtcttgaagtcatgcgccgggttaaggctaaaactgaaaggacaagttttggtgactggcgctcctccaagccagttacctcggttcaaagagttgggtag

SEQ ID NO: 27149 - DNA, 525 bp, Glycine max
  Peptide Sequence Number=SeqID_118834
atggcctctggtaatcgattaccaagggtgtgtaatcgattacaaggcttaaaaatggagacagtttccatgtgcagaagctgtgtaactcgagtttgggcactgatcgcgatggcagcacaattaatccatgatcgtgtggagatggagtgcctagagggagtttgggagaccctcgaaagcaatgagaggtgccgattccgtggcacgattcgactcactgctacttcattggtacatccggagaaacccgcacgcacgcttcagcggactgtggagtggatactacctacacctactccatatcgactagtggagccagttcaagtgatagaggtgtcatcctctgaagaagaccctgaggagttacctcctgagcctgctgtggatgctcttgactttccagaggatgatgaggacccactccctgatgtggattctccagaggatatcatgtcagcatctgaggcagactctacggaggagagcggccctgatgggacagcgactagtggagactcttga

SEQ ID NO: 27150 - DNA, 987 bp, Glycine max
  Peptide Sequence Number=SeqID_118835
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcgggggcttggtcgtccgtccgcccgggcacacctagttagcaccaggcaggcaaaacgagaagagaagccgacgaacgggtttgttggtgatttggaggggagggacgaatcaaagcgacaaggggctgaatctcagtggatcgtggcagcaaggccactctgcccacttacaataccccgtcgcgtatttaagtcgtctgcaaaggattctcccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgcttccacg

SEQ ID NO: 27151 - DNA, 96 bp, Glycine max
  Peptide Sequence Number=SeqID_118836
atgggaccaactcattttatttcaaaaaggaagtcgcatctagtcaaggtgtctgccatcgccttggccttggctaacaagcggggaagatcttga

SEQ ID NO: 27152 - DNA, 924 bp, Glycine max
  Peptide Sequence Number=SeqID_118837
atggccccgtggaagcttgcctcaaagaggtccaggaaggataaggcggccgaaggaactagttccgctcccgagtatgacagtcaccgctttaggagtgctgtacatcagcagcgcttcgaagccatcaagggatggtcatttctccgggagcgacgcgtccagctcagggacgacgagtatactgatttccaggaggagataggtcgccggcggtgggcatcactagttacccccacggccaaatttgatccagacatagtcctcgaattttatgccaatgcttggccaacagaggagggtgtgcgtgacatgaggtcctgggtgaggggtcagtggatcccgtttgatgcagatgctatcggccagctcctgggatatccgttggtgctggaagagggccaggagtgcgagtatggccagaggaggaaccggtctgatgggttcgatgaggaggccatcgcccagttgctatgtatggcgcctaccaggcaccctttggatccagataagtccaacaaggccctgggatttcccgcgctgatcacaggactctgccagtcgtttggagtccccgttacacctaccaaggtgattcggccgcccatcacccgggcttttattgagaagtactgcacccagagacaggctcaaggggatgctccacaggccgtgggcgcgccaccaccacctcatcaggctggcccggctgggtcatttgacatggagcagtatgtcgcaacctacccttcggcgggagggcgacgcgtggctcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 27153 - DNA, 768 bp, Glycine max
  Peptide Sequence Number=SeqID_118838
atggccccgaggaagcttgcctcaaagagatccaggaaggataaagcggccgaaggaaccagttccgctcccgagtatgacagccaccgctttaagagcgctgaacaccagcagcgcttcgaggccatcaagggatggtcatttctccgggagcgacacgtccagctcagggacgatgagtataccgatttccaggaggagatagttcaccggcggtgggcatcactggttacccccatggccaagttcgacccagacatagtcctcgaattttatgccaatgcttggcctacggaggagggcgtgcgagatatgagatcctgggtgaggggtcagtggatcccgttcgatgcggatgctatcagccagttcctggaatatcctttagtgctggaagagggccaggagtacgagtatagccagaggaggaaccggtccgatggttttgatgaggaggccatcgcccagttactgtgtataccggggcaggattttgcccggaatgctgcagggaggcgagtgcgaatcatgcgcaccaacatgaccaccctgacccagatatggatgacgatgctgctcagcaacatcctgcccagcgatcataatttcgacctccctctgccgaagtgtatggcgccgaccaggcaccctttggacccagataagtccaacagggccctgggttttcccgcactgatcacaggactctgccagtcgttcggagtccctgttgcacctaccaaggtgattcggccgcccatcacctag

SEQ ID NO: 27154 - DNA, 132 bp, Glycine max
  Peptide Sequence Number=SeqID_118839
atgaccaaattttgtctctgcgtgtcatcgggcccgccgcctctggatgacaaaaagggtgcggataaccgtaagggtgcggataaccgtaaggtatctccgcgtgtcatcgggcctgccgcctctggatga

SEQ ID NO: 27155 - DNA, 909 bp, Glycine max
  Peptide Sequence Number=SeqID_118840
tattatgaccagcccctaaggtgcttcacattcgaggacttccagctagtgccgactgtgaaagagtttaaagaaatcctgggatgcccactgggaggaaggaagccatatcttttctctgggttctatccctccacgacaagagttgccaagtatcaaggaagtgtttggaggaaagggcaaaggccttggaaaatcaaggcgaatgggctttcttttattgacatcttggcgcttttgatctttggagttgtcctctttccgaatatggaagggttagtggacctagcagtgattgacgctttcctcgcctttcatcatggcaaggaaagcccggtcgtcgccattttggccatgtacgacacgttcgaccggggatgtgaaaagagcgacgcaagaattttttgttgtgcactggctctctatgtgtggctggtttcacacccttttctccaagaaggtaggcccgtctatccgctacaaggtcaccgctcgtgcgtcgaaaaaggaaaggcgaattgggaccaactcttggctagcatggaggggcgtttgttaattggttccctcgctagaaggaaggaagaatcaggattctatcttcatgcgaaggatgacagagagcttaggggaagcagtaatgggatcatcggcggctatcataagtggctgagagtccgaacacaaggattggattggctcccaaatctaaagactgtgagagacgatgaggttaaagcttcgaaagaaagtgatgaggtacaagccctaaaggcagagcttgaaagagcctgggtagtcaaagagaagttcaaggcagcaatagtgagctcaaactccgaagaggtgaaaggaatcatcacgggtcaaaggcatgatctggaaggacgagctaaaggcttgccttag

SEQ ID NO: 27156 - DNA, 153 bp, Glycine max
  Peptide Sequence Number=SeqID_118841
atggaaatttatgtgagtgatcgactaggaaaaaatgattacaaaggtgatgacaaaaagctcaaagatcaatcaaagaacaactcatgtgaatcaaagattaatcaaagaacaactcaagtgaatcaagaacaattcaagagttcaagatag

SEQ ID NO: 27157 - DNA, 426 bp, Glycine max
  Peptide Sequence Number=SeqID_118842
atggtaagcatttgggacctagctagggtagaagtctccatggaaccaattgcctccctcgcccagtattatgatcagccgttgaggtgcttcatctttggggacttccagctatcaccaatggtggaagaatttgaagagatcctaggatgtcctctagggggaaggaaaccatacctcttctcaggggagtcctctttccaaatgtggatgggttggtggacctggaagcgatcgacgtttttctcgcctatcataaccacaaggaaagtccggttgtcgctatgctggccgacctatatgacaccttcgaccgaagatgtgaagaaagcaatgcaaggattgtttgctgtactccagctctctatgtggggctggtttcacacctttttctccgagaaggtaggcccgtctatccgctacaag

SEQ ID NO: 27158 - DNA, 141 bp, Glycine max
  Peptide Sequence Number=SeqID_118843
atggctcgcccagagatgatagcaaaagggctttatgtgaccctcacagtagtctgcagagaactcatgagtgatgccttcagatgtgcagtattcagtaaacttgctgttttcaaactctctgccatgggtcactcctga

SEQ ID NO: 27159 - DNA, 210 bp, Glycine max
  Peptide Sequence Number=SeqID_118844
atggctgccattgaaatggctctgaaaaagctttccgcgaagagatataggagggacgtcgtggctgcagggaccagtgctgcccccgagtttgatagccaccgtttcaggagcgccgagcaccagcaacatttcgaggccatcaaaggatggtcattccatagagagagacgcgtccagctcagccccgatgagtacatagatttttag

SEQ ID NO: 27160 - DNA, 393 bp, Glycine max
  Peptide Sequence Number=SeqID_118845
atgaggtggaaggttgtaggtggggataaggtcaggttttgggaagataaatggagtcagcaacagcaacctttagcagagaggtatcctagactgtatcaaatatcgacacagcagaaccaaaccattagacagatgggacagcacctgcattcaggatgggagtggcactttctgtggagaagatcgctatttgaaaatgaaatcgagtcagccatcaatttcctaagggagatcgaaggtatatacattcagcagcaaggatcagatcaatgggaatggttaggtgatcaatcaaggaattattccacacgcagcgattataatctggttttggaagcttctacaggaggtcagcaagaggaatggtggacagactaccaacaaggatga

SEQ ID NO: 27161 - DNA, 459 bp, Glycine max
  Peptide Sequence Number=SeqID_118846
atgaaaggaaggattgagcggtttgacggcaagcaacggcgactcatggtggccaccgatggtcgtgggtggtggagaagaaaagtgttggggttaagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 27162 - DNA, 516 bp, Glycine max
  Peptide Sequence Number=SeqID_118847
atggatctcattgaaaatatggctacaagtgacattgctattttgagagatagagctcacattcctaccaaaaagagtttattggagttaacctcccacgatgcattgttggcacaaaacaaattgctgtctaagcaactagaaaccttgactgaaacattaagatgtaccatttgtgggggagctcatgaatctggatgttgtattcctattgaagaacatcccactcgtgaagtcaattacatgggaaatcagcccagaaacaattttaatgcaagaggattttctggattccaacatggccaacaatataatcaacagcagggacaatggaggaaccaccctggaaatcatttcaacagagatcaaggtggaccatccacaaggccacagcaacaagggcctagtctctatgatcacacaatgaagttggaagagactctagctcagtttatgcatgtttctatgtataatcagaagagcacagagtctcccataaagaatcttgaggtctaa

SEQ ID NO: 27163 - DNA, 276 bp, Glycine max
  Peptide Sequence Number=SeqID_118848
atgccaatctccccctgcaaaagtatcagttggtctgtgtcgtccgacgtggggatcgcacccacaaagacacccagtggacccgaaaaagtcaaacagggccctggggttttcagctctggttacgggcctctatcagtcctacagggtgcccggatcgcgcctgcaagacacccagtggacccgaagaagtccaacagggtcttggagttgtcaagctctaattacggggcgaaacaccacagcagcattgggatggccggtagcgggcaatag

SEQ ID NO: 27164 - DNA, 366 bp, Glycine max
  Peptide Sequence Number=SeqID_118849
atgtcgttgctatttagcaacattctgccccaacgaccacaatgccaatctccccctgcagatgtatcagttggtctgtgccgtcatgacatagggatcgcgcctacaagacacccagtggacccgaagaagtccaacagggccctggggtttccagctctggttacgggcctctgtagtcctacagggtgcccgttccccccggcaaggtcacgtcatcatgacatagggatcgcgcctgcaagacacccagtggacgcgaagaagtccaacagggtcttggagttgccaagctctcattacgggcctcagtcagttctacggagtgcctgtcacccccagcaaggtcatcaggccccctactaa

SEQ ID NO: 27165 - DNA, 552 bp, Glycine max
  Peptide Sequence Number=SeqID_118850
atggccagcaacccagccagagcacaaaagaaaacaaattctttgaagaggaagcaaggagagtgctctcaagcaactctcaatagggattcaacttccccaacttgcttaaagcacagggccttctacacatgtgccaaagctgatatggaaggtaacttgtactctactatcaatggcgtagagatggtgattgatgttgcaatttggaaagcagtagtaggaatagatatgggtggagtccgtagcttaagacataatgttagctatatcattacgtatattctggcaccaacatccaacaatcatgctcaagtcacatacgatgacttgcaaatcatatatgggccgaaatcagtcttcacctcaagattcattgcttatttcaatatcgatgtatctaatgagattgtagactttaccaaagcctctaatgagataaccaaaaggcatctcaagaagcttggcatggcatatgttgatcatgagaggatcatggcaggagagcaaccagcagcaacaaatgttaatcagaatggaataagaagctga

SEQ ID NO: 27166 - DNA, 753 bp, Glycine max
  Peptide Sequence Number=SeqID_118851
atgaagaacgaacgaagaacggtgaagaacaatgtaggaatcgatcacgaatgcgatttgaaagcacctcggcctcattttttcttcttttttctccatcttctcatcaatttcactaaaatgctctcaatatatgaagctgaaccccttccttcagccccctcacacctatttataggaaatgaggggaggagtgcaaggtgcaaaagtgcaaaagaaatttggaatatgcttgaagtcgctcatgaaggcacaacggataaaaggaaaggaatagcactgaaagtcaactccttaagggaagaatatcagggcagttccagtagtgaggaagatgctaaaaacttcagtttaatggacaaaaaattctccaaatcctacaagaaggttgacgacaacaacaacaacaacaacacatattttgaatgtggtaagcaaggccacattaaatctgagtgtcctatctaccttagaaaacatggtggtgaaaagaaaaggaagaagggcaacaaacaaaagaaagcctacatagcgtgggaagatagttcatcaaaagcttccaactcttcaagtgatgatgaaattgctgatgtgttcttaatggaaaaatccaaaaatgatccgtcaacaagtgaagaaattgaggtgaactctaattttggagaacttttagaagcacttgatgagatgcaagaggaagctcaaaggcttgttgtgttaaacaaaaagctgaaaagtgaactgaaattgcat

SEQ ID NO: 27167 - DNA, 282 bp, Glycine max
  Peptide Sequence Number=SeqID_118852
cgaagaaccttaccagggcttatcgttccgggcaaccacttgaaagagaggggtgccttcgggaacgcggacacaggtggtgcatggctgtcgtcagctcgtgccactgccggtgataagccggaggaaggtgaggatgacgtcaagtcatcatgccccttatgccctgggcgacacacgtgctacaatggacgggacaaaggatcgcgatcccgcgaggggggagctaactccaaaaacccgtcctcagttcggattgtaggctgcaactcgcctgcatga

SEQ ID NO: 27168 - DNA, 546 bp, Glycine max
  Peptide Sequence Number=SeqID_118853
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggggaggatgggaaagaagggatcaagcttatcgataccgtcgacctcgagggggggcccggagaaaaaaggctgcaccggtgcgtcagcagaatatgtgatacaggatatattccgctttcctcgctcactgactcgctacgctcggtcgttcgactgcggcgagcggaaatggcttacgaacggggcggagatttcctggaagatgccaggaagatacttaacagggaagtga

SEQ ID NO: 27169 - DNA, 264 bp, Glycine max
  Peptide Sequence Number=SeqID_118854
atgagtgagctaactcacattaattgcgttgcgctcactgcccgctttccagtcgggaaacctgtcgtgccagctgcattaattgaatcggccaacgcgcggggagaggcggttgcgtattgggcgctagcgggagtagaaaaaaggctgcaccggtgcgtcagcagaatatgtgatacaggatatattccggttcctcgctcactgactcgctacgctcggccttcgactgcggcgagcggaatggcttacgaacggggctga

SEQ ID NO: 27170 - DNA, 404 bp, Glycine max
  Peptide Sequence Number=SeqID_118855
atgggttctccacctgcctccactcctcctcttcctcctcctcctccttcggacgcattggcttcgccgtctaccgtgaagcggacatgcaaagcctcacgtctacgatcgttgtccactagaccacctggtgctaagagaccagtggtgcatgttgatcctgctaccgggaaggccgacggtccccacaggaagaaattaagaacatgtttggggattgtggcttgtgataagggggacatcacctacgagaactggaaggaggcggaatttgatatcccagaggcttttgacagtaggatgaaaaggaagacggtgtcgaggacactgtttgtgagaaatacgacatcagcaaagaaaagtgggcctagttttgccagactcgcagagactcttcttgggag

SEQ ID NO: 27171 - DNA, 520 bp, Glycine max
  Peptide Sequence Number=SeqID_118856
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagacttataaaggataccaggcgtttccccctggcggctcccctcgtgccctctcctgttcctgcctttcggtttaccgttcgctcccaagctggactgtatgcacgaaccccccgttcagtccgaccgctgcggcttatccgggaaactatcgtcttgagttcaacccgggaaagacatgcaaaagcaccactggcagcagccactg

SEQ ID NO: 27172 - DNA, 492 bp, Glycine max
  Peptide Sequence Number=SeqID_118857
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcaaaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctttcgctccaagctggactgtatgcacgaaccccccgttcagtccgaccgctgcgccttatccggtaactatcgtcttgagtccaacccggaaagacatgcaaaagcaccactggcagcagccactg

SEQ ID NO: 27173 - DNA, 408 bp, Glycine max
  Peptide Sequence Number=SeqID_118858
atgtctcttgcaactctttttggaaagcttcgggaacacgaattggaacttatgagactaaaccaacatgaagaaaatgacaagaaaaagaaaggaattacacttaaagcctcatcttctattcaagaagaaagagacaaagaagacttgaatgaaatacaagaagaagatgatttcagtttcatcataaagagattcaataagtttctaaggaacaaaggaaatcaaagaagaacaaacatcaatccaaagaaaagaggagaagattcatcttttgttccaaagtgttatgaatgtaatcaacctggacatctaagagtttattgccctagtttcaagagaagaatggaaaaatttgataggaaaaccttcaaagataagaaggcaaagaaagcttacattacttag

SEQ ID NO: 27174 - DNA, 792 bp, Glycine max
  Peptide Sequence Number=SeqID_118859
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggggcgaattggagctccaccgcggtggcggccgctctagaactagtggatcccccgggctgcaggaattcgatccgtcttcatttccatgcggtgcactttatgcggacacttcctacagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 27175 - DNA, 396 bp, Glycine max
  Peptide Sequence Number=SeqID_118860
atggaacgtgagaagcagatgaataatcatctgcttccgcaagaaatcgaagaatttcttgggaatcctgcaagagctactcgttcttttttctctgacagatggtcagaacttcatctgagttcgaatcctactgagaggtctactagagatcagaaattgttgaagaaagaacaaaagaaacatcttgttctttccaggcgatctggaaaatatctaatgaaattagtggaattagatctattcaagataatagtacttcaaatactctggcaagttcccttttctcgtatccgattatatggttccaagggtgaacggacagttccaatagatttcttcttgaaaaatccgatagacttattccggagggaggccatatggcgtgcaatctga

SEQ ID NO: 27176 - DNA, 369 bp, Glycine max
  Peptide Sequence Number=SeqID_118861
atggcgaggacgtgtagtcctttaaaggcgaggacgtgtagtcctctgaaggtaagggcgtgtagctctacaaaggtgaaggtacatgaccctttgacggcgaggacgtgtagtcctctgaagttgagggcgtgtagccctctgaaggcgaggacatgtagtcctctaatggcgaggacatgcagccctctacaggcgaggacatatagtcctctaaaggtgataggtactagtacccaagagtccacctttatgagaaagcaagagatcgactcatcgagagggcagattgactgtccttttgaaagaggtgataattcatgcaacctcctcctatctttttgcaaatctctccgggaactcccttag

SEQ ID NO: 27177 - DNA, 427 bp, Glycine max
  Peptide Sequence Number=SeqID_118862
gagcaaaagcctcgcttttgtcgaccacactgctttctgttaccatgacccaagagctggtagcctgcggagacaccttacggttatccgcacctcgagtgtgattgataagcggaggccaatatggtcatctgcaccctttccgaagatgagcaagagccttccttttgtcggccgccccataatctttgtcatactgaccctgaggtcatgtgacatgcaccctgtttcatccagaggcggcgggcccgatgacacgtggagataccttacgattatccgcacccttttgtcatctagaggcggcgggcccgatgacacgtggagataccttacgattatccgcacccttttgtcatctagaggcggcgggcccgatgacacgcagagacaaaatttggtcattctgcacccttgtgtcatctag

SEQ ID NO: 27178 - DNA, 717 bp, Glycine max
  misc_feature (671)..(671): n is a, c, g, or t
  Peptide Sequence Number=SeqID_118863
gtgaactctagaggtggtggcggtgtgtctattgcccgctaccggccatcccaatgttgctgtggtgtttcgccctgcgcctgcctgggggcgcagtacttcttgatgaaagctcgattagtagggggcctgatgcccttgctggaggcgacaggcgcgatcccttgtcggggggggtacgagcaccctgtaggactgatagaggcccgtaaccagagctggaaaccccagggccctgttggacttttccgggtccactgggtgtctctcggggggagattggcattgcggtcgttgggcagaatgttgctaagtagcaatgtcatctatatctgtgtaagagtggttatgttagtgcgcatgatccgcactcgtctttttgcagcggcacgggtgaaatcttgccccggtatgcatagtagctgtgtgatagcctccctctctggttgtgctcgcacagttggccctcctccaatatcagggggtggcccaggaaccgtgtggatatggagcccactgaaagtgaggacgcgtagtcctctaaaggcgagggcgtgtagccctctgaagttcaggacgtgtcgcctttcgaaggcgagggagtgtagttctatgatggcaaggacgtgcaatcctctgaaggtgagggcatgcccccactttgaaaatgngggaacatgtagtcctctgaaggtgaggacgtgtagtcctctgaag

SEQ ID NO: 27179 - DNA, 539 bp, Glycine max
  Peptide Sequence Number=SeqID_118864
gcatgggcaagtccgatcactgagctgtacggcagcatggtcaggtgcgatggacaaatccgcgtactggttgatgttagaaatgaagctgtttcgcccgagctctactcaatgggtgttgcaactaccaatgcacctagtcaacaaggggcaacgcgtactactactatcgagctactagtgccaagtgagttcatgagtggtattcaatcggaaccaaatcgtactgaagagatgagtcaatcctactcaactatacctaggtgttgcaacaacgagtggagctactacgtccaaccaactagtacgaaacgaccggcgtatgaaagcatcgcaaatgcatcggtggctatagagctagttgaggttgctagtcgaatacaaaatgtaccaaccaagctacgtgtaccaccagcgaccatgaagcaaaagcaggcgcgaggcatccgttccgctactagctatgataatcaactactactagctagagcaatcggcatctatcttgactcactactaccgttgcaacctcagaagta

SEQ ID NO: 27180 - DNA, 1227 bp, Glycine max
  Peptide Sequence Number=SeqID_118865
atgtcgcaaaggacaagcagttccgtttgctgggaaagtggcaacactttacagtccaggaatgatggagaaaaaggtggttcccagaaccacatggtgacgcagaacaagacagaaacctgggaatcagaggtgatgatcccttttgcagtggaaagaacggtttacgcttttggtgggcccctcccagacaaagcatccctttcgagtaaaatgagcaaggtatttccctgctaccaaacctgcgaacctaggatttttgatagtgagccttacaactttaattgtttaagcaaacccaacaaactctttcgatccgccccgtcaatagcccatagggattacctgccttggcttgatcgagtcgaacaagcgtatgaggatttctggaagacatatggcatctttgatttgatacaattttctcgatctggtcctgaatatcgaccagaaatgctgatagcagctatgcacttcttcgaatcttctaccaacccctttcagtttaagtgtggtatgatgacccctactctcttagatgtggccgcctcacaggccttaggcctagcggagaaacttacgacccccactaattctagtgataatatcaagctagtatataaggagaacaccttttccaaatatatagttgaacacaaaggaccggtcgaagaggaagtctctgatgaagagcatgtagccttcttaaccctgtggctatctcactatgtcttctgcacgaaatccttgcaagtagccaaaagatttattccaatggcattacaaattcatgaaggtcagaactttggatttggacgcctcttgttagcagtgctatacgaatcgcttggtgaggcatgcgatgatctgaagaaatcgaaggatgggtcttccttcttagtgtctgggcctatgtggcttctccagttgtggcttaatgccacttttgaacaggaaatgggattaataatcccacaagattatgctgaagaagttgcaaatcgctcgatcgaaggccagagagcacttcgactaacgcccaagaccttggatccaagctcacaaaagctgttcctaaagtatatgaggattttcctgagctttgacaagtttcttccccaacatgctccattcattagtcgagaggttggcccagcctggttcactgactatttccctactgtcgatccggacaatgaagaagaggtgttcaatcgaactatttag

SEQ ID NO: 27181 - DNA, 50 bp, Glycine max
  Peptide Sequence Number=SeqID_118866
gagaaagggagctcagcggcaagaggattgtacctgagagaagcaaggag

SEQ ID NO: 27182 - DNA, 410 bp, Glycine max
  Peptide Sequence Number=SeqID_118867
ttggaacctcttacgtgccgatcaacgtctcattttcgccaaaagttggcccagggcttccggtatcaacagggacaccaggatttatttattctgcgaaagtgatcttccgtcacaggtatttattcggcgcaaaagtgcgtcggtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 27183 - DNA, 372 bp, Glycine max
  Peptide Sequence Number=SeqID_118868
atgcaggggctgacacagtcttctgcaccttttgttcctccgggaacaacaaagtcatttacatgcggaaatttcatggggcaactgtcataccctaatttcgtccggggacctttgcttgatgacatgcgaccattctttggtccttgtgagaaggcggttgcttctggaggaagcaaccctgctcgcctgggcgagctgggcggcaaccacctcccctattttgctataaatagaggaggaaggcaggaaggaagggccgaggcgcttccgaaacgttcccgtaacgttttccatgaggaatctcgcaaaggtttcaaccgttcttcgacgttcttcattcgttcttcatcgttcttcgatcttcaacgg

SEQ ID NO: 27184 - DNA, 335 bp, Glycine max
  Peptide Sequence Number=SeqID_118869
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggacagttttggtgactgcgctcttcaagccagttacctcgttcaagagtggtagctcagagaaccttcgaaaaccgcctgcaaggcg

SEQ ID NO: 27185 - DNA, 241 bp, Glycine max
  Peptide Sequence Number=SeqID_118870
atgattatgaggggccaagacatttatagtagccaagatgaagctactacttcacctccctctagtgaaagtgaagaagcaaaagggaaggaaagtcatttttcaataaagacaaacattaaagaaacttcccctcttagacaacctccacatcttctcctttgcaaaaagacacttgttagcattgccacacctgttgggcttaaggttattcctcaagtaaaggtgttgttggatgagg

SEQ ID NO: 27186 - DNA, 339 bp, Glycine max
  Peptide Sequence Number=SeqID_118871
atggggacaaatcaaatcggaaaaagattttatcaagtcaagattaagggcctagatgtcaccagccttaaggagttgggacggttgatgggacccctccaaatgcgagctgtccgcaaagtgtatggaaagattttagatttgaccacagcggaggtatttacggaagccgttgtatccctcgcccaatactatgaccagccgttgagatgcttcacgtttggggacttccaaatagtaccaactgttgaagaatttgaggagattctaggatgccctcttggttttaacaagacaaattgcagctgtatcttttctctgggtttcttccctccttga

SEQ ID NO: 27187 - DNA, 258 bp, Glycine max
  Peptide Sequence Number=SeqID_118872
atggcaagacacaaggtcacacgcacacacacacacacacactcacgcaggcacaaggggggaggaggggcttgggtcgtccgtccgcccgggcacacacctaggattctacccgccgctcgatgggaattgcgcttcaaggcgtctcgtagggctaatccgcctcacgagggtcaccaacggcacgtgcctttggggggccgaggccccctactgctggtcggcaaacggacggcggggcgcacgcgtcgcttctag

SEQ ID NO: 27188 - DNA, 177 bp, Glycine max
  Peptide Sequence Number=SeqID_118873
atggagtgttacagaaaacatttccttaatgagtgggctcaagtgaaagtggctattaagagtaggctcccagttcatacacctgaacctcgtattagcgcattctacgatgatttgaatcccatctttgaagccaagtcaccatcgtggaaactcaacactttccacgatttttaa

SEQ ID NO: 27189 - DNA, 114 bp, Glycine max
  Peptide Sequence Number=SeqID_118874
atgcacaatttgaaggagctccatgtagcttgtaggccttggatcttcttcatcaatgaagtcctttacttcttgaagatcaatggcagcggaatagagaaggaggaaaggtga

SEQ ID NO: 27190 - DNA, 249 bp, Glycine max
  Peptide Sequence Number=SeqID_118875
atggtccgcaccaagaaaacaggggagatgacgactgaggctgcaaaggaaatcactgagaagatcggatccttcgtcccccgtggacatcaggatgttctcaccattgctattggacgtccagagcaccctggacgtgtccgtgctactggatctggtgtcaccatcaagaaatactttggatcggttccatggacgtcccacagctcttccttgttgcctcctgaagaattgcagcagctgacctag

SEQ ID NO: 27191 - DNA, 226 bp, Glycine max
  Peptide Sequence Number=SeqID_118876
atggattcgattcggaagtgtttcggccttgttttcttttctttcttcttcctttctcttctttcctcttctttttggacctctagacctcagggaactcagggacccttttcctcagccttcccacacctatttatagcaaaacaaggcatttggaatgaaggtagctcgcccaggcgagctgataacttcatcctgaagcaaccctgctcgcctaggcgggctg

SEQ ID NO: 27192 - DNA, 304 bp, Glycine max
  Peptide Sequence Number=SeqID_118877
aggatacgttacttctcaatgccccaccagaaactatgattatgaggggccaagacattataatagccaagatgaggctactacttcaccttcctctaatgaaagtgaagaagcaaaaggggaaggatttatcgaagaaatctacccccaagaagaaggacaacctttaatagttaaggaggagtgtaaggaggtaagtgtctactccaagaggttagctaagaaggaaattcattttgcaataaagagaaatagtaaagaaacttcccctcttagacaacctccatatcttctgctttgttaa

SEQ ID NO: 27193 - DNA, 199 bp, Glycine max
  Peptide Sequence Number=SeqID_118878
atggaaccccggggctcttcccgtgacccaagcacacgttggttcgagtcgtattctcggacgaaactggaggttgatgaacctgctagggtttcaaaggctatcattgaacttatcaagctttctcgctgcaaaattcatttcttggctgactttgtggttgatttagggatggcctttgtggataaatgggcggtag

SEQ ID NO: 27194 - DNA, 294 bp, Glycine max
  Peptide Sequence Number=SeqID_118879
atggagaagagcaaagtcgatacattgatagcaatttctccaaacacatggcatgcatcaaagtttattcatatttctctccaagataaatatgtgatttatggagacaacaaacgaaggcctcatttctccccaagaaaagtgaatatgcgatttatggagacaacaaacaaaggccacttgatcaacaaccgcaacaattactggaagttggaagttggaaatgaaagttattggaagttgaaagttgaaaatggaggttggaagttggaaggggaagttactaaaagttga

SEQ ID NO: 27195 - DNA, 287 bp, Glycine max
  Peptide Sequence Number=SeqID_118880
tgatctccgtcacaggtatttattcggcgcaaagtgcgtcggctgtccctcctgttcagctactgacggggtggtgcgtaacggcaaaagcaccgccggacatcagcgctggcaagtgtagcggtcacgctgcgcgtaaccaccacacccgcccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaa

SEQ ID NO: 27196 - DNA, 216 bp, Glycine max
  Peptide Sequence Number=SeqID_118881
atgtggtcactctcactaagtaagatcatagggagaccagttagggtcacgatgttttgcgagaatgctcaaccatatgggatcaacataggcttaaaggagcactcaaacccggtgacccccaaggcctacactccgaagagtccgtcagggcctctccctcctgattcaggtccaacccctaaaattattttagcacacagactctatctatga

SEQ ID NO: 27197 - DNA, 657 bp, Glycine max
  Peptide Sequence Number=SeqID_118882
atgaaagagattgaagaagaaaataagcgaagtctacaagcttggaaaaatgagctgaaggatgccattattactgacatatttaacggagataaggactcagcaccggctaattttgacttaaatgtgttaggtgcacgcgtgagcactaaggagagcaatgctgaaattgttgtgaacccgtctggggaagtacatgttggtcgtgtaacaccgcctatggggttgtacgtccaaagtcaagattgtacaaagctggtggcgttgggaaaaattcatgatggaccatctaccatacattgcgtagcctatgcaaatgatgtcgtaagggttagcgtcgaaaaagtaattgatggtgaagctgaagttccattagcaacatcagaaattaagtatgtgagagatgccattaacacattcattgcatggccattgcctttgcattcaggcatcactccagacaaagtttccaatgctgccgaattaaacaatgatgttcctaaacatgaccccttgcgtgagttgattaagacccttgttgacatttacgacaagcctgttgagtttgtgtgggatcttactgaatttgggattccaaatcgaaataacatcaggcgacaaatgcttgaacatagtcatacttcaattgtggaccat

SEQ ID NO: 27198 - DNA, 221 bp, Glycine max
  Peptide Sequence Number=SeqID_118883
ggggagatcagagttgtggtggtgttaatgatccacactcgtctccttgtagcggctgggtgaaatcttgtctcggtatacatagtagctgcacgatagcctccctctctagttgtgctcgcacagttggtcgtcctccaatatcagggggtggcccaggaactgataaaagcaaactactagcccctcacccgggagtgcaggcctcgattaagcattaa

SEQ ID NO: 27199 - DNA, 360 bp, Glycine max
  Peptide Sequence Number=SeqID_118884
atgcgggttgtacgtcgaagaaaatcctcccggcctagttgccataggaagactttatcacaatcgttcacaacattcctctgtgccatgatcaagtcaaggcatatgattgagacaagtatgcgagcggggaattctggtgtgtatggattcctcaagccacaatccatacaaagatctgggcaatcacaatttgaatcagaaagttatattaagaactggatgcagaattcaaaaagggatgtgtacctaggagcctacttgaatggtgcacattggcaaatggtcgtcattttgcctaaggaaaatgttgtcatctggttttgttcgttgcataatgttagagttttgtggtcttag

SEQ ID NO: 27200 - DNA, 49 bp, Glycine max
  Peptide Sequence Number=SeqID_118885
agcttttgttttagggttttacgttttctgctttgatgctactgttcac

SEQ ID NO: 27201 - DNA, 603 bp, Glycine max
  Peptide Sequence Number=SeqID_118886
atgggatcaagtcaaaagccttcgcttgaaaagaggttttatcaagtcaaaatcaagagcttagaggtcaccagtttacgaaagttggggcaattaatgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccaatgggaggaaggaagccatatcttttctctaggttctatccttcgacgacaagagttgccaaggtagtgaaaatctcagcacaagagttggaccggcgattgacgctttcctcgcctttcatcatgcaaggaaagcccgatcgtcgcattttggccatgtatgacacgtcgaccggggatgtgaaaagagcggcgcaagaattgtttgttgtgcaccaactcttggctagcatggaggggcgtctgttaaatggttccctcgctagaaggaaggaagaatcaggattctatcttcatgcgaaggatgtcccatga

SEQ ID NO: 27202 - DNA, 324 bp, Glycine max
  Peptide Sequence Number=SeqID_118887
atgtcttgcctagcgatcataacttcaatctccctagtgccagttggtgtatgccatcctgacacgaatgagcgtccacgtggcccaggtatgccacccaccaggcaccctctggacccggataagtctaacaaggccctgaggtttctggcgctgatcacgggcctctgccagtccttcggagttcccgtcacccccagtaaagtaatccgaccgccgatcacccaggccttcatcgagaagtactgcaggcgcagggtgatgcacatcaggccgcagacgcaccgccaccacctcggcaggccgatcccgctggatcactag

SEQ ID NO: 27203 - DNA, 243 bp, Glycine max
  Peptide Sequence Number=SeqID_118888
atgggtctgctgaaagtggttcaggtcggatatgctccactagcgctagtgcggagtaggaatgtagtagggtgcctccgctcgttcatcagtggtcctcggattggtagtagtcaaaaagccagtgaattgggcatgaccagtactactacaggtcgttcactggttgttgaggcaaggtcactagttgagggaaggtggtcagaggtggcaactcagtctgaggagctagtagtggtctag

SEQ ID NO: 27204 - DNA, 315 bp, Glycine max
  Peptide Sequence Number=SeqID_118889
atggccacaatgataaaggccatgatgagcatgaagaagataatggaagccaatgcggttatagtcgccgctattagcgctgtcgctaaggtgaacccgatgtccccatccggcctcaagcaaatgaatcatccaacctcaaatatggtaggcaaagatttaggaagtacgggcggcccccatgatgtgcaaattcaaaacaagcacgccttcccgtcatatggcttgcctctcaactatacaccacccaacgtggcgtacactcttaatgaaaatctcaataactccactccgatactcattgagaaccaataa

SEQ ID NO: 27205 - DNA, 204 bp, Glycine max
  Peptide Sequence Number=SeqID_118890
atgttcgcagggattgtgccgcagacacctagtggacccgaagaaggccaaaagggtcttggagttgccaactctaaatacgggtctctgtcagttctacggagtgcccgccgccccaacaaggtcatcaggccccctactaatcaagctttcatcaagaagtactgcgtctctaggcaggcgcagggcgaaacaccacagtag

SEQ ID NO: 27206 - DNA, 183 bp, Glycine max
  Peptide Sequence Number=SeqID_118891
atggataggaaagctagtggtgaagttagcaaaggtgaagtcccgaaacccaaagagaatgttggaagtggttctgaagataaggttatgaaggctccaggtggagatggatcttacatttccaggaaggaatttgagaaaaatcctcagggttactttgatgactggtcctataataagtaa

SEQ ID NO: 27207 - DNA, 286 bp, Glycine max
  Peptide Sequence Number=SeqID_118892
atggatgagtccatgctgtggcacttgagattgcatttatggcaagatgcacaggttatcatttccaaaaacatcttgagagctaaagctccacttcaattggtgcatgctgatatctggggaccatcaagagttcaaggccctagtggaaaagcaaagtgggcattccctcaaaatcttgagaacagatcgcggggggaattcaatgggcacatattcatcaatttttgcaatgatcatggcatcaagaaggagttgaatgttcgtcacactccacaacagaatg

SEQ ID NO: 27208 - DNA, 342 bp, Glycine max
  Peptide Sequence Number=SeqID_118893
atggataaagttgacatctttgtccctcatccccttgtaattacatctttgcttccactggaatgtgggtgcaagccattgagagaagtgagctatcaagaatatgagtcatttgacttaatccgtcaactgaaaaatccttcaactatttcttgtccttggaaaattctttttgcaagaatcaaccgcttctttcattcttccttgctacaaggttgtggaaacaaaacaacgatggttacctcagagccctacactgtggcaatgaaaggcaccatgcataaacctcaagtgaacctaggggcagatcaaaagttttcacccgtcgatgtttttaaataa

SEQ ID NO: 27209 - DNA, 507 bp, Glycine max
  Peptide Sequence Number=SeqID_118894
atggccccaagaaagcttgcctcaaagagatccaggaaagaaaaagtggctgaaggaaccagttccgctcccgaatacgatagccatcgttttaggagcgctgagcaccagcagcgcttcgaggccatcaagggatggtcattcctccaggagagacgcgtccaactcagggacgacgagtatactgacttccaggaagagatagttcgtcggcggtgggcatcgctggttacccccatggccaagttcgacccagacatagtccttgagttttatgccaatgcttggcctacagaggagggtgattttgctcggactgctgctgggagacgggtgcggatcatgcgcaccaacatgaccaccctaaccccagatatggatgacgtttgctgctcagcaacatcccagcccagcgatcataattccgacctcccccctgtcgaagtgtcagctggtgtacgccgtcctgacacggatgagcattcacgtggctcagttgattgctga

SEQ ID NO: 27210 - DNA, 412 bp, Glycine max
  Peptide Sequence Number=SeqID_118895
ggttttctgcctttgcccggttttcttggctgtgatagtttgtgctgtgtgaatgttgtattacttggatgttggggaagcttgggaggattgatggggacccggggatggtgggtttatgcgcgatttgtggatgtggaaaacttgttgtgcaccatcgcccgaccgccacctagtaccacatgtgatggagtgtacctggagatatgtcgcgggggtcaggagacttggggacgtcaggcgagctcctggcagtcaacagataaaaggaaaacaagaccacaaagcaaggaggcttgtggtggctggccagctgaggctaagatggtctctgggatttgggagatgatagaagcctctggtaatcgattaccagcctgtgtaatcgattacacagaggaatgggtcactg

SEQ ID NO: 27211 - DNA, 195 bp, Glycine max
  Peptide Sequence Number=SeqID_118896
atgcatgaaatggctccgaaaaagctttccacgaagaggtctagaagagacaccgcagcggaaaggtccagtgccgcccccgagtttgatagccaccatttctggagcgccgagcaccagcagtgcttcgaggccatcaaaggatggtcgttccacaaagagaggcgcgtcagctcagggaggatgagtatatag

SEQ ID NO: 27212 - DNA, 816 bp, Glycine max
  Peptide Sequence Number=SeqID_118897
atgggatcaagtcaaaagccttcgcttaaaaagaggttctatcaagtcaaaatcaagagcttagaggtcactagtttaggagagttggggcaattaatgggtcaacttcaacggcaagcctttcgcaaagcctatggtaagatttgggacctagctagggtagaagtctccatggaaccgattgcatccctttcccagtattatgaccaacccctaaggtgcttcacatttgaggacttccagctagtgttgactgtgaaagagtttgaagaaatcctggggatgcccactgggaggaaggaagccatatcttttctctgggaatggggtagtcggagtaccaaggaagtgtttggaggaaagggcaaaggccttggaaaatcaaggcgaatgggctttcttttattgacatcttgcgcttttgatctttggagttgtcctctttccgatatggaagggttagtggacctagtagtgattgacgctttcctcgcctttcaacatggcaaggaaagcccggtcgtcgccattttggccatgtatgacacgttcgaccgaggatgtgaaaagagcggcgcaagaattgtttgttgtgcactggctctctatgtgtggctggtttcacacccttttctccaagaaggtaggcccgtctatccgctacaaggtcaccgctcgtgcgtcgaaaaaggaaaggcgaattgggaccaactcttggctaacatggaggggcgtctgttaattggttccctcgctagaaggaaggaagaatcaggattctatcttcatgtgaaggatgtccaaatgttcccttga

SEQ ID NO: 27213 - DNA, 198 bp, Glycine max
  Peptide Sequence Number=SeqID_118898
gatgattacgagggatatgaggcgattgcacagaggttggagcgtgtgctcaaccttaggatagtcactacaggcacagagttatatgacattatgcaggactgcctgacgatcgcgagagggggacccagtgctgatgggacggtcagggctcgtcagagaccccgccacggaccattgatcattttttttgtttaa

SEQ ID NO: 27214 - DNA, 300 bp, Glycine max
  Peptide Sequence Number=SeqID_118899
atgacacaccggaaatcagatggaagcatctttgcacaattagtgagattccgtaacattccgttccgtaacattacagaaagaaacaagtatcgttacgaaattcgtaagttccgtactttacgaaaaagatcaccaaaaaaggtagggggtgtacttagtaaaaaggggggtgcaaatagcacccaggcccacttgggccctccagaagattcctccagaaggctgttgcttttgggggaagcaaccctgctcgcctgggcgagctgggtggcaagcttctcccccaattttctataa

SEQ ID NO: 27215 - DNA, 363 bp, Glycine max
  Peptide Sequence Number=SeqID_118900
atggagatcagtatgattgatgttgccagtggtggagcccttggagacatgacccctgctgaagccagaaatttaattgagaagatggcttccaactcccaacagtttagtgccagaaatgatgctattgtcattagaggagtgcatgaactggccttgaatcagaagtctgtacctatcgcaagactctgtggtttatgctcctctatcgaccagcacacagacctttgcccttttgtgcaacaatctgaagcaattgaacagcctgaagcttatgctgcaaacatctacaatagacctcctcaacctcagcagcaaaatcagccacaacagaacaattatgacctctccagcaacaagtag

SEQ ID NO: 27216 - DNA, 144 bp, Glycine max
  Peptide Sequence Number=SeqID_118901
atgacgcaaaagatactaatattccagttgaagtatagatatattactatctcacaaacaggcctgaggaacctgattcggttggcaatgccaaagctcatggaagctgatgttcagtttgctgtgtttactggtagggtataa

SEQ ID NO: 27217 - DNA, 333 bp, Glycine max
  Peptide Sequence Number=SeqID_118902
gtcacaggttgtaccatctgtggtgaggcttatgaaataggccaatgtactcccactgaagaaaacactcaagaaattcattatatgggaaatcaacagcgagaagggccaatccaacaaggacctaacatattccagagaactactaacctagaggagaccttgactcagtttatgcaagtaacaatgtcaaatcataaaagcactgagtcagcactgaagaaccttgaagtccaggtgggacaactggccaagcagatagctgacaagtcatccaatagttttgtggcaaatacaaaacagaatcccaaggaggaatgcaaagtactgtga

SEQ ID NO: 27218 - DNA, 518 bp, Glycine max
  Peptide Sequence Number=SeqID_118903
ggccctgggatttcccgcctggatcacggggactctgccagtcgttcggcgtccccgtcacgcctagcaaggtaatttgccggcccatcacccgagcttttatcgagaagtactacacgcagagacaggtccagggtgatgtaccacaggccgcggacgtgccgccacctcatcaggctggcccagccggattgtttgatacagagcagtatttgcggcatttggttcgccagcaggcgaccaaccaccgggcacatgtacagactcatgattgtctgtatcagatgagtctcagcctgcagagtcagggctttactcctttcccgtgccctaccccggaccagtttagggcagaggtcgcgtggcctggggattggcctgaggcccaggcagcaggggctccagcagaggcaccagcaggggcaccagcagaggctcccgatgaggtggatgaggcccgcgaggacgaagagatgacagacttacttgatttcttaggaggcagcggagccgcgtga

SEQ ID NO: 27219 - DNA, 231 bp, Glycine max
  Peptide Sequence Number=SeqID_118904
atgagaataaaaatacacgaaacacaatgtggaccaccatgggtacatagaatgaatcgaaaagcttggttcgagcaaaataggggaggtggttgccgcccagctcgcccaggcgagctcagctcgcccaggcgagccaggttgcttcctccagaagcaacagccttctggaggaatattctggagggcccaagtgggcctgggtgctatttgcacccccatttttactaa

SEQ ID NO: 27220 - DNA, 523 bp, Glycine max
  Peptide Sequence Number=SeqID_118905
cttggggggattgatggggactcggtgttgagaggaacgaggataaaggctacgtgggagtacgtgagctcaattgaaggtgggcaactggggatggtggaattatgtgtgatttgtggacgtggaaagtcgacttgcaccatcgcccgaccgccacctagaaccacatgtgacggagtggtacctggagatatgtcgcgggggtcaggagaccttggggacgtcaggcgagctcctggcagtcaaccgataaaagaacaaggaccacaaagcaaggaggcttgtgtggtggctggcacgctatggatcttgagtgatatttgcgatatggcctctggtaatcgattaccaagggaaactatgggagcccctggtaatcgattaccagcctgtgtaatcgattacacagagggatgggtcactggtaatcgattaccagtgcctagagggagcctgggagaccctcgaaggcaacacgaggtgccgatttcggggcaccattcgattcacggctacatctttg

SEQ ID NO: 27221 - DNA, 597 bp, Glycine max
  Peptide Sequence Number=SeqID_118906
atgtctgtgcattgggtgtacgatggaaggggacatatgactattaccagagctcctaggaataccggatccaagcaatcttttactagacttgaaggaggtcataataatcagtttagggagtgggggaaaggaatgacaatctccgtaggaagtctcatcttagctatcgcccacggctcttataaaaggctttgccagttgcttttctcccttgaccttgctactttcatagccatagcaggaagcctggcaactttctttcgagacatggttgaagaaaaggctaatgccctgactccaacggcgcctactccttcccctaaagcggggtacctccctgaatacaacaaaagaaaggctaagaaaagaagaaagaggagaatgcaaaagaaagtgggcactcgtttcgttggttcaactcctctctcaaagagaagcgtaggaatccgcttataccgaacagagcttagcagccacacctacaacttgagatgttcccctgtgagccttttatcttatagtactgcattgggcacagatgccaggctttcagcctttcataggtacggttaccccgcctacttgactacttga

SEQ ID NO: 27222 - DNA, 189 bp, Glycine max
  Peptide Sequence Number=SeqID_118907
atggccattgggtggacacttgctgaccttcctggaataaatccttctatatgcatgcctcggatactattggaggattattccaagcttgtaaggttctggagaggttggcagattcatattgcaccggaggatcgacacaagaccacattcacagtctattcggcacatttgcctacaccaggatga

SEQ ID NO: 27223 - DNA, 276 bp, Glycine max
  Peptide Sequence Number=SeqID_118908
atggcacaacctccaccccgtgaaaggactctaagggaaatggctgcacctgatttcacctacgaaagcttgtgcatccaataccctgatgaggatgtcccatatgctcttaaaactagactggtccatttgcttccaaagtttcatggccttgcagatgtccaggaggatcacatatttctgaaggcctttcctcattctttagagggagtggcaaaggactggctttattaccttgctccacggtccatcacgagctgggatgacctcaagaga

SEQ ID NO: 27224 - DNA, 415 bp, Glycine max
  Peptide Sequence Number=SeqID_118909
atggaaaaatctgataggaaaaccttcaaagataagaaggaaaagaaagcttacatcacttgggaagataacgatatggattcatccaaagaatcagaaaatgaagttgtgaatctaagtctcatggctaaaaactatgaaagtaaagaagagataacatcttctaacaataacttatctatttcgtatgatgaacttaaagatgcattcaatgacttgcataaagaatctttcaaacttgccaaactagtttcattctctaagaaaactatttcaaatttagaaaagaaagatttaaaattaaatgaagaattagaaaatcttagaactgaagtcaaaactttaaaaccaattgaggcaaatcaatcttctaccataaaagtgatacaagataataatgaggcatctaactcat

SEQ ID NO: 27225 - DNA, 225 bp, Glycine max
  Peptide Sequence Number=SeqID_118910
atgtcaggatttacacgcgattctcctcaaatttcaaccagcccgcatcaattagaccttgcaccttacgcttcagagccctacaatgctcaatggaacgccccggggcttctccgtgacaagcacacgttgcgtttgggtcgtattctcggagaaatggagacaaactttgtggttgatttagggattgcctttgtggataactgggcggtgggtaaggagaag

SEQ ID NO: 27226 - DNA, 480 bp, Glycine max
  Peptide Sequence Number=SeqID_118911
atgggagaatttgtggacggtagatgggaatggaagttatcttggagaagggacttttttgactatgaaatacaaatggcagctgactttgtagatgagattcattctggtcacatacataaatgctatgatttcaagaaccacccgtttgatcctgaaaagagaaggactacaccagggactacaccatccatatgtagcagttgcatgtggaggtcaacaccaggttgtctcatgaacgacaactccattagccatcttccagcggtcaatgacatggtgtgcatgcaacgggactcgagaaatttgaacaccttgcaatacatgttctgggggtggtcggctatgtacataataaacatcatactagacagctcaaaagaacaattacacggcatgaatatgaaggcattaaacgaatacatgctttcaggcatcatacatgtttgtgatttgtggaatttcaaaaacatattttaa

SEQ ID NO: 27227 - DNA, 186 bp, Glycine max
  Peptide Sequence Number=SeqID_118912
atggcgtttttcctaagctacttggactacaaggctcaaaacgcacaagtgagcaatggtctcaggaacggaaacgtcgcgcacattacagacatcttctcaagatcccaacggcaacttcatgtagcttccttgagaagcttcattaagaggcttcctcgagaagctttctggggatccctctag

SEQ ID NO: 27228 - DNA, 519 bp, Glycine max
  Peptide Sequence Number=SeqID_118913
atggagctgggagccaacctatactttcctggggcttgccttgccccaacatctaaatcaaatgcgggcgccgaaaaggaaccagcccagcctcttccagaaagctttgcttgtgtgacgcccccttctcccatgctgagtcacaggcagcgcctcggaaagcgcggacgagccacatgcagggaaacttgcacgtgtggttctggccggggaccccggtatactgtactaatatgtgtaggtccccgtaattcgagtgagattgtcatggcgcaaaagcagatatggtccggtattcccttgttccctgtattggttatgttcttcatttctcgtctagcagaaactaatcgagctccgtttgatctcccagaagcggaagctgaatcagttgcaggctataatgtagaatatgcgcgggatgcgatccttaatagtccactgttggcggaagccaatgtcccggggtcccggggactcattctgactgaaacaaggggtgggtctttaccaacttaa

SEQ ID NO: 27229 - DNA, 296 bp, Glycine max
  Peptide Sequence Number=SeqID_118914
atggagcataatggcatggctttgaatgattacacaaagggaaaacaccaaacaaaggctcaaatagagcaacaggatgattacggggtttattataactgctcaagcgtctcacgaacagcggccaaatacgtttcacctttgagtcacggggtgtcctgtccagcgcggaagggagagtaccgaagagtaacgcgagtgaggtcaccgagtgtcacgtggctatctacatgtcgtgcacaccacatcggtctccatgaaacaaacgttgtggaagtttcagctttcttattcga

SEQ ID NO: 27230 - DNA, 275 bp, Glycine max
  Peptide Sequence Number=SeqID_118915
ttgtcatcatcaaaaatggggagattgtagaagcaaagcttcatgatgaatcaagattgattcaaagatgttttgatgataacaaagatgatgacaaaggtgatgacaaaaagctcaaagaacacttcaagactcaagaggaaaagttgaagaacacttcaagattcaggaggaaagttgaattcaagaatcaagaatcaagattcaaggatcaagcttcaagaatcaagatcaagattcaagactcaagattcaagaatcaagagaagacttaa

SEQ ID NO: 27231 - DNA, 1020 bp, Glycine max
  Peptide Sequence Number=SeqID_118916
atggcgggcctaccacagaagtacctagaagacaaagcgaggggtatggccaatcaaggagaatgggtcccgtttatggatgtgttagctttgctaatttttggggtcgtcctctttccaaacgtggatggtttggtaggcctagcagcaatcgacgctttccttgcctaccaccatagcaaggaaagtccggtggtagctgtcttggcagatctatttgacacatttgaccgaagaatggattgggaccagctcttggccgggataggaagtagaacaatcagttggttcccccgatggaaggaaggaaaagaaggagtcctttttctcatgtggaagatacccaaacattccgctgggatctcggcgcacaaaattccaaactatacaaagatccataaggcatgggaaaccccgttaaggaaagatcaagagcttagaggcattcgtaatggcatcattggtgggtaccacgaatggctgaaagttcgcatacgaggtttagattggctcgccaagttaaaagtcgtcagcgaagagaattttgaagcaccggaagaggacgaggaagtccaagctctcaaaagcgagttaggaaaggcaaaactcgccaaggagaagttcaagttggctgatacacacgttcggaaggagtgtgccgggttacgggaagagaatgcaattaccgcaagagcccttgaacgagagaccaagagggctcgcaaggaagagtatggccggaacaaatttcgcggagctctatggggtagcaatagtgaactcaagttgcgaagggaagaaagggaccagtcgcgagcacatagcatggttctgaaagaggagttgatggcgtgttcaaggtccaaaagaagcttgtctcagcgtctatgcgagacagagaccaacatgttagctatcatcgccaagtaccaagaagagttgggtctagccacggcccacgagcatagaatcgcggatgagtatgcccaagtatatgcggaaaaagaggctagaggaagg

SEQ ID NO: 27232 - DNA, 207 bp, Glycine max
  Peptide Sequence Number=SeqID_118917
atggtccccagtggagtcgccaactgtcgcagcctacccttcggcggaagggcgacgcgagggctcatgggtgcatcttccaagaaagaaaaatgcgcggagtcgccaccaacgtttattcgaggaaaacgtcggaaaaaccggaaagggtgtttcccttgcttctacgtattcctcaattgtgatatggaaatcagatctacgtag

SEQ ID NO: 27233 - DNA, 271 bp, Glycine max
  Peptide Sequence Number=SeqID_118918
tgctccagtggcttctgtttctatcagctgtccctctgttcagctactgacggggtggtgcgtaacggcaaaagcaccgccggacatcagcgctggcaagtgtagcggtcacgctgcgcgtaaccacccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaa

SEQ ID NO: 27234 - DNA, 251 bp, Glycine max
  Peptide Sequence Number=SeqID_118919
gcctctgtcagttctatggagtgcctgtcgcccccagcaaggtcatcaggccccctactaatcgagctttcatcaagaagtactgcgtccccaggcaggcgcagggtgaaacaccacaacagcctggggatggccggcagcgggcaacagacgtaccgccatcacctctagagttcacctcagctcatccacaaaaagccatcaggcgtccagctcaagacgttaaagaagcgctactaggaggcaaccta

SEQ ID NO: 27235 - DNA, 426 bp, Glycine max
  Peptide Sequence Number=SeqID_118920
atggggacgaggggttgcatcagctacaatcccaatcttgctataagacaacttggctacccgatgagaggggcaccactagaggaagagctcacacctgtcatttcacgaggttttaataagaccaacatggagacacttctgaaggtccgcaaggcatgggaggtggtacaaaagaaggacaaagagctcagaggcagtaacaatgggcccagtggtggctaccgtgagtggttgaaagcccacgtgcaaggtttggattggctcccaagtctgagaaccgctaaaagggaggaagttgaggcaccggaggaagacgaagaggtgcaggatcttagaatagaactcgagcaagctcaaacagtcaaagaaaggttcaaatcagtggctcttaggatccaaaaggagaatgccaaattgagggat

SEQ ID NO: 27236 - DNA, 465 bp, Glycine max
  Peptide Sequence Number=SeqID_118921
atgctgaacgaaggaagcgtaggaaaactattttgcaagaacgaaaaagacaacgttcagctactaatgtgtatctcacaatgtagtccaactattaaccataataataaccctgctacaagcttccaatctacaccaccatcgcacgggactttatctatagatgattctgaacgatgctcaaaaagacatgcagtcaataatgccaaattggctgtttattatccagatgaacatcagacaccaactaacactacacagcatgatcaatttgtcggctatgacagctcagattccagtgatgatgatgtaaatatgatacaggaaaacattgatatagaatactcattaaatgacccaacaatagatgatcttgatgattatgatgaacagacctttctatctgcctcatctgcataccaaaatacaggtggtacttacattgatatcggagatcctatatag

SEQ ID NO: 27237 - DNA, 684 bp, Glycine max
  Peptide Sequence Number=SeqID_118922
taatgggatcatcggcggctatcataagtggctgagagtccgaacacaaggattggattggctcccaaatctaaagattgtgagggacgatgaggttaaagcttcagaagaaagtgatgaggtacaagccctaaaggcaaagcttgaaagagcccgggtagtcaaagagaagttcaaaaatagtgagctcaagctccgaagaggtgaaaggaatctcatgggtcaaaggcatgtcttgaaggacgagctaaaggcttgccttagcgggttactcacgacaagaggcctagaggatgagtacgccaagatatctcagcacgaagagttggaccgtgaatgtggattggaccgattgctgaaagggtcaaagaacttccccgattgcgccaaggccaaagcacgattgaacgctaggaagtttatcctcgctctcatcatggcaaggaaagcccggtcgtcgccattttggccatgtatgacacgttcgaccggggatgtgaaaagagcggcgcaagaattgattctatcttcatgcgaaggatatcccatgagaggagtgccatcagacgaaagcatcacgcctttcatcgcacgaggtttcagtgaccacaacgcgagggtactccaaggagtttgcaaggcatggatgcggcgtgaagaaaggacagagagcttagggaagca

SEQ ID NO: 27238 - DNA, 1041 bp, Glycine max
  misc_feature (709)..(709): n is a, c, g, or t
  Peptide Sequence Number=SeqID_118923
atgagtttgcagatttccagcgaggagatagctcgccgacattggacgtcgctggtcactcccatggctaagtttgacccagacatagtcctggagttttatgttaatgcttggcccacaaaagagggagtgcgggacatgcggtcatgggtgagccagttcctgggtgacctgctagtgttggaggaaggtcaggagtgcgagttcagtcagagggggaacaaagtcgacgggttcgacgaggaggccattgcccaattattgtgcacactggggcaggatttcgcccggaccgctgccgggaggcgggtgcagatcatgcgcaccaacatgaccaccttaacacagatgtggatgacattgctgcttagcaatgtcttgcctagtgattataactccgaccttcctttgccgaagtgtcagctggtgtatgtcatcctgacacggatgagcgtccatgtggctcagttgattgtttacgccatctatttatttgaaggtatgccacccaccaggcaccctctagacctggataagtctaacagggccctggggtttccaacattgatcacggacctctgccagtcattcggggtttccgtcacacctagtaaggtgatccgaccgccgatcacttgggcctttattgagaagtattgcacgcctagacaggcgcagggtgatgcactgcaggccgcagacgcaccgncaccaccgcatcaggctgatcccgttgggtcattaggcatggagcggtatctacagcacttggttcgccaacaggcggccaaccaccgggggcaggtgcagatacatgagtgtctctaccagctcagcctcagtcagcagggccagggtttcgctccttttgcgtgccctactccagatcagtttaaggctgaggttgcatggcccggagattggcccgaggcccaggcaggggaggcgcctgcaggagctcccggcgatgcagaggaggcccgcatggatgaggagatgacagacttgctcggtttcttgggaggaagcggagccacgtga

SEQ ID NO: 27239 - DNA, 258 bp, Glycine max
  Peptide Sequence Number=SeqID_118924
atggcagattacagaaacctcgcctctgcattctctttctccaaaaatttgcacattttgcatttgtactctctttgtgcattttcgactttgaagcatcaatcatacaccgtccaaattgatcaagaacacttcaaggttcaaaaggaaattgatttcaataatcaagaatcaagtttcaagattcaagttccaagaatcaagatcaagattcaagactcaagattcaagaatcaagagaagactcaatcaagataa

SEQ ID NO: 27240 - DNA, 222 bp, Glycine max
  Peptide Sequence Number=SeqID_118925
atggctccgagaaagcttcctgcaaagagatccaggaaggacaaagtggctgaagggactagtgccgctcctgagtatgacagccatcacttccggagcgctaaacaccatagcatttcgaggccatcaaaggatggtatgccacctaccaggcaccctttagacccagataagtctaacagggccttgggttttccggcattgatcacgggtctctgctag

SEQ ID NO: 27241 - DNA, 132 bp, Glycine max
  Peptide Sequence Number=SeqID_118926
atggaatacttacttgttggtgatgaacaaaagcgcaaaacggaatcaaaaaatgcgaaaaaggatgatcctagggctgcaaactcgtcaatcccgtgggggtggctcgcccagctcgcccaggcgagctaa

SEQ ID NO: 27242 - DNA, 732 bp, Glycine max
  misc_feature (77)..(77): n is a, c, g, or t
  Peptide Sequence Number=SeqID_118927
atggaatttggttcagagtacattgaaaaggctaaacctgttgggcttcctgaatctcgacatgatgacagagtggncgttaagggttcaagaggactgcatgttatcactccaagtgtagaacatttgttacaagctcacttgtatgtgttgaataacaataatgaagtattgccatacatacttcagcatgaagcaacaccgatgattgtgcggaccgatgacgtgttgtctcgtgaggattatgaatatttagaaaagaagttgatggatgagaagagaaagaaaaaacaagaggaagctgctcaatccggaagcactgaggtcatgattgatcctccatctcccatcagacgacacgtgaagtggaagatggcccgcaccaaaaaaattggccatatgacgtctgaggtaacaaaggaaattgctgagaggattgattcgttggaggagcatgcatcacagggttcgtttgtccctcatggacatcaggatgtcctgactgctgccattgggcaaccagaacacgctggtcatgtgtgtgctgttggagtcggtgtgaccatcaagcaatactttggaccggctcaacgaaccgcccgcagcacttcttccatcgctcccgaagaactagtgcagttgactcaacaaatcaaggaccagctggaggagtcaatcacagaaaaagtgactcagcagttgatgttatccttcagcgagatgcaatcctag

SEQ ID NO: 27243 - DNA, 804 bp, Glycine max
  Peptide Sequence Number=SeqID_118928
atgggatcaagtcaaaagccttcgcttaaaaagaggttctatcaagtcaaaatcaagagcttagaggtcactagtttacgagagttggggcaattaatgggtcaacttcaacggcaagccttctgcaaagcctatggtaagatttgggacctagctagggtagaagtctccatggaaccaattgcatccctttcccagtattatgaccagcccctaaggtgcttcacattcgaggacttccagctagtgccgactgtgaaagagtttgaagaaatcctgggatgcccactgggaggaaggaagccatatcttttctctgggttctatccctccacgacaagagttgccaaggtggtgaaaatctcagcacaagagttggaccgtgtaaagcaaaacaggaatggggtagtcggagtaccaaggaagtgtttggaggaaagggcaaaggccttggcaaatcaaggcgaatgggcttctttttttggcatcttggcgcttttgatctttggaggtgtcctctttccaaatatggaagggttagtggacctagcagcgattgatgctttcctcgtctttcatcatggcaaggaaagcccggtcgtcgccattttgccatgcatgacacgttcgaccagagatgtgaaaagagcggcgcaagaattgtttgttgtacaccggctctctatgtgtgactggtttcgcacctttttctccaagaaggtaggcccgtctatccgctacaaggtaaacgctcctgcgtcgaaaaaagaaagacgaattgggaccaactcttggctagcatag

SEQ ID NO: 27244 - DNA, 207 bp, Glycine max
  Peptide Sequence Number=SeqID_118929
atgtggggagattgtggaagcaatgccttcaaaggttattttgatgatgccaaagaattcaagaatcaagagaaagattcaagagtagtttcaagtttccacgaatcaagagtcaagaataatcaagaacaagattcaagactcaagattcaagaatcgagagaagacttaatcaagataagtatgaaaaggttttttcaaaactga

SEQ ID NO: 27245 - DNA, 840 bp, Glycine max
  Peptide Sequence Number=SeqID_118930
atgattatgaggggccaagacatttatagtagccaagatgaggctactacttcaccttcctctagtgaaagtgaagaagcaaaaggggaagaatctagtgaagaaatctaccccaaagaagatggacaaccattagtggttaaagagaagtgtaaggaggtaagtgtctcctccaagaggttagctaagaaggaaactcattttataataaagacaaacattaaagaaactttccctcttagaaaacctccacattttctcttttgtaaaaagacacttgctagcattgcaacacctcttgggcttgagtttattcctcaagtaaagaagttgttggatgagggtttggttcgcaagagcttaaatccttgtgcttttttggtgcccaaaataggtattattaggcaccaagtccctaaaataggtggtatgatgaatgttttgagtggtgcaaccctttttgtaaacactcgtacacctatctttcctggaataagaaagaaccacatacttaggaaccaacatcataactcttgcaagagcctaagtgaagaacttcgtgactattacgaaggaaggcataggtcacatcttagacctcactcccatagaagagaaaaggacagaaagcctcaagaggctaacattaacctcccatacttccatgggaaggacaatgtagaggctaacttagtttgggaaataagggtagagcaacaacttaaaaagaagtctacatcaaaatcttatggctctcactcttatccaaagaaagaccaaggtcaaggcatcttaggggtgacaccttctaagcccaaagatgataaggggaagacatag

SEQ ID NO: 27246 - DNA, 828 bp, Glycine max
  Peptide Sequence Number=SeqID_118931
aggctgtacgtcctcgcctctagagcgctgcatgtcctcgccttcagaaggcaacacacccttgacttcagagggctacgcgtccttgacttcagagggttgtacgtcctcgcctccagagggctgcacgtcctcccctccagagggctgcacgtcctcgcctccagagggctgcacgtcctcacctctagaggactatacgtcctcgtcttcataggactacacgtcctcgcctgcagaggactacacgtcctcaccttccgagggctacatgccctcgccttcaaagggctacgcgtcctcaccttcagagggctacgcgtcctcgcctctagagggctgcacgtcctcacctctagaggactacacgtcctcgcctccaaaggactacaggtcctcgccttcagagggctgcacatcctcgactccagaggactacatgtcctcgcctccagaagactacacgtccccgccttcagagggatgcacgccctcgccttcagaggactacacgtccttgccttcagaggactacatgtcctcaacttcagagggctacgtgtcctatccttcagagggctatgcatcctcccctctagagggctgcacgtcctcgcctctaaaggattacatgtcctcgcctccaaaggactacaagtccttgccttcagagggctgcacgttctcgcctccagaggactacacgtcctcgcctccagaagactacacctccccgcctttagagagctacacgccgtcgcctttagagggctacatgtcctcgccttcagaggactactgatcgaggtcatacccaaatcaaaataa

SEQ ID NO: 27247 - DNA, 504 bp, Glycine max
  Peptide Sequence Number=SeqID_118932
atgacatccaggaaaagaaaaagctcagcttccagacctcaagctcagtatgacaccagatacacggataacattctcggccaaaatatccttctagagataaatgtgcagatttatcatattgagtttgccgagtttaaagtggagttggagaggcgtaatccacacaaatgcctcactaacctccaagagggaagcattgatgtggcgatcatcaaagaattctacgctaacttgtacaaccttgaggaccaatcacccaagcaagccagagtaagaggaaatctcataaaaattgatgcagacagcctcaatgattttcttgagacagcagtagtcctagatgagggggagtctctacccacttattccagattctgcaggttgaggactaaccatcaagagataaaggccagattatgtattccctacaagggttttgtgctaaatgctgaaggtcaaccatggaatatcctcataaaggacttgaccacattagcctaa

SEQ ID NO: 27248 - DNA, 1077 bp, Glycine max
  Peptide Sequence Number=SeqID_118933
atgcctgatgttgagaaagatgttccaacatcttccggcccaaatgatgaagtactctcttcccccagcaaagagagatcaacagaggaagatgatcaagccgcagaggagacccctgcaccaagggcaccagaacctgctccaggtgacctcattgacttagaagaagtcgaatctgatgaagaacccattgccaacaggttggcacctggcattgcagaaaggttacaaagccgaaagggaaaaactcccatcaagaggtctggacgaatcaagactatggcccagaagaagagcactccagtcactcctgccacatccagaagaagcaaggttgctatcccctccaagaaaaggaaagaaatttcctcatccgagtctgatgatgatgtcgaactagatgtctcgacatctaagagggccaagaaatctggaagaaaggtgcctggaaatgttcctgatgcaccattggacaacatctctttccactccattggcaatgttgaaaagtggaaatatgtatatcaacgtagacttgccttggaaagagaactgggaagagctgccatggattgcaaggagatcgtggatctcatcaaggctgctggactgctgaagactgtcaccaagttgggagactgttatgaaggcttagtcagggaattcattgtcaacattccctctgacatatcaaacagaaaaagtgatgattatcaaagagtgtttgtcagaggaaaacatcagattgccaaggaaatcactgccaaacgagtccagcattggccaaagaaagggaaagctttcagcagggaagctaagtgtgaacattcagaatcttttgctgtcaaattacccattgccttccctactgtattgtgtggcattatgttgagtcagcatcccaatatgttaaactacactgactctgtgataaagagagaatctcctctatccctgcattacaaactatttgaggggacacatgtcccagacattgtctcgacatcagggaaagctgctgcttcaggtgctgtgtccaaggatgctctgattgctgaactcaaggacacatgcaag

SEQ ID NO: 27249 - DNA, 513 bp, Glycine max
  Peptide Sequence Number=SeqID_118934
ggacaccaaggatttatttatctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccaggcgggagtgtatactggcttactatgttggcactgatgagggtgtcagtgaagtgcttcatgtggcaggagaaaaaaggctgcaccggtgcgtcagcagaatatgtgatacaggatatattccgcttcgtcgctcactgactcgctacgctcggtcgttcgactgcggcgagcggaaatgcttacgaacggggcggagatttcctggaagatgccaggaagatacttaa

SEQ ID NO: 27250 - DNA, 371 bp, Glycine max
  Peptide Sequence Number=SeqID_118935
ctgtccctcctgttcagctactgacggggtggtgcgtaaccggcaaaaagcacccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcaaggactgtggagaccaaagatgggaaaaagaagaaagaagtggcagtgcaagggagaatgcgaaagaatgctatcaactcaagcggtggtgaggacaatagacatgacggcgacgatagacacgtgttcagggttttcgaatggaacaaattgagatag

SEQ ID NO: 27251 - DNA, 517 bp, Glycine max
  Peptide Sequence Number=SeqID_118936
tccggcgttcaatgcaggacgaagcatatggttgcctggttggttaaacgctgttaatgagaatagtaattctctattcttaacaatagggcctggagacttcttggttcatcatgctattgctcttggtttacatacaactacattgatcttagtaaagggtgctttggatgcgcgtggttctaagttaatgccagataaaaaagattttggttatagttttccttgcgatggcccgggacgaggcggtacttgcgatatttcggcttgggacgcattttatttggcagttttctggatgttaaataccattgggtggtctgggcatgggatgttcttgtttggacatcttgtttgggctactggatttatgttcttaatttcctggcgcggatattggcacgaattgaatgaaactttagcatgggctcatgaacgcacacctttggctaatttgatcgatggagagataaacagtggctcctttccattggtgcaagcaagaatggtggactag

SEQ ID NO: 27252 - DNA, 735 bp, Glycine max
  Peptide Sequence Number=SeqID_118937
atgaggggagcgccaacagaagaaagtctctcgcctttccttgtgatacaaagagtccacaaggcgtggagaagtccgttgaggaaagacaaggagcttagaggcatccgtaatggcgtcatcggtggttatcatggatggctaagagttcacacacgagggttagattggctctctaaattgaaagttatcgatgaggagaacttcgaagctccggaggaagatgaggaagtccaagttctaaaattagagctagggaaggcaagactcgccaaagaaaaattcaagtcagctgctacacacatccagagggagtgcaccgagttacgagaggaaaatgcggccactgcaagagcccttgaacaagaaaccaaaagggcccgcaaggaggaacatggccgagagaaattccgaggagcattgtggggtagcaacaatgagctcaagctccaaagagaggaaagagaccggtcatgggtgcatggcatgatcttaaaagaagagttggctgcttgtgcaaggtccaagaggagtttggctcaacacttggaagccacggagcaaagcatgctagctatcatagggcagtacaaggaagagttgaaccagtctgtgacccatgaacaaaagctagtggaggattttgcacaagtgtatgccgaaaaagaagcaagagggagggtgattgatgcattgcatcagaagcgactatgtggatggataggttcgctttga

SEQ ID NO: 27253 - DNA, 501 bp, Glycine max
  Peptide Sequence Number=SeqID_118938
atggccaccgatgagccttggaatgagaaccagaaggcccgaaggaagaacacgccaaagcaaagttttgaggggctttatagggcagcaatagtgagctcaagctccgaagaggtgaaaggaatcatcacgggtcaaaggcatgatcttgaaggacgagctaaaagcgagactgaagggaatatgtgggccatcatcgataagtgcaaagagaagctaaatctagcggcgactcacgagcaaaggctagaggatgagtacgccaagatatcagcagaaagggaagtaagggaaagggtaattgattcattgcaccaagaggcaacaatgtggacggaccgatttgctcttactttgaacaggagtcaagaacttcccccattgctagccaaggccaaagcagtggcggacacctactccgcccccgaggagatccacggacttctcagctattgtcagcatatgatagacttaatggaccatatgattagaaaccgctag

SEQ ID NO: 27254 - DNA, 1123 bp, Glycine max
  Peptide Sequence Number=SeqID_118939
gatcaagccacagaggagacccctgcaccgagggcaccagaacttgctccaggtgacctcattgacctagaagaagtagaatctgacgaggaacccattgccaaacagttggcacctggcattgcagaaagattacaaagcagaaagggaaaaacccccattactaggtctggacgaatcaaaactattgcacagaagaagagcacaccagtcactcctaccacatccagatggagcaaagttgcaatcccttccaagaagaggaaagaaatttcctcatctgattctgatgatgatgtcgaactagatgttcccgacatcaagaaagccaagaaatcggggaaaaaggtgcctggaaatgtccctgatgccccattggacaacatttcattccactccattggcaatgttgaaaggtggaaatttgtatatcaacgcagacttgccttagaaagagaactgggaagagatgccttggattgcaaggagatcatggacctcatcaaggctgctggactgctgaaaactgtcaccaagttgggtgattgttatgaaagtctagtcagggaattcattgtcaacattccctctgacataacaaacagaaagagtgatgagtatcagacagtgttgtcagaggaaaagcatcaaattgccaaggaaatcacttccaaacaagtccagcattggccaaagaaagggaagctttctgcagggaagctaagtgtgaagtatgcaatcctgcataggattggcactgcaaactgggtacccaccaatcatacttccactgttgccacagaatcttttgctgtcaaattacccattgccttcccaactgtattgtgtggcattatgttgagtcaacatcccaatattttaaacaacattgactctgtgaagaagagagaatctgctctatccctgcattacaaactgtttgaggggacacatgtcccagacattgtctcgacatcagggaaagctgctgcttcaggtgctgtgaccaaggatgctttgattgctgaactcaaggacacatgcaaggtgctggaggcaaccatcaaagccaccacagagaagaaaatggagctggaacgcctgatcaaaagactctcagaca

SEQ ID NO: 27255 - DNA, 243 bp, Glycine max
  Peptide Sequence Number=SeqID_118940
atgatgataaaaaaagatgatgacaaaggtgatgataaaaagctcaaagatcaatcagagaacaattcaagagttcaagataagaatcaagaagaattcaagactcaagaagaaagtttagagtcaagaatcaagattcaaggttcaagatctcaagaatcaagatcaagattcaagactcaagattcaagaatcaagagaaggcttaatcaagataagtatgaaaagttttctcaaaattga

SEQ ID NO: 27256 - DNA, 452 bp, Glycine max
  Peptide Sequence Number=SeqID_118941
cctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgcattgcgatggtccctgcggatgttgacgcagtgatttctgcccgctacctgacccatgtcaaaggtgaagaaattcaagaccaagcagacggattcccactgtccctgtctactatccagcgggcaaaccacagccaagtaggaacgggcttggcggaatcagcggggaaagaaggcgaccctggagcggactctagtccgactttgtga

SEQ ID NO: 27257 - DNA, 240 bp, Glycine max
  Peptide Sequence Number=SeqID_118942
atggcctcatggagggagcagttaatgcagtatgaagcagctccgatagagaagaaccggccacagaccacaggtcgactagaagtacgggcacattgcacaggaaaagaagagcagctcaatatcataaagaccctcaagatctacggaggggagggtgtcgagttctatcccaccgatccccgaagggccggcaccaggcacgttgcctcaacccaaacatcgcagtattgccaatag

SEQ ID NO: 27258 - DNA, 303 bp, Glycine max
  Peptide Sequence Number=SeqID_118943
atggcagtcgctaagctccattttgaggtttgcggtggcaccaccgcaaagttcgtcgacggtgttgacgacttggacctctgcagcagtggtgccttgggcgtagaggtagccctcaccgaagactttgtcgaagggggagacgatgacatagcgaaagttgggggattagaatctggttgcaaattccatgtaccagcaacccatacaacccttgagaggagaacccaaattcgtagaaccctcttccaagaggtatcaccttccactgcttcagaggtttccacaacttgcttagcttag

SEQ ID NO: 27259 - DNA, 711 bp, Glycine max
  Peptide Sequence Number=SeqID_118944
atgggtggtacatacagtgatctcgaggctgagcgttacaaatggtcaagtgaggaatttcctcaagagacagctctgaaatacactcctgtgagtgataaatcaaagtttagcattttccgtttgagcgtgagaccagaaaaggtgctactgagactggcagacactttgtgccatgatcatcccgtacgccttcacatggagctcactgctgaaagacacaacggatatttcaaccctcggttggtgagagtggttgtagagggggttaatactctttctgatctagatgttaacgccttaggggctcatacacatttcagctattcttgtgtaagcaggtcttgtaattatcatgtgtctaaagtgagcgatatgacttgggaggtttttcacacctatgagttaagtatgaaaacccttcttagattttatgtcaacattgaatgtcataaagtcacagggctttcggccatgtttagaggccctttcaaattcaaggttccggctttcgtcacggagagtatgatacaacgttctactccagtgattcagcgcgaggtaaatggagaacccccgaaagctatcaatgcatttcttgagagtgagtttacagggaaacaatatatcctcttccaacaagaaggaaaattagggaacagtagcaccacccaagtcgttctctgggcaaggagcgagagtcattgttaa

SEQ ID NO: 27260 - DNA, 504 bp, Glycine max
  Peptide Sequence Number=SeqID_118945
atgacttgtggtaaagttaaaagctgtatgggatatagggaaagagggagggaaggactgaaagagttattcatcgatgagcaggggatgtatacatggcagttctattattttgtgcattcaattaatgtggactcactgattcagtatgctgttagcttatttttcatgagtttctttgtgatattatctatggcaccaaagcagaagattagaatcaagcttaggtcttactgggtgcccttgatagaggattcctgcaagcagatattagatgctgcaaggactaccaacgcgaaaacaatgggacccgtgccattaccaaccaagaagcgaatctactgtgttcttaaatccccgcacgtacataaggatgcccggttccatttcgagatcagaactcaccagcgtctcattgatattctatatcctacagctcaaacaatagattctctgatgcaacttgatcttcctgctggtgttgatgtggaggtcaagctgtag

SEQ ID NO: 27261 - DNA, 165 bp, Glycine max
  Peptide Sequence Number=SeqID_118946
atggtgaagttacctaggaatgtgataactcactccctgtgtgttgttgtgtttgatcctgtgatgatcttgaacttgtgttcgggggagcagatgaataggtggatgactatgaagaacctcatgctagaggacacaggaacaccatgctctgataggatgtga

SEQ ID NO: 27262 - DNA, 318 bp, Glycine max
  Peptide Sequence Number=SeqID_118947
atgacctatgcagtccctgtagacagcaaaaagttcattaaaaacagaagcctcagtaacccacaagcattgatgaaagaaccaaatttggacacaacaatttcagatagtttctgtataaaaggctctacttcaaggaatttaacatacacgcagagttctggtttcaggagaaatgcagagagatgcaccaactctatggaatgtccttctgttaggaagcagtgggattctattgttccattcaagcacagtgaatattggaattggaaggttgagtgtattaattacatagaaagaaatcaaactaacaagtag

SEQ ID NO: 27263 - DNA, 537 bp, Glycine max
  Peptide Sequence Number=SeqID_118948
atgttcatgcacacctctcattccagtatgcttggggcgctacttgcaggatatatcactctgttacaggagcatttttcgtctgttgcttccgttgttcctggcgaggattacgacgagaggagaccgcgtgcatgtcgatggacctctggtaaggcattgtccgttttcacatattggaggcgtctggatagactgacccctaacacagtgtgctggattccgtacggtgaccaccgttcatttagagaatctgaggtcatctcattattttccagccatctcagatggggccccttgatggtcattcaccgaccagagagggtttacgacagttcgactacatctagactattccgccacactctgctgcgtcttcgctgtctattgcagaaattgatgatagatggatgcagtttggtgagtacattgcacctccaagggatccctcctagagtaccgccagttcagcaacatgaagaatttgttgaaccaaatatgtatcagcaaccgatagcggcagcggcaccttattaa

SEQ ID NO: 27264 - DNA, 348 bp, Glycine max
  Peptide Sequence Number=SeqID_118949
atggcaattgatatgcatcaagatttcatattgcttttttttttattttttttgattgagaggatatttggtatttttaaatcgcggttcacaatttttaagtcagcacctccatttctatttaaaacacaagcaaagcttgtgttggcatgtgcagcacttcataattttcttcgcaaagaatgtcgttctgatgaatttccagtggaacctactgacgagtcttcatcttcatcttcagtgttaccaaattacgaagacaatgatcatgaacccattgttcaaacacaagagcaggaacgagaagatgctaatatatggaggactaatataggttcagatatgtga

SEQ ID NO: 27265 - DNA, 2577 bp, Glycine max
  Peptide Sequence Number=SeqID_118950
atggcgacggtggagtggaactcgacggtgttgtatagtgcgccggtagtggcggcggttgtggaagtggtgtcactgcctgaggttgaatggatagttgtttcatcataccctgcatggtggaggcctctaatttctgaaaaataccttgaaggttatccatggtgggcttgctgtgtttgtgataaagaagggaggtttatggtagctcgaacatcctgccatcctggtccaaaccgtgtatctcagtcattgaaggagaggcaagtcgaattcttcaagctctgcaccaattttcatgcatggcttatctggtttccttcatctactgttgttagtggcgcttttagtgtcactggtttgtcacaagaaaagcttgtgacccttttggatttagtgctcaaagtggttgcttggggtgttggtggtgtttgcatgcacgatgagctcttcatttcaagggaaagaagattgccattcttcttcagaggttggtgtgtcctctacctctttgtttctggctattgctttatagtgaacattgttctctatgaaaagcatgctgctttgcctattcagtgcttaggttctgatgtttcctctgtttgtgtgggtttattcttctgttacttgggtttttttgtaaaatttgagggtggagtgagaaatagtactcttcaagaatctcttttgaatggtgattcaaatgataatgatgtgtttgggactaatgaaaccaaggggggtgacactgttaccccttactcttatgctggaattttcagcattcttaccttctcttgggttagtcctctgattgctggtggcaagaagaagagtttggaccttgaggatgtcccccaacttgacaaaagagacagtttaattggagcatttccaatttttagtgataagcttgaggcatattgtggagcaactaacacattaaccacacttaagttagtgaagtcattagtattctcaacctggaaagagattattttcacagctatccttgcactggtaaacacattggcgacttttgtcggtccctatctcattgattgttttgttcaataccttaatggaaaacgacaatttgaaaaagagggccttgttttggtgtctgcattttgtgtggcaaagcttgtggagtgcctgacaaagaggcactggttctttaggttgcagcaggttggaatacgaatgcaagcactgcttgtgacaatcatatataataaagctttgaacctatcatgccaatcaaagcaaggacagaccacaggggaaataatcaacttcatgagtgttgatgcagaaagagttggtgagttcagttggcacctacatgatctgtggttagtagtcctacaggttttagtaggcttgttggttttatataaaaatcttgggcttgcttcaattgctggttttgttgcaattctcattgtaatgtgggcaaacattcccttgggttcaacccaagagaagtttcacaacaagttgatggagtcaagagatgaaagaatgaaagcgacatctgagattttgaggaacatgaggattctcaaactgcaaggatgggaaatgaagtttttgtctaagataactgaactcagaaagatcgaacaaggctgtttaaaaaaagttatatacactttagtcttgatcatatctatattttggtgtgccccagcatttgtatcagtggttacttttggtacttgtatggtcattgggatcacccttgaatcagggaagatcttgtctacacttgcaacattccagattctccaagaacccatttataatcttccagagacaatttcaatgatggcacaaactaaggtttctcttgacaggattgcatctttccttcgtctcgatgagatgctatctgatgttgtgaagaagcttccgccgggtagttctgatatagcaattgaagtggttgatgggaatttctcttgggattcattttcccctaatataacattgcaaaacataaatctaagagtttttcatggcatgagggttgcagtttgtggtactgttggatcaggcaagtctactttactttcttgtatattgggagaagtaccaaagaaatcagggatcctaaaggtgtgtggaacaaaggcctatgtagctcagtcaccatggatacaaagtagcaccatagaggataatatattgtttggcaaggatatggaaagggaaaggtatgagaaggtccttgaagcttgttgcctaaagaaggatctagatattttatcatttggagatcagactattataggagagagggggataaatttgagtggtggacagaagcaaagaatacaaattgctcgtgctctataccatgatgctgatatatatctatttgatgatgtgtttagtgctgtggatgctcatacaggatctcatctttttaagaatgctccaaccatgtgggatcgacacagacttaaaggagcactcaaaccaggtgtatttacccctaaggcctacactccaaagagtctgttagggcctctccctcttgattcaggttcaacccaaaaaacattttag

SEQ ID NO: 27266 - DNA, 1381 bp, Glycine max
  Peptide Sequence Number=SeqID_118951
gattggatttgtgatacaagaggatgtgctttacccacaattaactgttgaagaaactttagtcttttccgcactcttgaggctgccaacccatatgagcaagcagcaaaaatatgcaaaagtggataccactatcaaggagctagaccttgaaagatgtcgccacacaaaaatagttggaggatatctcaaaggcatatcaggaggagaaaggaagagaacctgcataggctatgaaattctagttgatcattcactgttgctacttgatgaaccaacttctggccttgattcaaccgcagcaaacaaactccttctcacacttctaggacttgctgaggctagaaggactataattacgacaatacatcagccatccagcagaatctttcacatttttgacaaacttctaatatcagaaggctatcctgtttgctatggaaaggctaaggacacaatggagtacttttcatccttgagattcaccccacaaattccaatgaatcctgcagagttcttgcttgacttggcaactggacaagtgaatgacatacgtgttccaacagatatcttgcaagatcaagaatcttctgacccttcaaaagttgttattgaatatctacaactcaaatacaaaactctactggagccaaaagaaaaagaagagaaccatagaggagcaaacacaccaaaacattttcaactagccattcaggttaagaaggagtggacattgagttggttggaccaatttgtgattctttccaggagaacattcaaaataagatgcaaggactattttgataagctaagactagttcaagcacttggtattgcacttttgttagggctcctttggtggaaatcttcaaccaacactgaagctcagcttagagatcaggttattgccatgctattacttttctcacgttacaagattgatcttctaatcactatctttattgcaggaaaagctgacatgtatagactaagtgtatactatgcatgtagcactctgtgtgacatggtggcacatgttttatatcctacttttttcatggtcatcttgtacttcatggctggctttaagaggactgttgctagcttcttcttgacactattcactattctgttaattgtcataacaagtcaaggagcaggagaactatttggagctgcaatcatgagtgttcaaagagcaggaacggctccttctttgatactactgttattccttctcacaggtggctacaatgtccaggaccctgcagagttcacttacatttggcattgtaaacttgaaaggtggaaaaaaacaagtgtggattcttctggccatggccttagtctttcggttgttagcttacttgtgccttcgtag

SEQ ID NO: 27267 - DNA, 552 bp, Glycine max
  Peptide Sequence Number=SeqID_118952
atggaggatgcaaatctcaactatgctgagtccaacagagtctccatattaacagtggacaaattttcaagaaggatggttcttcagtttctgggatttaatcacgtgatatgttatgcttctcctgctttggctgcacctattatgccagacattaaggaacctgaagaccagaagcacatgatggagatttggttaaattcaattgtgtatgctggcgtggaaatggatactttgttttcaggaaagagaagagcactgatcccaccttcagtaggatatgtaaatgagaatttgcaaccaatgcctgaagagtcacgcaagcagcaaggatcgcaattgcattttgtgggaatcggcggcgagaaaatgcagggttggttctcggggcagagtagcgaggaggaggcgaagccggcgtcgtcgttgctcgccgattggaactcctacgcatccgcccaaacctctgaagattcatccactttccccttcgatatcgaatccgccgttaggtctgccaacgacaccgtttccggcactttcagcgtgtaa

SEQ ID NO: 27268 - DNA, 681 bp, Glycine max
  Peptide Sequence Number=SeqID_118953
atggcttcatttccttcaaattctgcattggaacatagcatggccagtgcacaacaaaacagtaaccctcatgcttcctcaccttctttcatgactagagtggccatgagaatatctagatcaagatggttcactttcttgagaagagtattccattaccaaaacggaccaagatccaatctcggctccaaccctttcaattccagcacttggatgatgctggagttgattgctttgttggtccaaatagcaagcacaacattcactttggccatttcgaagagtgagaagccaatttggcctatgagagtgtggatagcaggttatgatattggttgtgtccttaatcttctgctactttgtggccgctaccatcaacttcatgtgactcaagggaataatgctcttagcctctctgaattggagcagcagagaaacaatgaagaatcaaggacttcacatttgatagacaaatgccgtagttcactagagcttttctttgccatatggttcgtgatgggcaatgtatgggcctttgactcacgttttggatccttcccacaagccccaaaactccaagggcatctgatgatcaaatctcacaactcccaagttggagatataaagggcttcattccaacttggacattgccaatgactctcaaagcagtgaaagattga

SEQ ID NO: 27269 - DNA, 96 bp, Glycine max
  Peptide Sequence Number=SeqID_118954
atgggaatatggacgaacaaacagaggagtgaaagaaaaatgacaggagggaaacggaagccagagtcagtccctcccaccggcctcaacgactag

SEQ ID NO: 27270 - DNA, 1512 bp, Glycine max
  Peptide Sequence Number=SeqID_118955
atgaacaaaagaaccacgttgcttattcgaaccctcttgttcctcttcgtacttaactccctctatctctctctctacttcacccacaaaccctcttcttcttcagaagaagaacaagaaaaatctgaacttgaaccagacacatatctcacaccattttcacacgaacctcacttttcaaagccatggccaattgtcccctcccacatcccctggactaccacttctgcgcgatcccactcctgcgaggcctactttgggaacggcttcactcgccgccgcgacgtcctccttccccgcggcggcgcggggtggttccggtgccaccacagtgacacgctccggaactcggtgtgcgagggcgggagactccgcatggcgccggagaagatcacgatggcgaagggtggcgaggatttggcggcggttatggggcgcacggaggacgaggagatgcccgtgtttcaaaacggtgcgtttcaggttgacggcggtgaagtcgtcgttgaccgggagcttctggttgaccaagagtttttggatgagtatgtgccgaggggagggatcgataggcacaccatgcgggagttgattgccaagatacggatcgtgagagggaaggattttcaatgtgatgagtggattgaggaaccaacacttctggtgacacgttttgagtatgctaatctttttcacactgttacagactggtacagtgcttatgtttcttctagagtcactggtctgcccaatcgacctcatgtggtctttgttgacggccactgtaaggctcctcttgaagagacatggaaagccttgttctcaagcgtcagatatgctaaaagcttcagtggttcagtttgttttcgtcatgctattctctcacctttgggatatgaaacggcaatgtttagaggactttcagaacatatagattgtcatggagctcctgcacaagaactactgcaaaagcctgatgaccaaaaaactgcacgcctttctgagtttggagaaatggtcagagcagcattcgggctacctctaaacatacaccgcgatggaaaatcactcgctggacataatgtcctctttgttcgtcgtgaagattatttagctcatccacgtcacagtggaaaacttgaatcgcgactaagtaacgagcaagaagtcttcgactccttgaagagctggacatttaattataaagggtgtaaaattaaccttgtcaacggattgtttgcgcacatgtctatgaaggatcaggtacaagctgttcatgatgcatcggtcatcatcggtgcccatggtgccggtcttactcatatagtgtctgcattgcctaaaactgtgattctggagatcattagcagctattacagacgaccacattttgcatatatttcacggtggagagggttagagtaccatgcaatcaaccttgccggatcacatgctgatcctggaactgtgatcaaagaactggcgaacataatgaaaagccttggatgttga

SEQ ID NO: 27271 - DNA, 4566 bp, Glycine max
  Peptide Sequence Number=SeqID_118956
atgtggaagccacgcgctgtcccccgcgcgttctctctgcttcatcttctttttcattcagtgctggttctggtctctgcacaaggatctaacagaaccacttggaacactcttaccggaagtgagaattttggagtgggagcagagaatcaacttgttgaagttggtgtggataagttactatcagaatttggaagtccaccattggtcatagcacgtggtgggttttcagggatatttcctgattccagtgaatttgcctataatttagcagcagtaaccagtttgaaaaatctcattgtatggtgtgatgtgcaattaaccaaagacggggaggggatctgcatcccaaacatcaagcttgaaaatgctactaacattgataatgtttttcaaaatagaagtaagacttactcagttaatggtgtacaaaccagtgcctattttgctgtggatttcacctttgaggagctgtattccaagggagatttcactcggtcggacaagtttgataacaatttatttcaaatacttactgtgaatgacttggttaaaaatgaagccccgccaggattgtggttgaatattcagcatgacgcattctatgaacaacacaatttgagtatgaaaaactttgtactttctgtttctagaacagttaatgtcaattatatctcatcacctgaagctggtttcctgagaactataagagcacgcatcaacccaagaataacaaaactggtcttcaggtttctggaaaaggatgaagtagatccatcaaccaatcagacttatggttcactgttaaaaaatctagcatctatcaagacatttgcttcaggaattcttgttcccaaaggatacatatggcctattgatccatcaagtctttatctactaccacatacatctttggtctccgatgcacacaaagtggggttggaagtctttgcttcagattttctgaatgatgttccaatcagctataattacagttatgaccctgttgctgagtacctcaatttcattgacaatggaaacttctcggttgatggtgtgttgtctgacttccccctaacaccatctgaagctatagactgctttgctcacgtaggcctcaatgcaacaaagaaagttaacaccttggtcatttcaaaatatggagcaagtggagattatcctccatgtactgacttggcatatgaaaaggctatttcagatggtgttgatgttcttgactgtcctgttcaaatgtcaaagggtggaataccattttgcttaagctctattgaccttatagagagcacaaatgttgctcaatcaaatttcagcaaacttggaaaaattatcccagagataaaatctggcaatggaatatttacattcgacttggcatgggatgatataaaaaccttgaccccctcaatgttgaacccatattctataaactctttgtataggaacccaaaatataacaagaaggggcattttttaacattgtcagatttcttgaacttgccaaaaggtcagacttccctgttaggtgttgtgatcaccattgagaatgcagcctatcttgcaaggaaacaaaatttaagtgtgactgaagcagtgattgatactttgagcaaagcaggttatgacaaaccaggggctccaaaagttatgattcaatccactaatagttctgtactactgaaattcaaggagaaaaccaagtatgagcttgtctacaagattgatgagatagttggtgatgctgttgattcagctattttggatataaaaagatttgctcattctgtggttgtcaagaaggcctctgtatatcctgttagtaaattcttcgtgactggctctacaaagattgtgccaaagttcaaatcttctaatctctctgtttacgtagaaacattcagaaatgagtttgtatctcaggcttgggatttcatgtcagatgcaactgtggagattaacacatttgttcaagatgctgaaattgatggtgttatcacagacttcccgaaaacagctaatagatacagaaggaacagatgcttaagtttgggtgacagcaaacctccttacatggaaccagttcgagtaggtagccttttattagccatggacaaatattccttgccaccagctttggctcctgcccctcccctgacagaagctaaagtgacagaaccccctctgcctcctctttctaaaacagccccatctagccctattgctgggactggacaaggagcacaaccaccgcaaaatgcgcaatctaagagtgagtggggaagtgagaattttggagctggagcagggaatcaacttgttgaagttggtgtcggtgagttgttatccgatattggaagtccaccattggtcatagcacgtggtgggtcgtcagggatatttcctgattccagtgaatatgcctacgaattggcagcacaaattagtttaaaaaatctcattgtgtggtgtgatgtgcaattaacgaaagatggggaggggatctgcatctcaaacatcaagcttgaaaatgctactgacattgataaaatttttgaaaatagaagtaagacatactcagttaatggtgtacaaaccagtgcctattttgctgttgactacaccttaacagagctgcgttccaatgtcttattgattcagggagatttcgctcgaaatccaaattttgatgacaattttgaaattcttactgtgaatgaaatgatcacaataacacccgcatctggaccgtggttgaatattcagtatgatgcattctacgctcaacacaatttgagtatgaaaaactttgtactttctgtttctagaacagtaaatgtcagttatatctcatcacctgaagctggtttcctgagaagtataaaagcacacatcaacccaagaataacaaaagtggtcttcaggtttctggaaaaagatgaagtagatccatcaaccaaccggacttatggttcactgttaaaaaacctagcatctatcaagacatttgcttcaggaatacttgttcccaaaggatacatatggcctgtagatccaacaggtctttatctactaccacatacatctttggtctctgatgcacacaaagtgggacttgaagtctttgcttcagatattctgaacgatattccaataagctataattacagttatgaccctgttgctgagtacctcaatttcattgacaatggaaacttctctgttgatggtgtgttgtctgacttccccctaacgccatctgaagctatagcgagtggagattatcctccttgtactgacttggcatatgaaaaagctatttcagatggtgtggatgttcttgactgtcctgttcaaatgtcaaaggatggaataccattttgcttaagctctattgatcttatagagagcacagatgttgctctatcaagtttcagcaaacttggcaaaattatcccagagatcaaatctggcaatggaatatttacatttgacttggcttgggatgatataaaaagcttggccccctcaatgttgaacccgtattctacaagctctttgtataggaacccaaaatctaacaagaaggggcaatttttaacattgttagatttcttgaacttgacaaaagctcagacttccctattaggtgttgtgatcatcattgagaatgcagcctatcttgcaaggaaacaaaatttaagtgtgactgaagcagtgattgatactttgagcaaagcaggttatgacaaaccaggggctccaaaagttatgattcaatccactaatagttctgtactactgaaattcaaggagaaaaccaagtacgagcttgtctacaagattgatgagataattcgtgatgctgttgattcagctatttcggatatcaaaagatttgctcattctgtggttgtcaagaaggcctctgtatatcctgatcgtaaacagtttgtgactggctctacaaagattgtgccaaagttcaaatcttctaatctcactgtttatgtagaaacattcagcaatgagtttgtatctcaggcatgggatttcatgtcagatgcaactgtggagatcaacacatttgttaaggatgccggaatagatggtgtcatcacagacttcccaaaaacagctaatagatacagaataaagttggttttcccttcatgtccaattcagaactacaatggagtcttactctcacatctgattactgatatgattgttactcatcctaccgcagggaacagatgcttaaatttgggtgacagaaaacctccttacatgaaaccagttcaactgcccggccttttgtcaaaaatagacaatttttcgttgccaccggcattggctcctgtccctcccctgactgaagctgaggtgacagaaccaccattgcctcctctttctaaaatagccccatctagccctattgctgggactgaaccaggagcacaaccgccgcgaaatgcacaggctaaggtcaccgtcgtcttccttttgtccactctgactactgtgcttgtaggttctcttctgctttga

SEQ ID NO: 27272 - DNA, 819 bp, Glycine max
  Peptide Sequence Number=SeqID_118957
atggggggtggaaatcaagaggcagtgaagcagctgcagaccctgatggaaaatgtggatgatgagcagctgaagaacacattccagaagcctatccccatggatttgtacagagccatacgggattctcaactcataggaatgtctggttactcaaaggagggtctacctgtcattgctgttggtgttggtctcagtacatatgataaagcatctccaacagctacaaggaaacatggacgatacattggcacctgtgtgaaagtcttggatatgactggtttaaaattttcagcattgaatcaactgaggttgttgactgctatatctacaatagatgacttgaactatccggaaaagacagacacatactatattgttaatgtgccatatgtattctcagcgtgctggaaggttgtgaagcctcttttgcaagaaagaacaaggagaaaaatccaggtgctgcaaggttgtgggaaggaggaattactgaaggtaatggactatgcatccctcccacacttctgcagaaaagaagattccaagtcttccaaacatcatgcattaggaaacattggaaattgtttctccttcaatcacgccttccatcaacaactctacaatcacatcaagcaacaatccatcattgtggagtcaatttcaccaatcagacaagggtccttctatgtagacataccagagccagaccctgatgatgccaaaatagccaagaccatagaaactgagttccacaaattggagaatcagaagaatggctttaccaactcactaaatggtcttagagttaatggccattga

SEQ ID NO: 27273 - DNA, 1254 bp, Glycine max
  Peptide Sequence Number=SeqID_118958
atggctatgttgatggtggggtcagcggctggagtggtggtcggagaagtggcggcggcggccgaaaaagaaaagtcggaaagtagagaaaaaaggtcgcagaaactgggggcaaggagaaaaggggcagctataagaagggtccactggaatgtggaaaaagctttggctaacaagtttatagataaacctctcacgtttagaccgaagctcctgattctcacagtaccaccagaaacggagaggctagatgaaaaacggtcgccttatgatcttgtctgggacgataagagttttctattgggaaagtcattttatctactgggatcagttgatgcaaacgacaggcagatagagcagtggaatgtaaagccacccccactctacctttggagtcgtcctgattggactgataagcacaaggtcatagctcaggagcatggtcactttatcagccagcgggagctgtcaagaatcaaaagctttgataaagaaaaatcaccggccagtcatactatggatgatagttatggttttgatatcatgccaggtcacaatatcttgaattcaactgatgcacctaaggatgagggccagacaggatgctcaccacatggaaatgttgatcgagagagtcaagagagactggaatatagggtgagaaaggctgataagacctcatggaagaggaaacgaactgaggaaaacgatggaagattagattatgaccttggtgataaaagttataggcatatggagcccacctcttcctcacgtatgggggagattagagcagcctatagcaggacccaaaactggcccagttttgccaatcccctttatgattctgggattacagatgtaggcgaacaccgtagcagccttccgagagacactgcccatagcttcaaatatagaccctatgccaaggaggatgagaactatcttaaggaattagacactaggcaacagactcgccattatggtattcagaatcctaattctgtgacaagcaactatctatctggtagccatcatcacatggggccaagttatccagcctgtggtttggcatctgagtctccttatgtgatgaatacaccagccatgcagcgatatgcacctcgcccggacgaattaaaccatgcaaggatggatcctttgggtgccgccccacctggatatgggagtaggatgccaggttttgcagctggttctcaccatgtgtcttcacgccagaattccgcagactga

SEQ ID NO: 27274 - DNA, 735 bp, Glycine max
  Peptide Sequence Number=SeqID_118959
atggattggagtttaaaactactgctgctaatatcaagtgatgccatacttctttgcagaatggatgaagcactatgttcatatattgaaaaggatcgaccatttttgggcatttgtcttggacttcaactgctttttgaatccagcgaggagaatggaccaggttttcttataattaactctggtggaaatagtgctcaatgtacatcatcctcaatcaaaggtcttggcttaatacctggaactgttgggagatttgactcatcaaatggttttagagtaccccatattggctggaatgctttacaaatcacgaaggacttgggaattttggatgatgttggaaattatcatgtctattttgtgcactcttatcgtgccatgccttcagatgacaacaatgagtggatatcctctacctgtgactacggtgacaaatttatagcatctattagaagaggaaatgtgcatgcagttcaattccacccagagaagagtggaggcaaacagaagcctggggaaggcaaagcttcaaaacttgcaaaaagggtaagaaatcttagcaagccagttgatattgctggacagtactataaagaaggagctgatgaagtcagctttctaaacattaccggatttcgcgacttccctcttggtgatttaccaatgctgcagattatatttgatccactatctgccgtggtttcaatgtttcatgctcccaatgcttcatag

SEQ ID NO: 27275 - DNA, 777 bp, Glycine max
  Peptide Sequence Number=SeqID_118960
atgtctcacaaagaaaaaaagaatgtcattgagttccttgatgaacaagctttctattatgacaaggaagatgagcagtggtttaaggaaaaagatgatcagtgggcaaagaacataccatgctacaaagaagacgcagtcttgaattcagtccacttcgattttgacatgcaagatttagatgagttcttgatggttcttggcactgaagattcttcccctgagagagttcctgatcctattattcctgttactcctcctatttctggacgggttcaggttccttcccctccgagagttcatgctcctgcacctcagagggtttatacttttgccaatttggtttctgctacatctgcccctacagctcgggttccagcaccacacgagtcaccggaggagacattcaatggcattgcatctggtcagaaatttgttccatcaaaaaatccatttcaagttgcaagtcatgctcaaaaatacttcaaacccaagaataacccaaagaaagagaggaaaaggaaaagcattcatgacataaccttagaggacattaacacgattgttactccccgcattgatcaacataattgggttcctcctcctccaaattttgcagcgcaaccacatgaaatacgacatgcacaacccatgcagcagttcaaccaacataatccgtttcatcaaatgcagcagtttcagcacattatgcctagtcaaatgaacatatatggatattctaataattggcctcacgacagtgaacacgccaattga

SEQ ID NO: 27276 - DNA, 1497 bp, Glycine max
  Peptide Sequence Number=SeqID_118961
atggcgatgcttcccctcacaaaccctactccaattcgccacaatgcattgtcttcctcctctttcgttcaaagaaaatgtgtctctctgatccctagaatcagaacatgcgactccgaaccccagcgacgtcgttttgcgtccgtgacatgctgctccttctcgacactcgacagtgctaagattaaggttgtcggagttgggggcggcgggaacaatgctgttaaccgcatgattggttgcggattgcacggtgtagaattttatgctataaatactgatgcccaagcactgttgcattcttctgctgagaaccctatcaaaattggagagcttctgactcgtggattaggtactggagggaatccgcttttgggggaacaagctgctgaggaatcaaaagaagctattgctaatgctcttcaaggctcggatttagtgtttgtaactgctggcatgggtgggggaactgggtctggtgctgcccccgtagtggcccgaatagcgaaagaagcaggttacttgactgcattggaagccattgaaaagctgcagaaaaatgtggatacacttatagtgattccaaatgaccgcctgcttgacatggctgatgagcagacacctcttcaagatgctttccgtctagcagatgacgttctacgacaaggagtacagggaatatcagacatcataacaatacccgggcttgtaaatgtggattttgctgatgtaaaagctgtgatgaaagactctggaactgctatgcttggtgtgggtgtttcctccagtaaaaaccgtgcagaagaagctgcagaacaggccactttggctcctttaattggctcatctattcagtcagctactggggtagtgtataacattactggaggaaaagacataactctacaggaagtgaacagagtgtctcaggttgtgactagtttagccgacccttctgccaatattatatttggcgccgttgttgacgatcgctacaatggggagattcatgtgactatcattgcaactggcttctcacagtccttccagaagatactactaacagatcctagggcagcaaagttgcttgacagagagcctgggggccaagaaagcaaggctgcatctcctcctctcaagtcctcaaactatccttcaacggatggtgagggaataagggaaaggattgggggtgtaggagagcgaggagggtatagggggacaatttacatttctggaggtgaaaatagcactttagaggaattcgttttctctgatcgggatctggaagggaagcgaatcgacatgggtttcttggtgacgacgctgatcttcgtagtgatcggaatcatcgcgtgcctctgcaccagaatttgctgcaacagaggaccttctgccaatctgtacgctccttccgattctctttcgttttttcctattttgtgttctcaatgtatcgattttgatgccctagctatgagagtggtgcgcgtgtga

SEQ ID NO: 27277 - DNA, 675 bp, Glycine max
  Peptide Sequence Number=SeqID_118962
atggttctgattattcaacatgaattcaaatatgaattaagagtgccagaatctgttttggacaagaggtcaagtgcacacaacaagggcagggtgtttatccatggtgctagtgagatcactgcaaatgcttacaaaaaacaattccaaacagacctagcaaccttcttgagctcaagggctgtggaattgaagagaggggggtccatgttcttggtttgcttaggcagaacttctgtggaccccacagaccagggtggggctggcctcctctttgggacccactttcaggatgcttgggatgatcttgtccaagagggattaattagcggtgagaaaagagacagtttcaacattccagtgtatgcaccaagcctgcaagacttcagggaggtggttgaagccgatggttcatttgccataaacaagcttgaggttttcaaaggtggaagtcctcttgtagtgaaccagccagatgatgatggtgaagttgggagggcccttgcgaacagctgcaggagtgtttctggtgtccttgttgatgctcacattggtgacaagcttagtgaagaactgtttatgagagtggaacgtagagccacaagccatggcaaagagttattagagcaactacagttctttcacatagttgcatccctttcttttgctctatga

SEQ ID NO: 27278 - DNA, 327 bp, Glycine max
  Peptide Sequence Number=SeqID_118963
atggcggtgacaaattctgaaaatcgtcttcttgatgaaaacacctgtggttcattgttagaaaagttgcaggaaatattggatggggcttctaagtcaagggcactgctacttcaatccttgtcagatgctaagcttgagctctctagtcttttattggctcttggtgaaaacagcttcatgggaatgctctctagtcttttattggctcttggtgaaaacagcttcatgggaatgaaccctaacagagcaaccagaggaggagctctagaaagcaccagagacgccaccattgctaacagagaacatttaagtgactacctcgag

SEQ ID NO: 27279 - DNA, 297 bp, Glycine max
  Peptide Sequence Number=SeqID_118964
atgtccacccaagaatggggtgtattggggtggaagaaagaaaagattgctgtgctagaagaacagaaaaagatgaatgttgtgaaggctgaacatgaacccacaattgaggctgaccaattggcatttagacagacaaatgtgactcacgagatgcaggggaaactaaacatgaatgaaatgttggaggaaaccaaggattcaaacattggtaatttggatcttggttcagacttccaaagcaacaccggtgaaaacagccacgacagtgattctcaattggaaaatagtatctag

SEQ ID NO: 27280 - DNA, 1029 bp, Glycine max
  Peptide Sequence Number=SeqID_118965
atgaacctagacaatgaaagggtaaagtatattcagtccaggctctctaagaatttgggtcgagaaaatactgtgaaggatttggattcaactaccctacccgccgagtctggtagccttattgggtctgcaaactatgttgttgttgttggtcttggtacaccaaagagggacttgtcacttgtttttgacacaggtagtgatcttacatggactcagtgtgaaccctgtgctggttcttgctacaagcagcaagatgcaatctttgatccatcaaagtcttcatcgtataccaatatcacatgcacatcttccctctgcactcaactcacttctgatggaattaagtcagaatgctcctcatccacagatgcatcatgcatatatgacgccaaatacggtgacaattccacctccgtcggcttcttgagtcaggagcgccttaccatcaccgccaccgacatcgtcgacgacttcctgttcggctgcggccaagacaatgagggcctcttcaatggctccgccggcctcatgggcctcggccgccaccccatttccattgtccaacaaacctcctcaaattacaacaaaattttctcctactgtctccccgccacctccagctcccttggccacctcaccttcggcgcttccgccgccaccaatgctagtctcatatacactccgttgtccacaatctccggcgacaactccttctacggtctcgacatcgtcagcatctccgttggcggcaccaagctccctgctgtctcctcctccaccttctccgccggtggctccatcatcgactccggcaccgtgatcacgcggctggccccgaccgtgtacgccgcgctccggtcggcatttcggagggttgaaagtgagcaacaagtgtgtttggcttttgctgcaaatgggagtgacaatgatattacggtatttgggaatgtgcaacaaaaaacactagaggtcgtgtatgatgttaagggtgggaggatagggtttggtgctgctgggtgtaagtga

SEQ ID NO: 27281 - DNA, 915 bp, Glycine max
  Peptide Sequence Number=SeqID_118966
atgcagaggtcagtgaagatcctttcggtgtttgtggggccatgttttgtggccgagtgtgcatacaagatatggtggtacgcatccggagcctcacagatccccttcttaggaaacgtgtacgtgagcgatgcggtggcgtgcatactggaactgtggtcctggctgtaccgaaccacggtgatcttcctagtgtgcgttctgttccgtttgatctgccacctccagatcctgcggctgcgcgacttcgcgagattcttccacgtggactccgatgtggcgtcggtgatgacggagcaccttaggattaggaggcacctgcgaatcataagccacaggttccgcgcgttcatcctactcgcgcttttattggtcaccggaagccagctggcgtgcttgcttgttacaactaaacatacgcaagatatgaatatttacaaaaccggtgaacttgcgctgtgctcagttacactcctttctgcgttgtgcatcttgttgcgtagtgcgacgaagataacacacaaagcacaagcgatcacggggcttgctgccaagtggcacgtttgcgcgacgttggattcttttgatggagttgtaacggaaggtgagacaccaatggctcctcaaagttcccatgaaacagtgtttcctaatgtgggaacggatggggaatcagagactgatgaagctggtgatgaagaagatgaaattgacactaccaagttaatcccatcctatgcttatagcaccatctcatatcaaaagcgacaagctcttgtaaattactttgagaataacagggcagggattacagtatatggattcatgttggataggagcacactccacacaatatttggcattgaaatgtcgcttgttctttggctgcttgggaaaaccataggcttctcttga

SEQ ID NO: 27282 - DNA, 1572 bp, Glycine max
  Peptide Sequence Number=SeqID_118967
atgggtagcgaagaagagagggttcttgagaaccaactggaacttcaattgcaagaacaaagggattctctctctgctatcgatcaagctctcctctctgatccaaccgaccctgaacttctcgcgttgaatctagcaaatggggctagtctctcacgaagtagagaaccaaggtctgaatccctattaggagatgttcatgaggagcttgttcaggcaattaaggatgcagaagaaggacttcttcacctaaaacgtgcacgattgttacaggaagcagattcagtgctgcataacactaatatttttactgaagagaaagtggatccccttgatcccacttatgttgaaccagagccattggaggacaagtgttattctgttggatctaaatgtagattccgtcacaaagatgggcgttggtacaatggtcaagtggtgcagttggataattcagtggcaaaagtttcatttcttactcctacttctgagaatatgttggtatcctttgtatacccacaagcttattttccaatatatgtgatggctgatttacacaatctgcttcttggacttgatgttcaattgtctgctcttaagaaatatgtgcctacaatctggaagcagtctcttgtggggtcaagtatatgggcagtctcaactgcaaatgcaggcacttggagagaagccgagctcaagtcctgggacgaaaaggctggagttggacaagttgttttccgagacgacggaagttctgtgaaacttggggcagaagaaatggcactgtctgagcatgcagaaatgagtgacatagagagtgattccagcttagatcaatccgattccagtgactatgaggaggaggaggaatcgcaaggcataggatttctggagagtaccaatctacagagaggtattcaaactgaaactgcgacatttgccacgtgggagaaccacactagaggcatagcttccaaaatgatggctaatatggggtacagagaaggaatgggtttaggtgtaaccggtcagggaatgctggaccctatagcagtgaaggtgctaccaccaaagcagtccttagatcatgcactcgagtctcataaaagggaagagaacaaagagaagcaaggcaagaagaaacagagccgaggtggcaagagaaaacgtgagaagaaatttgcagaagcaaaccgtgcagcaaaagaggaagaagaatcggcatcagatgtctttgcattaataaacaatcacctggcaatgcacaatgaggcttttggcggtggattgatgaagaagcagcaaagtaaaggttctgaggaaggtaagaaggtggatagacgagcattggttgcttatgaggaagaggtgaaggatttgaagattagggttgaaaagctcgagcacattgtcaatgccaatagaaaagagaaggctgtgtatgagggtgctatgagaaaattaaatgaaacccgcaaggctttggcagatgctgaagcagttcatgcctctgcctcaaattcagtaacaagcaaagaaaaagagaagagatggctcaagttaagaggttga

SEQ ID NO: 27283 - DNA, 2022 bp, Glycine max
  Peptide Sequence Number=SeqID_118968
atggtagcaaaaatccggcaaagtgctaccgagtctcctaatccaaaacccgaggttggagagattgacaccagccctccttttcagtctgttaaagatgcagtctctctatttggtgaaggtgctttctctgatgaaaaacctatctttaagaaggcaaaaccttattctgctgaggcccaaaccgaaccagtcaaacccgttgagttttgggttgggtcacgggttttaatatctgaatctgcggatccggagacacaacttcatgtagcccaaaaagagctgaacaagttaagggaacaagtaaagaatgctgaaactaccaaggctcaagctcttgtggagcttgaaagggctaaaagaacagttgaggatctgacacaaaagataaaagttatcagtgattctagggagatagcaatcgaggcaacagcagctgcaaagtgtcaggcaaaacaacttacagaagaaaagtatggtgtccctggcggaacaaatggtgcttggaaggaagagttagaatctgctgttaaaaggtatgcatctgtcatgacagaacttgatgctgcaaagcaagcactgagcaagactcggcaagagtatgattcatccttggatgaaaaaatgtttgctttcaagcaagcagcagaagctggagatgcattgaaggaaaacacagaaagagcatctgagctttctaaagaaatttcagctgtaaaggagtcagttgagcaagcaaagcttgcttctattgtagcacaacaacagcaaacaatgattttagctgagaaagatgttctaagacaatcatataaagctaccttgggacaatctgaaaagaaattgcttgctttaaagaaggaattcagtcccgagcttgccaagaatcttgaaatgcagctggcagagacaatgaatgaaattgggactctgcaaaaggaaatggaaaataaaaggacatcggacttggactccgtgaaaagtgtcactttggagctagacgatgctaaggagtctttgcagaaagtagcagatgaggaaagctctcttagaagcttggtggaatctcttaagggggaactggagaatttaaaaagagaacattctgaattgaaggagaaagaatctgagactgaatccattgttgggaatctgcatgtcaagctccgcaaaagcaagtctgagcttgaagcctgcatggcaagagaatctaaagttagaggtgcatccgaggaaatgatcttgacacttagccagctgacatctgaaactgaaaatgcaaggcgagaagcagaagatatgaagaacaggacagcagaattgaagaaggaagctgaagttaccatgcttgcatttgaagaagcagagaaaaagcttaaagtggcactggaagaagcagaagcagcaaaagcagctgagaaaaatgctcttgaccatattacagttttaactgaaaggactactgctgcacgtgcatcaacatctgaatctggtgctgtgattacgatctcaaaggaggagtttgactcactaagccataaagttgaggagtcagataaattagcagatatgaaagtggctgctgccaaggcacaggttgaagctgtgaaggctagtgaaaatgaggctctcaaaaggttggagacaacacaaaaggagattgaggatatgaagactgcaacacaggaggctttgaaaaaggctgaaatggctgaagcagcgaaaagggcagtggagagtgagcttcgaagatggcgcgagagggagcagaaaaaagctgccgaagctgcgtctcgaattctggctgaaacacaggtgtcaacagaatcatctcctcagcactacaggattcaaaagcagaatcctcctcgtacaacggtggaggtgaaaaggtttgaaaaggagaaggtttcagtttcaaagaaagccctcttgcctaatattagtggcatcttccaaaggaaaaagaaccaggttgagggtggttctccttcttatctgcctggtgagaaccctgtatga

SEQ ID NO: 27284 - DNA, 450 bp, Glycine max
  Peptide Sequence Number=SeqID_118969
atggaaaaacaaatgtttccaacaaagtttcttctagttcttaccaccatatggtttgcactatccaattttgcctttaaagcttcagcagatgatgtcactcaaaccccaataacatgtctgaattgttccaaatgtgaatacccttgtcaacaacaaccctcacccccacttccttatgttgctccaccaccaccacaatcccctacaccttatggttactctatatatggagcaccaccaccaccaaaagagaaagagaaagaccctagcaagtgccctcctgctgcaggtgttcagtgctgcacccctccagatccttatgttttttctcctccaaatccttacactcctgtgccctatggtgaaggccaacgctcggcttcaatgcttcttcaagttgtagttccactcatgatgctttgctcttcctttattttcctcttctga

SEQ ID NO: 27285 - DNA, 825 bp, Glycine max
  Peptide Sequence Number=SeqID_118970
atggaggatgagtctcctgttaggggtaggtccctcgtggctagggaggttaagggcacaggggaaaataggagtgaggatgagttgtccatttcgtttccctcatccacctccgactcaaaaagaacgaagaatattctagtgagtggtggtaaggaggcaaagaagacaaagaagagtgggggtagtcagcagatggacggtgttgtaggtagtggtaaggggactaaaagtggtagggggagcaagtttgcccctatcaccatccatgggtacgggtgggtttccgtggagtcttggaaaaagttcaagtcgagctttttccgagttcatccaaaccttgcttatggagacttgaaaaatttattctacaaggaggatgggaaaactcccaaatttcccttttattggcaatgtttccctttcaagttcaaattccgtccccaccaactattgttggcccaggaagtcaaggatattaagatcataaaggaatggtcacgcgagatgtcattcatgaagggctacgactacaagaacttgaacagtttggtggttaatgaccaaatggaggttgggaagacgaaaaagaggaagtgtgctaaggattcctcaaagtctgaccttatgaagaaatcaactaagtcggtgaaggggccaattaagggcaacaatgccaaggtggaggtcactcacttggatgagcccgaggtggtagacaagggattagaagagaacaaagtggttgaaggtgatgctgagtctttagagaagaaaatgaggggaaaaaaggccgagaaggaaagagaaatggagcttgcatga

SEQ ID NO: 27286 - DNA, 372 bp, Glycine max
  Peptide Sequence Number=SeqID_118971
atggaggccatgaaagacaaaatggcctccatgatggaggccatgttgagcatgaagaagataatggaggtcaatgtgtccagtgacaagcattccttcataccatatgccttgccttctaactatacaccgcccaatgttgcacacactcccaatgagaatgccgacaactccgcacccatacccattgagagccaacaaccccaatttgatcatgcacatgtatctcaacccatgggggagacacatgaagcacctcaagaccacaatctagtcgactttgaacctcacctcagatatgctactgaggggcaagtagttgatggtgtacccctaccaaacactttggggggtcctcagtattgcccataa

SEQ ID NO: 27287 - DNA, 258 bp, Glycine max
  Peptide Sequence Number=SeqID_118972
atgtctgcaccaataggtggcattcttgtaattagtgctaatactattcattatcacagtcagtctgcttcttgtgcattggccttgaacatttatgctattacacttgacagtagggaagactcaatcacaggtgtcgcaacctacccttcggcgggagggcgacaagaggattcatgggtgcgtcttccatgggaggaagatgcgcggagtcgccaccaacgtttattcgaggaaaacgttggaaaaaccgaaaag

SEQ ID NO: 27288 - DNA, 540 bp, Glycine max
  Peptide Sequence Number=SeqID_118973
atgccgcctaccaggcaccctctagacccagataagtctaacatggccctgggttttccagcattgatgacgggtctctgccagtcgttcggggttcctgtcacacctagtaaggtgattcgaccgccgatcacccgggctttcatagagaagtattgcacgcctagacaggcgcagggtggcgacccgcaggccccaaacgcaccactgccacctcatcaggctgatccagctgggtcgtttgacacggagcggtatttacggcatttggttcgccagcaagcggccaaccacagggcgcacgtgcaggcccatgactgtctctaccagctcagcctcagactgcagggccagggttttgctccttttccatgccctactccggatcagttcagggcagaggtcgcatggcccgaagattggcctaaggcccaagcaggggaggcacccgcagaggctcccggcgatgtagatgaggcctgcatggacgaggagatgatggatttactcgatttcttaggagggagcggagccacatga

SEQ ID NO: 27289 - DNA, 423 bp, Glycine max
  Peptide Sequence Number=SeqID_118974
atgcgtctaccggggaaggagagtctgctgatgaaatctcccataaccataaatgagattttggatgttagcatttcgtttctaaatgaccatttagaggaaacactgggttcgacaaaaatagaagaaatccactcaaagtgtatcaatctcgcacagtgcggggcgaggaaaaaaaaagtcgctagcgcacgggattttggttgggtaaggtttatggtgagtcaggattttggctcaaggcttgtagaatggctagacatgatacatgtcagggtttggtttggttcaaggataaaaagggatgccccacattatttccatgacacaaatgcaaaaatgatgatttggaaattttatgcaaaactggccacgcatgcacctatgtggacactcaaatgtcaaatttttatggtcatgtga

SEQ ID NO: 27290 - DNA, 213 bp, Glycine max
  Peptide Sequence Number=SeqID_118975
atggcacatcaaaaccccccatacttagccttttgcactcttgggaaaaatgaaataaagaacaaaattcaaggatatcaaagagagacaaacacaaacatttacatattttgcaatgaacatcaaggaatgaaaggaatggatgaggataaaaaggtctttaaaggttgtaatgggcccaaggacaaggtagggaagaaaaatatggaataa

SEQ ID NO: 27291 - DNA, 318 bp, Glycine max
  Peptide Sequence Number=SeqID_118976
atgggtgatcaacaggagacacgagaacagatgaaagccgacatgtcggctctgaaagaacagatggcttccatgatggaggccatgttaggaatgaggcagctcatggagaaaaacgtggccaccgctgccgctgtcagttcagctgccgaagcagacccaactctcttggtagggcggggaaggaacacactggggcatgacggcaaccctcatctgggatacaaccaagcggcttacccttatggattgccgcccaactactcaccacctgtcctgcaagacgatgcggggccatattgtttctcccgtccttga

SEQ ID NO: 27292 - DNA, 479 bp, Glycine max
  Peptide Sequence Number=SeqID_118977
atgactagggacaatccaggtgatttacaaccctttgaacctgaaatagatagaacctttcatagattagttaggcatagtgtgcatcctggtcattctgtgcattttgagcattctgagcattttgttgagggtgattctgaatattctgattttgagcattccactactaatttttatactaagaacatggctcaacctccacctcatgaaaggacacttagggagatggttgcacctgatttcacttatgaaagcttgtgcatccaatatcctgatgagggtgttccatatgttctcaagactggactaatacatttgctgcccaagtttcatggtcttgcaggtgaagatccttataagcatcttaaggagttccatattgtttgtttcaccatgaagccccctgatgtccaagaagatcttatctttctaaaggcttttcctcattcacaaaagggagtggcaaaagattggct

SEQ ID NO: 27293 - DNA, 435 bp, Glycine max
  Peptide Sequence Number=SeqID_118978
acaatctgtgtgggcactcaaagtgacatggattcttaacgtcctcggacgaaaaatgaataccaagtctcaacgagtgaacacattgaacgctggcggcaggcctaacacatgcaagtcgaacggtagcacagagagcttgctctcgggtgacgagtggcggacggccacactggaactgagacacggtccagactcctacgggaggcagcagtggggaatattgcacaatgggcgcaagcctgatgcagccatgccgcaagaagcaccggctaactccgtgccagcagccgcggtaatacggagggtgcaagcgttaatcggaattactgggcgtaaagcgcacgcagcggtctgtcaagtcggatgtgaaatccccgggctcaacctgggaactgcattcgaaactggcaggctagagtcttgtagaggggg

SEQ ID NO: 27294 - DNA, 843 bp, Glycine max
  Peptide Sequence Number=SeqID_118979
atgcacacacatgacctctattccatgaagtgctttaaatgtcttggaagaggacacattacttctcaatgccccaccaagaaaaccatgattatgaggggccaagacatttatagtagcctagatgaggctacttcttcaccttcctctagtgaaagtgaagaagcaaaaggggaagaatctagtgaagaaatctacccccaagaaaaagaacaacctttaatggttaaggaggagtgtgaggtaagtgtctcctccaagaggttagctaagaaggaaatgcattttgaaataaagacaaatattaaagttatttcccctcttagacaacctccacattttctcctttgtgaaaagacacttgttaccattgccacacctcttaggcttgagtttattcctcaagtaaaggagttgttggatgagggattggttcgcaagagcttaaatccttatgctttgttggtacccaaaataggtattattaggcatcaaatccctaaaataggtggtatgatgaatgttttgagtggtgcaaccctcttttgtaaaatcactcgtgcacccaacatcttcatgatttgtgtacatagggactcattaggtagtgatcaaggggttcccatgaaccctaagagaataaaggtcattcctgaatggcccactccaccaacagaatgcagaaggaagacagagaggagacgccacttcaaggagaagatgagtctagaagaagctcaccaccataggaggccatggataagagcttggaggaagaaggagatgaatgaaggggagagggaagagaggagcacgaaattttgtgctctaaatgagctttga

SEQ ID NO: 27295 - DNA, 364 bp, Glycine max
  Peptide Sequence Number=SeqID_118980
atggtgggagcaggtttgaaaaaggatcttacgggagtgtctagggttgagtgcttatctccaatgacaaagatccttgccatggtaaagaagaagggggaacaagcaccttggagagcgcagtacaacggagttgtagctgcgttcgggaaggatcctcagaatcgacctcccgaaaaggaatctattgattctctcccaattggttggactgtaggtgcgatgatttacttcacgggcgaggtctctgctcagttggtagagctccgctcttgcaattgggtcgttgcgattacggaggaccgaaacatgccactgaaagactctactgagacaaagacgggctgtcaagaacgtagaggag

SEQ ID NO: 27296 - DNA, 279 bp, Glycine max
  Peptide Sequence Number=SeqID_118981
atggtagcctggcccgggacccaaccttctctttacagggaagatgaaggtcccatagcccaggtacctcagtatgtggaggatgagtcatctgaggccaccatcccagagccatttgttatagcagaagaggcagaggagacacatgtgagacaggtagatgctgccacacctgagcgatcccttgaggctacttcagagccttctgcaaaagggaaggaaataccctcacctcaacttgcagcagacccctccactcctcttcaagagatgccatag

SEQ ID NO: 27297 - DNA, 171 bp, Glycine max
  Peptide Sequence Number=SeqID_118982
atgaagacggtgaagaacgacgaagacgatgagaatttccacagaatcgcttacggaagcgttacggaagttttcggaaattttacggaagtattacggaagccgcggaagccccgaaaaccatttttcaaaaacgtggaggagcttgccgcccagttggggatcctctag

SEQ ID NO: 27298 - DNA, 405 bp, Glycine max
  Peptide Sequence Number=SeqID_118983
atgaataatgtggcgcaggagtatcgtgcaaccgtagcagcattaacccagcggctggagcgtggcgagcgtgatgtcgacgcactggtcgccgaggcgcgtagtgcgctgctgcagaaacagacgctgaccaccgccgaagtcgacgaggtcatgcgcgcggtgcggcgcgatttgcacgagttcgcgctcagctatcaggagtccagcgaagcgctcggcgattcagtgtttctgcgggatctgcggcatcacggcgtgtatcagagcggcgaagtggtggggctgggtaacctggtgtgtgaaaagtgcggctttacccgggcgatttacaccccggagagcctgacgcgctgcccggagtgtggccacgatcagttccagcgtcagccgtttgagccctga

SEQ ID NO: 27299 - DNA, 171 bp, Glycine max
  Peptide Sequence Number=SeqID_118984
atgggatcttcgttagcaatgggatgttcatctcggtttgatgtttgcgtttgtggtagctgtgaaggtggcgtaaagggggatgaaggatggttttgttggtcaaaggaggcggtagttgtagttgtggacatgggggttgtggagatgatggttgtggttgaggaataa

SEQ ID NO: 27300 - DNA, 186 bp, Glycine max
  Peptide Sequence Number=SeqID_118985
atgattgaacatgtattggcgatcaaaattgccattccttgggttatggggttgaaccaagctcgtgcttttatgaaaaaggttcatcaagtcaagttgaagtatggaagtaaccatcttgcaaaaattggggcaaaagatggatcgggttacatcactgcttcgtctactgccaaacacatttag

SEQ ID NO: 27301 - DNA, 708 bp, Glycine max
  Peptide Sequence Number=SeqID_118986
atggccccgagaaagcttcccgcgaagaggtccaagaaggacaccaccggagagggctccagtgttgccccgcaagctgacatggacttcgacaagcaccgatttcggagcgccgaatatcagtggcgccatgagaccatcaaggggtggtcattccttagagaaagacaggcagagggccaacaatgtgagtacagccagaggaggagacaggtctttggctttgatgaggatgctattgcccagctgttatgcataccgagaaaagatttcacccggaccgctggagggagacgggtgcgaatcaggcacaccagcatgaccacccttacacaaatatggatgatgttgcttcttagcaacattctgcccagcgaacacaactctgacctccccctaccgaagtgtcagttggtttatgccattctgacgcaggtgagtgtgcacgtggcacaactgatttttgacgccatttatcactttgcaggtgttgcacccacgagacaccctatggacccggagaagtccaatagggccctggggtttcccgcgatcacggcctctgccagtcctacggagtgcccgtcacccccagcaaggtcatctagtcatctattaaaagggccttcatcgagaaatactgcatccccaggcaggcataggaccaggcaccgcagcaaccagaggaggaccaacaaccatctgtag

SEQ ID NO: 27302 - DNA, 282 bp, Glycine max
  Peptide Sequence Number=SeqID_118987
gggtgctcgcccaggcgagctaacctttttagggaagacataagcatggccctctacgggatactaggatgccttgcggcggcgttttccgtttgtccagagctggggaagggacgacgatctgtcggtcgtgaccctagcctctacttgcgtccgtccctaactctagcttctcatctcaaggaggtgagcttagctattagagagcttctcaaggaagttttctcaaagaagcttctcaaggaagttttctcaagaaagcttctcaaggaagctacctag

SEQ ID NO: 27303 - DNA, 1120 bp, Glycine max
  Peptide Sequence Number=SeqID_118988
gcgctgctggacgaggcggttcgtcaggaagccgacgcggtgattgttcatcacggctacttctggaaaaacgaatcgccgattatccgcggtatgaagcgcaaccgtctgaaaacgctgctggcgaatgacatcaacctgtacggttaccatctgcctctggatgcgcatccggagctggggaataacgtccagctggcgcgattattaggcataaccgtgatgggcgaaattgagccgctggtgccgtggggcgagttagcgatgccggtgccggggctggaactggcatcatggatcgaagcgcgtctcgggcgtcgtcccctgtggtgcggcgacaccgggcccgatcttgtgaagcgtgttgcctggtgtaccgggggcgggcaaggctttatcgatagcgccgcgcgcttcggtgtcgatgcgtttattaccggtgaagtttctgagcagacggttcactccgcccgggagcaggggctccatttctacgcggcaggccaccatgcgacggagcgtggcggcattcgcgccctcagcgattggctgacggaaaataccgatctggatcgagcgcgttgttatcttctgggtgaaaccgcagtggtactggagctggagccgcctgttacgctggcgacgcaaaagcgaatctggcggttgacccagcgtctggccgacatgccagaggtggttgagggccattccagtgaagcgctggagcctgactccagaacgattgagatcccagtggtgtacggtggcgcggggggacccgatctcccgattgtcgcggaacactgcgggttaacggaaaagcaggtcgtcgagctgcacgcttcggttgattatgttgtctggttcctggggtttcagccgggcttcccgtaccttggcgggctctccccgcggctgcatacgccgcgtcgcgcggagcctcgcctgagtgtaccggctggcaccgtcgcaataggcggcgagcagaccggcatcgccggtcctgttgcgtgccggcgataccctccgctttattccgcagaaggagggggtatgttaacgcttattcgcgccggtctttacacttccgttcaggatgcgggccgcttggcatgcgcca

SEQ ID NO: 27304 - DNA, 459 bp, Glycine max
  Peptide Sequence Number=SeqID_118989
atggcaaggggcgtacatgacattcagaggatgtggcagagcattgacattgtccgcgaacgcttgacacttgtggcatttccttacatgaacgcaacaatcactttccattgtgagccattaataacctgctctcaggatcttcctggccatagcatgcccattggcgtgtgttccaaacaaaccctcgtggacttcctcgatcatgtggttcgcctctttggcatccacgcatcgcaggagagtcatgtcgtggttccttttatatatttccggtgggtactctttgctttcgacaaatcgcttgatatcgaaataccaaggcttacgtcccgttcctcttccacctggcaacaatgtgcgggttttccacgacaccagaactcaatgtatggtagatccccgtgcggcgttagctggaacatggacgccaaagtggcaagcgcatcagccatttga

SEQ ID NO: 27305 - DNA, 273 bp, Glycine max
  Peptide Sequence Number=SeqID_118990
atggcttgcacccacattccagtgaaaggatttacacgcaattctcctcaaatttcatccagcccgcatcaattagaccttgcaccttacgctttagagccctacaatgctcaatggaacgccccggggcttctccgtgacaagcacacgttgcgttcgagtcgtattctcggagaaatggaggttgatgaaccttggctagggttatggctaccattgaattatcaagtagatatgggagcaagtcagcataggacactggaattggggtga

SEQ ID NO: 27306 - DNA, 183 bp, Glycine max
  Peptide Sequence Number=SeqID_118991
atgcaggaggtgaaacatgtcacgccaacacgactttgtaagttaccgttcacaggaaaaaatccaaaaagatttgacattccttcgggatgtagcatcaacgaattgaaggatgtgatcaagcaagttgcatctcaagggattctcccttatggtattcatgaatcacaaacggtcagatga

SEQ ID NO: 27307 - DNA, 479 bp, Glycine max
  Peptide Sequence Number=SeqID_118992
ccaaagatatctccattaacgctgctaagaccgtttgcgatttctgtggacgcattggtcatgtggaaagtacgtgttataagaagcatggagtgccctctaattacgatgcaagaaataagagtaatggaagaaaagcatgcactcactgcggcaagataggacatacagtggatgtctgttatcggaaacacgggtacccgccgggatacaagccttacagtggaaggaccaccgtgaacaacgtagtggcagttgaaagcaaagccactgatgatcaagctcagcatcacgagtctcatgagttcgttcgcttctcccctgagcagtacaaggcacttcttgccttaatccaggagccatccgcagggaacacggcactcactcaacccaaacaggtggcttcaatctcatcatgcaccgtcaataatccaacaaacccaggaaatgaacaaccatatgaagattggtatagttga

SEQ ID NO: 27308 - DNA, 315 bp, Glycine max
  Peptide Sequence Number=SeqID_118993
atgtgggatcaatttcatacgtgcatccaggattctattgaaaatattattgatgtcaaagcggatggtaactgtggttattgtgcaatagctgccttattgggtatgggtgaagattcatggtcattggtgcataaccatctacataaagaactcacaagctggtcggaagagtatattaacctacttggtgtcatagagagatttgaggaattaaagtgttctctacttgttgatggattatctatggtgcgttaccatagaaaagtggatgaatattacagatatgtgatatgtcattgcttcacgatataa

SEQ ID NO: 27309 - DNA, 430 bp, Glycine max
  Peptide Sequence Number=SeqID_118994
cctcgcttttgtcgaccacaccgctttctgttaccatgacccaagagctggtagcccgcggagacaccttacggttatccgcacctcggccagtgtgattgatgagcagaggccaatgtggtctgagttcctcattggaggatacgtaggagcaagagcctcgcttttgtcgaccctgccccataatctttgtcatactgaccctgaggcgggcccgatcacacgcagagacaaaatttggtcattctgcacccttgtgtcatccagaggcggcgggcccgatgacacgcggagataccttacggttatccgcacccttgtgtcatccagaggcggcgggcccgatgacacgcggagataccttacggttatccgcacccttgtgtcatctagaggcggcgggcccgatgacacgcggagataccttacg

SEQ ID NO: 27310 - DNA, 134 bp, Glycine max
  Peptide Sequence Number=SeqID_118995
atgggggtgcaaatagcacccaggcccacttgggccctccagaatattcctccagaaggcgggaatctcgcaaaggtttcaaccgttcttcgacgttcttcattcgttcttcatcattcttcgatcttcaacgg

SEQ ID NO: 27311 - DNA, 645 bp, Glycine max
  Peptide Sequence Number=SeqID_118996
atggaggccgcagaggagtcattagaaaccgctttccagtctttcgaggtggtaagcatttcctccgtggattccttctctgggcaagcttgcctgtccgatgcaatagtaatgatggcccgagttatgttggggaacggttacgaacccggaaggggtttaggcaaagacaacggcggcataactagcctgataaatgccaaaggaaatcgtgggaagtatgggttaggctataagcccactcaggcagatataaagagaagcatcgcgggaaggaagagcggtagtcaaagctcacggttgagacaagaaggtgaaggaagcccaccctgccacataagcaggagctttataagcgcgggtctgggggacgaaggtcaagtggtcgcgatatacgaagatgatgttccgagtacattggatttggtacgaccatgccctcctaatttccggctgggaaattggcgagtggaagaacgccccggcatttacgcgacgagcataatattcgatgacgagtccctcgaaggtactaatacttgggacccgcctatcaacttcgagcaggaaacgaatcaaacggaagatgaagagaacgaggatgtgggacttcccctggagtttagaaaggatagtcgcccatga

SEQ ID NO: 27312 - DNA, 168 bp, Glycine max
  Peptide Sequence Number=SeqID_118997
atgtggggttctacaggtgccatgcttggacaaaggaaaggaaaattttttcataccatctactatgctagtgaagttcaaaatgatgcacagggatcagagaatgttgtagctgatcatctgtcaagattggtgaatgaggaagttacagcaaagaagctgaagtga

SEQ ID NO: 27313 - DNA, 408 bp, Glycine max
  Peptide Sequence Number=SeqID_118998
atgggaggccatgaggtgagaaacctgcgtgtaaccgacagatcaaggaagccacatgcggttgcaattaagccgctaccagcattgttgctaagcccccataatgtacaaattcaaaacgagcacgccttcctgccatatggcttgcctcccaactatacaccacccaacgtggcgtacactctcaatgaaaatctcaattactccactccgatactcattgagagccaacaaccccaaactgatcaggcacatatctctcaaaccatgggggagacacaagaaattccccaccacaatctagctgacttcgagccttggctcggatatgccactgaagggcaagcagttggtggtataccctttgaaaacactttggagggccctcagtttcgcccacaaccataa

SEQ ID NO: 27314 - DNA, 906 bp, Glycine max
  Peptide Sequence Number=SeqID_118999
atgggtcaacttcaacggcaagccttctgcaaagcctacggtaagatttgggacctagctagggtagaagtctccatggaaccgattgcatccctttcccagtattatgaccagcccctaaggtgcttcacattcgaggacttccagctagtgccgactgtgaaagagtttgaagaaatcctgggatgcctactgggaggaaggaagccatatcttttctctaggttctatccttccacgacaagagttgccaaggtagtgaaaatctcagcacaagagttggaccgagtaaagcaaaacaggaatggggtagtcggagtaccaaggaagtttgtcctctttccgaatatggaagggttagtggacctagcagtgattgacgctttcctcacctttcatcatggcaaggaaagcccggtcgtcgccattttggccatgtatgacacgttcgaccggggatgtgaaaagagtggtgcaagaattgtttgttgtgcactggctctctatgtgtggctggttcacacctttttctccaagaaggtaggcccgtctatccgctacaaggtcaccgctcgaaggaagaatcaggattctatcttcatgcgaaggatgtccaaatgttcccttgatggaacaaggggttgtattaattataatcccgtcctcgccataagacagcttggctaccccatgagaggagtgccatcagacaaaagcatcacgcctttcattgcacggggtttcagtgaccccaatgcgagggacagagagcttaggggaagcagtaatgggatcattggcggctatcataagtggctgagagtccggacacaaggattggattggctcccaaatctaaagactgtgagagacaatgaggttaaagcttcggaagaaagtgatgag

SEQ ID NO: 27315 - DNA, 800 bp, Glycine max
  Peptide Sequence Number=SeqID_119000
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgataaggctaaagaaagcttattcaatgtgtatcaaagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 27316 - DNA, 387 bp, Glycine max
  Peptide Sequence Number=SeqID_119001
atggcttccatgatggaggccatgttaggaatgaggcaactcatggagaaaaacatggccaccactgctgctgttagttcggctgccgaagcagacccaactctcctagccaccgcgcacaatcctcccccaaatgcggtaggacgaggaaggagcacactggggcacaacaacaacccctatttgggatacaaccaggtggcttacccttatggattgccgcctagttacacgccgccattctaccccccgatccctgtcgaggggctggcacccaacactttgcctcagcccaacctcacaccacaaccaatattcttgtccacagaaggaccacccccggcggctgagaaagaaggaaactcgatctcctcgaggagagattga

SEQ ID NO: 27317 - DNA, 258 bp, Glycine max
  Peptide Sequence Number=SeqID_119002
atggagatgcaactgaaggcaaaggagaagaggagaggggagacaccatccactagggaatatgtagaagcaaagcttcatggtgaatcaaagaacaattcaggagttcaagataagaatcaagaagaattcaagactcaagaagaaaatctaacgtcaagaatcaagattcaaggttcaagatctcaagaatccagatcaagattcaagactcaagattcaagaataaagagaagactcaatcaagataagtattaa

SEQ ID NO: 27318 - DNA, 165 bp, Glycine max
  Peptide Sequence Number=SeqID_119003
atgacagaatttgttcctgccaaaaacagcactgagagcacgatgccaactctggtctcgacatcagaacgcaggactctcggaggaaaagaagagcaaaagaatctggctttcgtgtccaatgatgaaggagaagaagatgagtatgacctgatactgatgaag

SEQ ID NO: 27319 - DNA, 318 bp, Glycine max
  Peptide Sequence Number=SeqID_119004
atgcgtctaccggggaaggagagtctgctgatgaaattccccataaccataaatgagattttggatgttagcatttcgtttctaaatgaccatttagaggaaacaccgggttcgacaaaaatagaagaaatcactcaaagtgtatcaatctcgcacagggtaaggattgacatcctcaccctgggtcaaggttatggtgagtcaggattttggctcaaggcttgtagaatggctagacatgatacatgtcagggtttggtttggttcaaggataaagggatgccccacattatttccatgacacaaatgcaaaaatga

SEQ ID NO: 27320 - DNA, 792 bp, Glycine max
  Peptide Sequence Number=SeqID_119005
atgggaacaaatcaaaccggcaagaggttctaccaagtcaaggtcaaaagcccagataccaccagcatcaaggaattagggcggttgatggaacccctccaaatgcaagccttccgcaagacttacggaaagatcttagagttgaccatagcagaggatgtcctctcgggagaaagaaaaccatatctttcctccgggtgtctcccctctttgagcagaattgcaactgtggtcaaggattcagcaagaggtttggaccgcataaaacagactcggaacggcatagcgggcctaccacagaggtacctagaagacaaggcgaggggtatggccaatcaaggagactgggtcccgtttatggatgtgttagctttgctaatttttggggtcgtcctctttccaaacgtggatggtttggtagacctagcagcaatcgacgctttccttgcctaccaccatagcaaggaaagtccggtggtagctgtcttggcggatctattggacacatttgaccgaaggtgcgaaaagagtagcgcacggatcatctgttgcttacccgccctctgtaatagattgggaccagctcttggccggataggaggtagaacaatcagttggttcccccgatggaaggaaggaaaagaaggagtccttttctcatgtggaggatacccaaacattccgctggtaggaacgaggggttgtattaactacaatcccgcgctcgctataagacaactagggtaccccatgaggggagcaccgacggaagaaagcatgtctcctatcctt

SEQ ID NO: 27321 - DNA, 288 bp, Glycine max
  Peptide Sequence Number=SeqID_119006
atggagattcctgataacagaaagtggatgtatcagaggttggatgctaataaacatcggacaaatgagtttagcaaaggacgatttgagtttgtacagtttgttactagtcaggacatgtttcaaatgcaagggttcatgccgatttattattggtggacaaaccacggtgaggagttaccacaatttccttcagtagtgttgcatggttcatactacgaaagtgatgggcaaagggaagaattgaatccttatgagcaaatgatcatggatcatgctggaccatga

SEQ ID NO: 27322 - DNA, 669 bp, Glycine max
  Peptide Sequence Number=SeqID_119007
atggataacaatcaagaggagataaattacatagggttagagagggatgtggattgtttggttgtgagggggtcgctgcaacgggatgatgattgtagccaaatgcaaagccacgtggaccggccatgccggcgcataggacagcgtcgtagtacaaaaaagggtttgccgcagcaccgcgccggaatcggcggcgacgtcacagtcgcggctagaggactcgacgatgctgctctagctggggctcaagcacgcgctgcctcctccgcagtgtcgaaggttccgagccagacgcggctcttcttgctgggatctctgatctccgaggcatatctcccccatggcctctttctcactccacgaaaatgcacccctggagccatcagccatgctcatgtgggatctgcatctgtgttggttggtgatattgatgatgcattggactctgaaaaaggtaaccatcccaccgttgaatactattatcagatcatgtatttttcctctacatctgatgaggacatgaccaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaaggtt

SEQ ID NO: 27323 - DNA, 387 bp, Glycine max
  Peptide Sequence Number=SeqID_119008
atggtgaaagttggaacctcttacgtgccgatcaacgtctcattttcgccaaaagttggcccagggcttcccggtatcaacagggacaccaggatttatttattctgcgaaagtgatcttccgtcacagtggcttctgtttctatcagctgtccctcctgttcagctactgacggggtggtgcgtaacggcaaaagcaccgccggacatcagcgctggcaagtgtagcggctgcgcaactgttgggaagggcgatcggtgcgggcctcttcgctattacgccagctggcgaaagggggatgtgctgcaagcgattaagttgggtaacgccagggaattcgatgggcggatagaccgtccacccagtgccgctacccacttctactaa

SEQ ID NO: 27324 - DNA, 822 bp, Glycine max
  Peptide Sequence Number=SeqID_119009
atggacctcatcaaggctgctggactgctgaaaactgtcaccaagttgggagattgttatgaaagtctagtcagggaattcattgtcaacattccctctgacataacaaacagaaagagtgatgagtatcagaaagtgtttgtcagaggaaaatgtattagattctcccctgctgtaatcaacaagtacctgggcagaccaactgaaggagtggtggatattgctgtttctgagcatcaaattgccaaggaaatcactgccaagcaagtccagcattggccaaagaaagggaagctttctgcagggaagctaagtgtgaagtatgcaatcctgcataggattggcactgccaactgggtacccaccaatcatacttccactgttgccacagaatcttttgctgtcaaattacccattgccttcctactgtatgtgtggcattatgttgagtcacatccaaatattttaaacaacattgactctgtgatgaagagagaatctgctctgtccctgcattacaaactgtttgaggggacacatgtcccagacattgtctcgacatcagggaaagctgctgattcaggtgctgtgtccaaggatgctttgattactgaactcaagaacacatgcaaggtgctggaagcaaccatcaaagccaccacagagaagaaagtggagctggaacgcctgatcaaaagactctcagacagtggcattgataatggtgaagcagctgaggaagaagaagaagccgctgaggaagaagaagatgcagcagaggatacagaatccgatgatgatgtaggtaagaccaacccatga

SEQ ID NO: 27325 - DNA, 315 bp, Glycine max
  Peptide Sequence Number=SeqID_119010
atgactcgggcatactttaagctatgcatggaaaataggaaaatgcatggatcacacatgagcaaacatgaaaacaaaagagatgcttatgcgatgcatgatatgaatgcattttacggacacgagagcccggaaaattatctcttcttacttgcgcatttgggggcacagtgccctatgtgtacaattaagaaggtgatatggaccttccggcttcccgtgacaaaggacgagaccaacatacaatgcattctagagataaaatgcgggagtgacttgattcgcactgatttttggagtaaaaatgtgggataa

SEQ ID NO: 27326 - DNA, 450 bp, Glycine max
  Peptide Sequence Number=SeqID_119011
atgcaccaccctgtgtccgcgttcccgaaggcacccctctctttcaagaggattcgcggcatgtcaagccctggcgggatacttaacgcgttagctacagcattgcacgggtcgatacgcacagcgcctagtatccatcgtttacggctaggactactggggtatctaatcccattcgctcccctagctttcgtctctcagtgtcagtgtcggcccagcagagtgctttcgccgttggtgttctttccgatctctacgcatttcaccgctccaccggaaattccctctgcccctaccgtactccagcttggtagtttccaccgcctgtccagggttgagccctgggatttgacggcgaacttaaaaagccacctacagacgctttacgcccaatcattccggataacgcttgcatcctctgtcttaccgcggctgctggcacagagttag

SEQ ID NO: 27327 - DNA, 156 bp, Glycine max
  Peptide Sequence Number=SeqID_119012
atgactggagatgcatcaaagtttacacatatctctcccaagaaaagcgggcatgtaacttatggtgacaacaacaaaggtagaatccttggtgttggtaaagtcttaagtacatcctacttagtgttagtcaattatgtgacaaaggctatctag

SEQ ID NO: 27328 - DNA, 313 bp, Glycine max
  Peptide Sequence Number=SeqID_119013
tgctgaagcagaactggacaggagctgtcagaaactgtccggaacatccctttcgacatcaggaaaggtagtgaatactggaaaaggtcagatgaaaagcccagtcacagcaaaggaattcaatgccatgggtgtgaagaagtatggacacatcagaaagctgaatggtcccactctgaactcaagaagcagaggaaaggactttctcaatgaagcacaattcttgaaagaagcttgcactggggctgagaagagacatgaagagggagaaagatctctgagcttaaaggagaagttggtttctgaactctaa

SEQ ID NO: 27329 - DNA, 336 bp, Glycine max
  Peptide Sequence Number=SeqID_119014
atggcagtggtaaaccccgggaagatctaccaatctcccttccctcgatggtacaaccccaatgcaacctgtgcctacatgggggatagcccgaatataaggacgaatcctcttgctagtcataggggatcaatggttaatatggtggaggagtgtggacctcgagggctgaagcggatggaagatgtgttatcttctaggaggtttatattggaagcgttgtgtgaagcgggcatgatcagccttggcggggacaagggagattcttgtttgatacatctgggggcatcacatgatgtagagacatgcttggtggcagaggagctgctacaaggg

SEQ ID NO: 27330 - DNA, 340 bp, Glycine max
  Peptide Sequence Number=SeqID_119015
aaaattgggggagaagcttgccacccagctcgcccaggcgagcagggttgcttcctccagaagtaacagtcttctggaggaatcttctggagggcccaagtgggcctgggaaatggccccgaggaagctcgcctcaaagagatctaggaaggataaagcggctgaaggaaccagttccgctcccgagtatgacagtcaccattttaggagcgctgaacaccagcagcgcttcgaggccatcaaaggatggtcatttctccgagagcgacgcgtccagcttagggacgatgagtataccgatttccaggaagaaataggtcgccggtggtgggcatcactg

SEQ ID NO: 27331 - DNA, 231 bp, Glycine max
  Peptide Sequence Number=SeqID_119016
atgtcgctaagcggtagtgtcttgttttgcaaaggccagctaagcagaccatgtctcgctaagcggccaatggcttctaggaaacataaaagtattggttcaagacccacagtgcagtatgacaaggagattctcttctttagatgcttggaccagatacacagacaatgtcctggggagaaacatttaaccagagaggaaagtagaaatatatcactcttagctagatga

SEQ ID NO: 27332 - DNA, 312 bp, Glycine max
  Peptide Sequence Number=SeqID_119017
atgggaaggcgtgctcgttttgaatttgcacatcatggggtcatccgtacttcccaaatctttgcctaccatattggacgattcatttgcttgaggccagatgggagcatcgggttcaccttagcgacagcgctaatagcggcaactataaccgcattggcttccattatcttcttcatgctcatcatggcctttatcattgtggccatttgctcttttatggcctccatttttggccttcatcttctcttgcaccttctctgcttcacccattactctagctctagcacgagttcggaaagaatgcaatga

SEQ ID NO: 27333 - DNA, 198 bp, Glycine max
  Peptide Sequence Number=SeqID_119018
atggtgaagttgtcttctggggtgtacgcttggagctctatggagagaaagagaagaaggaagaatagtgttaaggaggtgatactgaggaacgtcatgcttggtgttgagaaaccgcaagaagcacaggagaaaggaaggttcagagtgtttgttagtgaaagacgacagcacgactcaagtggcaaatatgtgtaa

SEQ ID NO: 27334 - DNA, 1020 bp, Glycine max
  Peptide Sequence Number=SeqID_119019
atggctacctcaccaaaagaaacttcagctcctggttcaccctctgtaccatcatctccatcatccaccaaagcaccatcaaaccaggaacaacctgaattccatatccaacccatacaaatgattcctggtcaagcccctgttcctgagaaactggtccccaaaagacaacagggagtgaagatttctgaaaaccctagccttgcaacaagtcctagggaagtagacccggagatggacaagaagatccgcagtattgtgagtagcattttgaaaaatgcttctgtccctgatgctgatgaagatgttccaacatcttccaccccagatgtttctgtccctgatgctgataaagatgttccaacatcttccaccccaaatgctgaagtcctctcttcatccagcaaagagagatcaacagaggaagaggatcaagccacagaggagacccctgcaccagctggcaccagaacctgctccagaaagactacaaacagaaagggaaaaacccccattactaggtctggacgaatcaaaactatggcacagaagaagagcactccaatcactcctaccacatccagatggagcaaagttgcaatcccttccaagaagaggaaagaaatttcctcatctgattctgatgatgatgtcgaactagatgttcccgacatcaagagggccaagaaatcagggaaaaaggtgcctggaaatgtccctgatgcaccattggacaacatttcattccactccattggcaatgttgaaaggtggaaatttgtatatcaacgcagacttgccttagaaagagaactgggaagagatgccttggattgcaaggagatcatggacctcatcaaggctgctggactgctgaaaactgtcaccaagttgggagattgctatgaaagtctagtcagggaattcattgtcaacattccctctgacataacaaacagaaagagtgatgagtatcagaaagtgtttgtcagaggaaaatgtgttagattctcccctgct

SEQ ID NO: 27335 - DNA, 279 bp, Glycine max
  Peptide Sequence Number=SeqID_119020
atggataagtttgaccctgaggtagtcctggatttttatgctagtgcttggcccacagaggagggagtgcgagacatgcgttcatgggtgaggggaaggctaggagtgcgagttcagctagaggaggaacagggccgatgggttcgacgaggaggccattgcccagctgttatgcacaccggggcaggatttcgcccggaccgctgccaggaggaaggtgcggatcatgcgcaccagcatgaccaccttgacccagacgtggatgacattactgcttag

SEQ ID NO: 27336 - DNA, 147 bp, Glycine max
  Peptide Sequence Number=SeqID_119021
atggtcaaataccgcgccaaatccaagacagagatgaatcgaggtacttggggacgagcacaaatggatgctaggcccatgatcaacagatcgctgtcccgcgtccagctccggacaatcgagaagcgctactgggaggcaacctag

SEQ ID NO: 27337 - DNA, 429 bp, Glycine max
  Peptide Sequence Number=SeqID_119022
atgggagacactagtcagaaggtccgcttaaaaggaggtttatcaagcaaatcaaggaactcagaggccagtttacaatggggcccatcgatggcaacttcaccggaaggttccgcaaagcccatggtcaaggtttgggacctagctagggtagaagtctccatggaaccaattgcctccctcgcccagtattatgatcagccgttgaggtgcttcatctttggggacttccagctatcaccaaaggtggaagaatttgaagagatcctaggatgtcctctagggggaaggaaaccatacctcttctcagggttctacccctcattggccagaatttctaaaaaagtccaaatctcggcgcaggaattagaccgccaaaggcaagtcgaaaatggggtgatcggaataccgagaaatatttggaggtaa

SEQ ID NO: 27338 - DNA, 750 bp, Glycine max
  Peptide Sequence Number=SeqID_119023
aagctcctggctgagaagacaaagaagaagctgcaggaagctgcacagtcaggaagcgttgatggcgtcatcgaccctccatccccggtcagacgccacgtgaagtggaagatggcccgcacgaagaagataggggagatgacgaataaggccacaaaggaaatcgctgagaagattaatgccatgtaccactgtgtgttttctgtgcatgattcgtttgaggagcaggccacacaaggatcattcgtcccccatggacgtcaagatgttctggccgctgctattggacatccagagcaccctggacgtgtccatgctgctggagccggtgtcaccatcaagcaatactttggatcggctccatggacgtcccacagcgcttcctccctacctcctgacgaattacagcagctaacccagcagatcagggaccagctagaggagtccatcacagagaaagtgacgaggcagggacttgcagtgcctcctaagcctctggttggtcctggtccctctggtcctcgagtgagcacaaaggggagttgtgttgatccctcaggaaacgatcctgagacgggtgactctgacaggtgcggcttgtacatagaagcagatcctgtccgcctggttgccatggggagagtttatgagggatccactcttgttcataacactcctttgttgtctggccaggcacttcacaccttccttgcttggccgacacatctggtcaagtctttatcacagcag

SEQ ID NO: 27339 - DNA, 246 bp, Glycine max
  Peptide Sequence Number=SeqID_119024
agttttctgcctttgctctgttttgttggctgtgagtagcttgtgctgtttgaattctattttccttggatgttgtggaagcttgggaggaaaccttgatggggaggggaatggtgggtttatgcgcgcatttgtggatgtggaaaacttgttgtgcaccatcgcccgaccgccacctagtaccacatgtgatggagtggtacctggagatatgtcgcgggggtcaggagaccttggggacgtcag

SEQ ID NO: 27340 - DNA, 270 bp, Glycine max
  Peptide Sequence Number=SeqID_119025
gtccaagtgatcgaggtgacgtcatccgaggaagaccctgaggaggatcccgaggagctacctcttgagcctgctgtggatgctcttgactttctagagggtgatgaggacccacttcctgaggtggattctcccgaggaagtcatgtcggcatctgaggcagactctacggaggatagtggcccgagagagatgccaccactatggaaaaagagtgagtctttgagagttggaaggccaaatctggatttagtggtatttggaggttag

SEQ ID NO: 27341 - DNA, 351 bp, Glycine max
  Peptide Sequence Number=SeqID_119026
ggatcgcacccacaaagacacccagtgaacctgaagaagtccaacagggccctggggtttccagctctggttacgggcctctatcagtcccacagggtgcccggattgcgcctgcaagacacccagtggacccgaagaagtccaacagggtcttggagttgtcaagctctaattacgggtctctgtcagttctacggaggcgaaacaccacagcagcattgggatggccggtagcgggcaatagacacatcgccaccacctctagagttcacctcagctcatccgcaaaaaggttagagcgttgccgacgacacatggccgaccagcaggcgaccgagtccaaagccaaag

SEQ ID NO: 27342 - DNA, 258 bp, Glycine max
  Peptide Sequence Number=SeqID_119027
atgacaaattatccaccatggttactttctgtggctgctagcactcttgacagaaagctggttaccaaggtgcaattgggcaatggggcggtttatgagagttctgcagaagtggggtttttatctggagcagctggtgttatatttggatttaatttcccacaagaccgtagctcagcatatgccctgcctgctgtgttgcttagtcagtggaaccaaaggctaatactttcttacataacttcaaccaggtattga

SEQ ID NO: 27343 - DNA, 1083 bp, Glycine max
  Peptide Sequence Number=SeqID_119028
atggggcctctccaaaggcaagccttccgcaaagtgtacgggaagattctagatttggccacagcggaggtatttacggaagctgtcgtatccctcgcccaatactatgaccagccgttgaggtgtttcacgtttggggacttccaaatggtaccaactattgaagagtttgaggagatattaggatgccctcttggggggagaaaaccgtatcttttctccggctttcttccttccttgagcaagattgcagctgtgattggagattcagcaaaagagttggatcgcatgaaacaaactcgcaatggaatagtgggcctgccacggaaatacttggaaggcaaggcaagggatatggcgagccaagagaagtggggcccgtttgcggatattttagctttgctgatttttggggttgtcctctttccgaacgttgacggtttggtagacttatccgccattgatgctttcctcgcatatcaccatagcaaggaaagtctagtggtggctatcttggcagatttgtttgacacctttgaccgaaggtgtgagaaaaacagtgcacggattgtctgttgtttacccgctctctgtgtgtggttgatttcacacctattccaacaagacacgagacacccgtgtccgcttcaaagttatcgctcatgcgccgaaaaaggaagagtcgattgggaccaacatttggctgggatagggggcagcgcaatcaattggtttcctcgatggaaggaaggcaaggagggagtccttttctcaagtggggactaccctaacgttccgttgttagggacaaggggttgcattaactataatcccgcacttgccataagacagttagggtacccaatgaggggagcgccaacagaggagagtctctcgcctctccttgtgagggatctaggtgcgcaaagtctcaaggttatacaaagagtccacaaggcgtggagaagtccgttgaggaaagacaaggagcttaggggcatccgtaatggcgtcatcggtggttatcatggatggctaagagttcacacgcgagggttagattggctctccaagttgaaagtt

SEQ ID NO: 27344 - DNA, 600 bp, Glycine max
  Peptide Sequence Number=SeqID_119029
atggtggaggtctccacagaggccattgcctccctcgcccaatattatgaccagtctttgaggtgcttcacctttggggacttccagttaacacccacgatggaagagtttgaagagatcctgggatgccctctgggaggaaggaaaccgtatcttttcttaggcttctatccctccttggctagaatttccaaactagtcagaatctcgacacaggaattggaccacggaaagcaagtcgaaaatggggtggttggagtaccaaggaaatgtttggaagcaaaggtgagaaccttggcaagtcaagacgaatgggccccgttcatggacgtcctgacactcttgatcttcagggtggtcctctttccaaatgtggatgggttggtggaccgggcagcgattgatgcttttctcgccttttacaaccgtaaggaaagcccggttgtcgctatcttagctgatctatatgacacattcgaccgaagatgtgagaagaacaatgcaaggatcatttgctgtacaccggccctctatgtatggttggtttcacacctttttcgccaagaggtgagacacgtttgcccgctaaaaggccattga

SEQ ID NO: 27345 - DNA, 300 bp, Glycine max
  Peptide Sequence Number=SeqID_119030
gacagagagcttaggggaagcagtaatgggatcatcggcggctatcataagtggctgagagtccggacacaaggattggattggctcccaaatctaaagactgtgagagacgatgaggttaaagcttcggaagaaagtgatgaggtacaagccctaaaggcagagcttgaaagagcccgggtagtcgaagagaagttcaagtccatagccatcaaactgaagccttggaacgaagaggtgaaaggaatcatcacgggtcaaaggcatgatcttgaaggacgagctaacggcttgccttag

SEQ ID NO: 27346 - DNA, 276 bp, Glycine max
  Peptide Sequence Number=SeqID_119031
atgactctaagacaacatggatcaaatagaggaagcaaaagaacatcacctagagaagatgctctgataccacatgatgcaagctccattggagcttgtaggcctaggatcttcttcatcaatggattcctttgcttcttggaagatgaatggcagcggaaatggagaaggagagagagaggagaagccacttcaaggagaaagatgagtctagaagaagctcaccaccataggaggccatggataaagagcttggaggaagaaggagatgaatga

SEQ ID NO: 27347 - DNA, 163 bp, Glycine max
  Peptide Sequence Number=SeqID_119032
ggcgaggctcacgggtgcgctttccaaaggaggaaagatgcacggagtcgccaccaacgtcgacaaaagcggggcttttgctcctacgtaccctcctttggagaggaaatcagacctacgtagttctttcttaagtgtgaatcaagcgattcttttactttga

SEQ ID NO: 27348 - DNA, 567 bp, Glycine max
  Peptide Sequence Number=SeqID_119033
atgaattcctcctccatttatattcttgtctttgtccagctttggttgttgagcttaccatgcagagagagtgtgtgcatcccaagtgagcgtgagacacttttgaagtttaagaataatctcatagatccttccaataggctttggtcttggaatcataatcataccaactgttgccactggtatggagtcctctgccacaaccttacttcccatcttcttcagcttcacctcagctcttcagattatgctttctacgatgaggaagcttatcggagatggagctttggtggagagataagtccttgtttggctgatttaaagcatttgaattacttggacttgagcggcaattatttccttggagaaggtatgtcaattccttctttccttgggacaatgacttccttgactcacctcgacctctctcatagtggattctatgggatgattcctcctcagattgggaatctctcaaatttggtgtatcttgacctgagatctgttgccaacggaacagtaccctctcagatcgggatctctctaagcttcgatatcttgacttga

SEQ ID NO: 27349 - DNA, 116 bp, Glycine max
  Peptide Sequence Number=SeqID_119034
gatcccccgtcttctttatctcgacgaaatgggtggaatggctatcccaatgccaaaaatattcacggttttcactatcttatcgatggcttctcttgcattgccgggcatgagcg

SEQ ID NO: 27350 - DNA, 689 bp, Glycine max
  Peptide Sequence Number=SeqID_119035
atgggggattcacaagaaaataacaaaggaaagagtagagacaaagataattatgtatcttggactatggaggataccaatgagttgttgcacctcttggtggatgctatgaataggggattgcgtgatgccaatgggtcacttagcaaacaaaatgtagaacgaataatacttcctcaactcaatgcaaaaactaaattccctaaaacttatagtcattatttgagtcggatgaagtggtttcgaaaccagtataacatgatgtcaacccttatgcgcaacaactctggctttggatgggacccaattggaaaaactttcactgctcatgaggatgtatggaaagattacttaaagtcccacccaagtcacagcaaacttcgaggaaaaagtatggttgattatgagtatttgaagatcgttgttgggggtggagtttctagcgggaataattctatatcagtcgatccagatgatactgatgcaacaacttttgagccagaaaatagaattgttgggatagaagaattttcatatgatcctaatagtgatacattcataacaccaaataactatgaaccagcatatcagcctccatcaccaaaccaaccaagtccaccatcccacccccctttagattcagaggttcccatagaaaaacaaaactgtcacaagcgaaggagatccga

SEQ ID NO: 27351 - DNA, 448 bp, Glycine max
  Peptide Sequence Number=SeqID_119036
ggacaccaggatttatttattctgcgaagtgatctccgtcacaggtatttattcggcgcaaagtgcgtcggctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttccccagtcacgacgttgtaaaacgacggccagaattcgatgcgtcttgggcaacgatgtgttctgcgatggctgcttcaatgcggcccatagtggatgtggaacaagagaagtcagccattgcctctcaaagagagcatcaaatgttatga

SEQ ID NO: 27352 - DNA, 369 bp, Glycine max
  Peptide Sequence Number=SeqID_119037
atggcaaggaaagcccggtcatcgccattttggccatgtatgacacgttcgactggggatgtgaaaggagcagcgcaagaattgtttgttgtgcactggctctctatgtgtggctggtttcacacccttttctccaagaaggtaggcccgtctatccgctacaaggtcaccgctcgatgtccaaatgttctcttgatgggaacaaggggttgtattaattataatcccgtcctcgccataagacagcttggctaccccatgagaggagtgccatcagacgaaagcatcacgcctttcatcgcacggggtttcagtgaccacaacgcgagggtactccaaggagttcgcaaggcatgggatgcggcgtga

SEQ ID NO: 27353 - DNA, 168 bp, Glycine max
  Peptide Sequence Number=SeqID_119038
atgggaatcgggatggcatggttgcacaaaacttggcgggtattgagggaactcctcttctattgtggccacctcctcctcgaacaccattccggcactggcgaaacactggctaatacggccgaaataggaatagtgggggcaagatacgcgggttggactaattaa

SEQ ID NO: 27354 - DNA, 133 bp, Glycine max
  Peptide Sequence Number=SeqID_119039
atgaaggattctttgaagagaagttggtacattgatagcggatgctttaaacacatgacaagagatacatcaaagtttactcatatttctcccaagaatagtggacatgagacttctggtgacaacaacaaag

SEQ ID NO: 27355 - DNA, 135 bp, Glycine max
  Peptide Sequence Number=SeqID_119040
atgatattagaggacaagttgaaggcttgtcaaagggcattggatagaagactccaagaagattgggccaaagatgcaagagaaggccctagggttctcatgagccttagggtagatttcgggcctatgaactaa

SEQ ID NO: 27356 - DNA, 279 bp, Glycine max
  Peptide Sequence Number=SeqID_119041
atggtgaaagttggaacctcttacgtgcccgatcaacgtctcattttcgccaaaaagttggcccagggcttccccggtatcaacagggacacccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 27357 - DNA, 371 bp, Glycine max
  Peptide Sequence Number=SeqID_119042
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtgcaggagaaaaaggctgcaccg

SEQ ID NO: 27358 - DNA, 443 bp, Glycine max
  Peptide Sequence Number=SeqID_119043
atgcctttcttcgttcatggttcgatattctggtgtcctaggcgtagaggaaccacaccaatccatcccgaacttggtgtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatgggcttacgaacgggggcggagatttcctggaagatgcccaggaagatacttaacagggaa

SEQ ID NO: 27359 - DNA, 156 bp, Glycine max
  Peptide Sequence Number=SeqID_119044
atgggcccgaaatctaccctaaggctcatgagaaccctagggccttctcttgcatctcgggctcaatcttcttggcgtcttctatccaatgtccttgcgggatttgtaagctgtggggctgagaacctatacaacaacaccaaggttttagtttga

SEQ ID NO: 27360 - DNA, 702 bp, Glycine max
  Peptide Sequence Number=SeqID_119045
atggtaagccaagagaagtgggacccgtttgcggatatattagctttgttgatttttggggttgtcctctttctgaacgttgacggtttggtagacttagccgccattgatgctttcctcgcatatcaccatagcaaggaaagtccagtggtggctatcttggcagatttgtttgacacctttgaccggaggtgtgagaaaaacagtgcacggattgtctgttgtttacccgctctctgtgtgtggttgatttcacacctattccaacaagacacgagacacccgtgtccgcttcaaagctatcgctcatgcgccgaaaaaggaagagtcgattgggaccaacatttggctgggatagggggcagcgcgatcaattggtttcctcgttggaaggaaggacgcgcaaagtctcaaggtgatacaaagagtccacaaggcgtgagaagtccattgaagaaagacaaggagcttagaggcatccgaaatggcgtcatcggaggttatcatggatggctaagaattcacacgcgagagttagattggctctccaagttgaaagttgtcgatgagaactttgaagctccggaggaagatgaagaagtccaagctctaaaattagagctagggaaggcgggactcgccaaggagaagttcaaatcagccgctacaaacatcccggaaagagtgcaccgagttacatga

SEQ ID NO: 27361 - DNA, 663 bp, Glycine max
  Peptide Sequence Number=SeqID_119046
atgtctatttggcaaatgggtttcatctgcggcattgtcttcgcgcttcgtagggagatgacaatgtttttggtttttgattgtgtcttcgcggtttttgacaatgtcaatgtcttcgcgctttttgaggtaggaagattcactccacgtgccagtgatggaaaggttgaatatataggcggagaatttgacgtttgggaggatatatctgcagattgcctgaatgcatttatcttatatgatctggtgaaagcttgtaagaagtatagtaatataggagaatgtttttggttgattgataaggacttagattttaatcatgggttaaggagttgtacaactgatggagatatattacacttagttagggatgcttttgaaaatgagaatgagataaatgtttattttcatcatgaagtagatccaattttagaagaagtcccacaaatgttgtacttggaatgtgatccaattcgaaaagctgttgagaatgaggatgatttagatgatgtacctgttgctggccatgaggaagatgttggtgctggagagcagacagatgctggtgagcagatggatgctggtaagcagagggatggtggtgagcagagggatactgatgctggtgagcaaacagatggtagtgagcagacgggatactga

SEQ ID NO: 27362 - DNA, 818 bp, Glycine max
  Peptide Sequence Number=SeqID_119047
gggagcgccaacagaagaaagtctctcgcctttccttgtgagggatctaggcgcgcaaagtctcaaggtgatacaaagagtccacaaggtgtggagaagtccgttgaggaaagacaaggagcttagagacatccgaaatggcgtcatcggtggttatcatggatggctaagagttcacacgcgagggttagattggctctccaagttgaaagttatcgatgaggagaacttcgaagctccggaggaagatgaagaagtccgagctctaaaattagagctagggaaggcaagactcgccaaggagaagttcaaatcagccgctacacacatccggaaagagtgcaccgagttacaagaggaaaacgcggtcactgcaagagcccttgaacaagaaaccaaagggaccgcaaggaggaacatggccgagagaaatttcgaggagcattgtggggtagcaacaatgagctcaagctccgaagagaggaaagacaccgggcacgggtccaagaggagtttggcccaacacttggaagccacagagcaaagcatgctagctatcatagggcagtacaaggaagagttgaaccagtctgtgacccatgaacaagagctagtggaggagtttgcacaagtgtacgccgaaaaagaagcaagagggagggtgattgatgcattgcatcaggaagcgactatatggatggataggttcaccttgaccttgaatggaagtcaagacctcccgcgtctattagccaaagcaaaagccatggccgaagtctatacggcccccgaggagattcatgggctaatcaattact

SEQ ID NO: 27363 - DNA, 120 bp, Glycine max
  Peptide Sequence Number=SeqID_119048
atggacaaattgcttttcttaggaacacatattcgttaccacaaaaaggataatggcaaagatgagcctccgtcggaaaggagattccgatcgcattttgagactccagccacggattag

SEQ ID NO: 27364 - DNA, 156 bp, Glycine max
  Peptide Sequence Number=SeqID_119049
atggcagaaatcaaccaaggtacggatgcaagtggggatggggtcacgaccgaccaatcgttgccccttcccggtgctaaacaagcagagaacatcgctgcaaggcagcccagtatcctttgtggttgcagtttcttttactattgtttgttttaa

SEQ ID NO: 27365 - DNA, 263 bp, Glycine max
  Peptide Sequence Number=SeqID_119050
gatgtttctactctatagcagttggaggattgagatgctatgagaatccaaagaataagattgttgcaatacctgctaaggaagaggaaatccggggtgcattcttcaagaacagagaatcagtgatcagtcccaacagtaatataaggttaatgtcaattgagactgcattaggtacaaagggaaaatgtgaggtaattttagagcttaagaagttagagttgaatatccattatgtaactaggattgccaattgcaactaa

SEQ ID NO: 27366 - DNA, 285 bp, Glycine max
  Peptide Sequence Number=SeqID_119051
atggaatacttaagctctgattatatagagaagtcagaaaccattgacagttggcatttccaatcaatcacaactgaatttctcaattcactaaacacatctggtctgccaaatcatcgtatcaagctaaaaatcgatagtcctataatgttgctaagaaacttagaccaaacgcaaggactctgtaatgctgaaatcatttctggcaaaaatgttggtgataatgtttacatcccaagaatgtcaatgtcaccttcacaatcaccatgcctttcaagcttttaa

SEQ ID NO: 27367 - DNA, 427 bp, Glycine max
  Peptide Sequence Number=SeqID_119052
atgggtcaactccaacggcaagctttccgcaaagcctatgtcaaaatctcggcgcaggaattagggaaccaaatcgaaaatggagtggttggagtaccaaggaagtgtttggaagaaaaggcaagagccttggcgagtcaagacgaatgggctcctttcattgatgtcctggcactcttgatcttcggagttgtcctctttccaaatgtggatggattagtggacctagcggcgattgacgctttccttgccttttacgatagcagggaaagcccgatcgtcactatcttagccgacttatacgacacattcgatcatagatgtgagaagagtagcgcaaggattgcttgctacacaccggccctctacgtgtggttggtctcacaccttttccgccaagggggaagacacgtttgccctctaaaag

SEQ ID NO: 27368 - DNA, 300 bp, Glycine max
  Peptide Sequence Number=SeqID_119053
atgttggaccttgtacttaagggccaagcatttttcgatggaatgccccggggtattcccatgatcttctcgggagttattacagccatttggttggcgataaaggactgcaagaggtcttcgtacgtcattgggagtggggtgaattctggaattggcttcgggggaaagttcctcattgcgttggaattgtcggctgggcgagtcgtggttggagccggaacttggggggcctccctctggatgggtgccttaggctacacgggtgctgaaattggaggagttcccggcgcgagctga

SEQ ID NO: 27369 - DNA, 842 bp, Glycine max
  Peptide Sequence Number=SeqID_119054
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgattcaggctcatttgaacataaaaggcagagggaaccctttgttcaaaaaagcaactttgtcaagagtaagcagcctgttccttttagcaagccatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 27370 - DNA, 480 bp, Glycine max
  Peptide Sequence Number=SeqID_119055
atggaaccaattgcctccctcgcccagtattatgatcagccgttgaggtgcttcatctttgggggcttccagctatcaccaatggtggaagaatttgaagagatcctaggatgtcctctagggggaaggaaaccatacctcttctcagggttctacccctcattggccagaatttctaaaaaggtccaaatctcggcgcaggaattagaccgccaaaggcaagtcgaaaatggggtggtcggaatactgagaaaatatttggagccgacctatatgacaccttcgaccgaagatgtgaagaaagcaatgcaaggattgtttgctgtaccccagctctctatgtggggctggtttcacacctttttctccaaaggtaggcccgtctatccgctacaaggttaccgctcgtgcgtcgaaaaggaaaggcaaattgggaccactctggctagcatgggggcgtctgttatggtccctcgctag

SEQ ID NO: 27371 - DNA, 399 bp, Glycine max
  Peptide Sequence Number=SeqID_119056
atggaaaggaaaatgatagcaataatagtagacacattacctgtgttctactatgagaagatggtgggttacatgccttcaagctttgcagatttagtgtttgttggcgagaggatcgaagaagcctgggcaaatggagagaataagaaggagggagaaacccatgctgtgactaccgttcctacatggccaaattttgcagtagctcaacaatatcaatactcaaccaatatcaatccttctcattatccaccaccctaccagccaagaacacccaatcatccacaaaggccgcccctaaatcagccacaaaaccctcatgttgcacatccgaggccaaacaccacccttaatacgaaccaaaacaccaaccatggaaggaattttccagaaaaataa

SEQ ID NO: 27372 - DNA, 285 bp, Glycine max
  Peptide Sequence Number=SeqID_119057
atgaaggataatgggagcgaaattggccgtgttatccacgaggatatcgatgtgtggcaaaggaaaattgtccttgggactggcccgattcaggtcccgataatccacacacattcgtaccttcccatctttcttagggaccggatgtttcgggcttcatccttctcagtttctgctttaccggggaacactcgggatttagaggtaatcggtgctgtacaaggtcagaactcaaaccgggcatatcttggtatgaccaagcaaagatgtcttggtagtctttag

SEQ ID NO: 27373 - DNA, 453 bp, Glycine max
  Peptide Sequence Number=SeqID_119058
atgacaaaatacgccctggtcggcgatgtgggcggcactaacgctcgtctcgccttgtgtgaggtggagaccggcgccatctcccaggccaaaacattctcaacatcagactacgacaaccttgaagcagttatccgtcactatctggatgagcaaaaacaggacattaccgacggctgcatcgccatcgcctgtccaatcaccggcgactgggtggagatgaccaaccatgactgggccttctcaacgcgtcagatgaaggaaagtctgggctttactacgctggaaatcatcaacgatttcaccgcggtttccatggcgattccaatgctgacggcgcaggacgtactgcagttcggcggcaaatcgccggtgcaggataaaccgattgccatttacggtgctggcaccgggctcggcgtcagccatctggtgcacgttgataagcgctgg

SEQ ID NO: 27374 - DNA, 399 bp, Glycine max
  Peptide Sequence Number=SeqID_119059
gcaagttccttgacttcatgatcacacactgggggattgaagccaaccctgataaatgcactactatactggagatgtgcaaccccaacagcatccaagaagtccagaagctgaataacttgaaaacaagccttcctggatttcaagaagatcatagccacatcgctaattttgagttgacccaggccatgagtacccctactcctatatctcttagtggtactagcacttattacctcaacccgacgactcaagccctacttcctgagtcatcaagtgagttcaacatccagtacgaaccacgtggccccatgaagacacaattcacgactgactttttgacagaattcgctggaaacaacacaaccacctcatatgggtggaccctttatgttggca

SEQ ID NO: 27375 - DNA, 280 bp, Glycine max
  Peptide Sequence Number=SeqID_119060
tgctctgtttctatcagctgtccctcctgttcagctactgacggggtggcgcgtcccattcgccattcaggctgcgcaactgttgggaagggcgatcggtgcgggcctcttcgctattacgccagctggcgaaagggggatgtgctgcaaggcgattaagttgggtcacgccatggcggtttgcgtattggcgctagcggagtgtatactggcttactatgttggcactgatgagggtgtcagtgaagtgcttcatgtggcaggagaaaaagctgcaccg

SEQ ID NO: 27376 - DNA, 270 bp, Glycine max
  Peptide Sequence Number=SeqID_119061
atggcggtgcgtctgttgcccgctgccgaccatccccaggctgctgtggtgtttcgccttgcgcctgcctgggatgcagtacttcttgatgaaagctcgattagtagggggcctgatgcccttgctggaggactgatagaggcccgtaaccagagctggaaaccccagggccctgttggacttttccgggtccactgggtgtcttgtggaccaactgatccttccgcagggggagatcggcattacgatgactgggcagaatgttgctaa

SEQ ID NO: 27377 - DNA, 295 bp, Glycine max
  Peptide Sequence Number=SeqID_119062
gcctcatggtcacgccccgcagccccgagtcgtccctcatgccccgcagacggatatccctcacgtgctggagtcaggagcatcgtcgacatctgcggaggagcctagacatacagtggaagtttgtgatgacattgctgagaggttggagcgccatctgagtcaaggggtggtcacgccaggctcatcgacacatgaggtgatcgaagaatgcctcaggttggccaggagtgtgacacagcaccatctagtatatgttaggtctagacgcaggcggcgcacggatcagacgtag

SEQ ID NO: 27378 - DNA, 189 bp, Glycine max
  Peptide Sequence Number=SeqID_119063
atggaaatttatgtgagtgatcgactagaaaaaagtgtatgtgatgacaaaaagctcaaaggtcaatcaaagaatgagttcaagatgttcaagatggaatcaagaacacttcaacattcaagaggaaagttgatttcaagaatcaagaatcaagattcaaggatcaagcttccaagaatcaagctctag

SEQ ID NO: 27379 - DNA, 360 bp, Glycine max
  Peptide Sequence Number=SeqID_119064
atgatgataacaaaagatgatgacataggtgatgacaaaaagctcaaagatcaatcaaagaacaactcaagtgaatcaaagttcaatcaaagaacaactcaaatgtcgtacaggatgtcacgacatcacgcttcagaacatgcagattatattttgacaggtaacatcaaggtggctcacaaaacactcaagtcccaaacctcacaaaataactcttcaatcccggacttggtagaaaactcgtgcagccttcatgtttatatagcagtgtgcgtatctgggctgcaacaacttgtgctggataagatctatcattctcctgaaaaatctgcacttaaagatctgaaagataaagtttga

SEQ ID NO: 27380 - DNA, 1197 bp, Glycine max
  misc_feature (1047)..(1047): n is a, c, g, or t
  Peptide Sequence Number=SeqID_119065
aattgcaactgtggtcaaggattcagcaagaggtttggaccgcataaaacagactcggaacagcatagcgggcctaccacgggggtacctagaagacaaggcgaggggtatggccaatcaaggagattgggtcacgtttatggatgtgttagctttgctaatttttgggatcgtcctctttccaaacgtggatggtttggtggacctagcagcaatcgacgctttccttgcataccaccatagcaaggaaagtccggtggtagctgtcttggcagatctatttgacacatttgaccgaagaatagattgggaccagctcttggctgggataggaggtagaacaatcaattggttcccccaatggaaggaaggaaaagaaggagtccttttctcatgtggaggatacccaaacattccgctggtaggaacgaggggttgtattaactacaatcccgcgctcgctataagacaactagggtaccccatgaggggagcaccgatggaagaaagcatgtctcctttgcttcttaggggcattcgtaatggcatcattggtgggtaccacgaatggctgaaagttcatatacgaggtttagattggctcgccaagttaaaagtcgtcagcgaagagagttttgaagcaccggaagaggacgaagaagtccaagctctcaaaagcgagttaggaaaggcaaaacttgccaaggagaagttcaagttggccgctacacacattcggaaggagtgtgccgggttacgggaagagaatgcaattaccgcaagagcccttgaacaagagaccaagagggctcgcaaggaagagtatggccggaataaatttcgcggagctctatggggtaacaatagtgaactcaagctgcgaagggaagagagggaccagtcgcgagcacatagcatggttctgaaagaggagttagttgcttgttcaaggtccaaaagaagcttgtctcagcgtttatgcgagacggagaccaacatgctagctatcatcgccaagtaccaagaagagttaggtctagccacggnccacgaacatagaatcgcagacgagtatgctcaagtatacgcggaaaaagaggctagaggaagggtgatcgactctttacaccaagaggcaaccatgtggatggatcggtttgctcttaccttgaacgggagtcaagaacttccccgctt

SEQ ID NO: 27381 - DNA, 180 bp, Glycine max
  Peptide Sequence Number=SeqID_119066
atgtttgatgataacaatgatgatacaaaaggtgatgacaaaaagctcaaagaagaaatcaagaacaaatttaagactcaagaggaaaatttgaagaacacttcaagattcaagaagaaggataaattcaagaatcaagattcaaggatcaagcttcaagaatcaagattcaagatttaa

SEQ ID NO: 27382 - DNA, 159 bp, Glycine max
  Peptide Sequence Number=SeqID_119067
atggtcctcctggttggacattcagaagcaatatgtcctttgcctacgcatttgaagcattttatgtttctggttccagtattggatgaggaagtggaggtgttatgtttgcttccacctacactggacgctgctgactttctatgtggggatgttgct

SEQ ID NO: 27383 - DNA, 867 bp, Glycine max
  Peptide Sequence Number=SeqID_119068
atgggagtgatgctaattactctattcctctttatagctgcaacagttgcagaagatgctgataatattggtgaagccattattcccgagaaccctaaattcaaaaagtttgtgacagattgcacatcgcatgttgctgaaagatgtagtagtggaagcgaagcattgcatggcgagggagggacttgtctcaatgctcctaatgttgctacatcacctttagccgcttgtctcattccatccatgaatcaatgtgtctatcccagtggagctgaatccggtactggtcaagttaaagaagaaacagaaggaggaaaagagaataggaagaaattattggagagattcagttctgatatcgggtataaactgggaaaatcaaagaagggagttcctattctactttggggtgaagcatgtttcaaacatttggttgctccatttggtacgctgctagcgggtcctcatcaaggtgggaagacacatgatgatgaggggaaggaggggatgcaagcagttaatcaatcaatagctctcttgtgtttatggggtccggccttcttggaaatttcatatcacttatgggacaagaatgcattgcttttaagggatgttggaaagagaatggggtggctattaccattggcaatgtctatattcctttcggcaatggacaaaaaagaagagtgtggggggagcttaggaggagaaataagacaagaggggaaagggacaaatttaacaacatctttgtacaagaatgaagcttgtagatattcctatggtgatatgaaccttcattgcacaaacgttgacttaggatcgtctaggattaaaccttcatggaaaatgcggaaaattgattaa

SEQ ID NO: 27384 - DNA, 261 bp, Glycine max
  Peptide Sequence Number=SeqID_119069
atggataagtggcaaagacgatctccacaaacacgatctccacattgtggttgcagtcatggaagcgcaggcgactttgacacaaggagaaagaagaagaacgatagggttcaagcgcaaggagaaagaagaagaacgatagggttcaagcgtgggttgtgcaatttcagaatgagccagcatataatgagttccatgctggagatggagaggcttagtcgttgccagggaaatgctcttaaatgtgacatcagggcatga

SEQ ID NO: 27385 - DNA, 522 bp, Glycine max
  Peptide Sequence Number=SeqID_119070
atggcacgcagagacaaattatggttattctgcacccttttgtcatccagaggcggcgggcccgatgacatgcggagacaaaatttggtcattccgcacccctttgccattcagacacagtcgtgtccgatggcacgcagagacaaattatggccattctgcacccttttgtcatccagaggcggcgggcccgatgacatgcggagacaaaatttggtcattccgcacccctttgttattcagacacagtcgtgtccgatagcacgcagagacaaattatggtcattctgcacccttttgtcatccagaggtggcgggcccgatgacatgcggagacaaaatttggtcattccgcacccctttgccattcagacacagtcgtgtccgatggcacgcagagacaaattatggtcattttgcacccttttgtcatccagaggcggcgggcccgatgacacgcggagatttacatcatcttccgtacttacaaggtctgtcatactgacttttgagtcacgctga

SEQ ID NO: 27386 - DNA, 192 bp, Glycine max
  Peptide Sequence Number=SeqID_119071
atgaagggaaaccaacaaaaggtccccagtggagtcgccaactgtcgcaacctacccttcggcgggagggcgacgcgtgactcgcgggatgcgtgttccacgaaaggaatacgcgcggagtcgccaccaacgtttattgaggaaaacgtcggaaaaaccggaaaagacgcgatctacgaactttttaagtga

SEQ ID NO: 27387 - DNA, 681 bp, Glycine max
  Peptide Sequence Number=SeqID_119072
atgaaagataagagtgatgaggaagaaaaactagaaaaccaaaagaaaaagacggatagtaaggccttgtcttcaaaggccaaggggaaggaaaaagaggaaaaggattcctccaagaagattgttaagaaggaaaatcattttgcaacaaaatgtgatatcaaaagagcactccttcttaaacaatctttctaccttctcctatcaagggaaacatcccttagcaccgccatacctcttgagcttgaggttattcctcaagtaaaggagttgttggatgagggtttggtttgtaagagcttaaatccttgtgctttgttggtgcccaaaataagtattatgaggcaccaaatccctatgataggcggtatgatgaatgtgttgagtggtgcaaccctcttttgtaaaatcactcatgcacccaacatctttatgatttgtgtacatagggattcattaggtagtgatcaagggcttcccatggaccctaagagaataaaggtcattcctgagtggcctactccgccaagtgttgaggaaaaaatccatgagtttcaagaacctatggatttgaggtcaaatcattttcaagggagagggaatgaggcaatactactccccaagggcattggattgaagactccaagaagattgggacatagatgcaagagaaggccctag

SEQ ID NO: 27388 - DNA, 168 bp, Glycine max
  Peptide Sequence Number=SeqID_119073
atgaagcgtgcactgattaatattcacgaatttgggataactgccttttgcactcctgggcaaaatgaaacaaagaacaaaatccaaggatatcaaagggagacaaacaaaaacattcacatatttctcaatgaacatcaaggaatgaaaggaatgggtaacatctaa

SEQ ID NO: 27389 - DNA, 336 bp, Glycine max
  Peptide Sequence Number=SeqID_119074
atgccaatctccccctgcaagagtatcagttggtctgtgtcgtcccgacatggggatcgcacccacaagacacccagtggacccggaaaagtccaacagggccctggggtttccagctctggttacgggcctctatcagtcctacagggtgcccgtacccccccggcaaggttatgtcagttggtctgtgtcgtcccgacatggggatcgcacccacaagacacccagtggacccggaaaagtccaacagggccctggggtttccagctctggttacgggcctctatcagtcctacagggtgcccgtacccccccggcaaggttatgtcatcatag

SEQ ID NO: 27390 - DNA, 331 bp, Glycine max
  Peptide Sequence Number=SeqID_119075
atggtggttgcggaggaacgagaagatgagcaactctttgtcgcaacatgctttgccacaagcaatagttccagtgattcattgttaatagacagcggctgcacaaatcatatgaccaatgacctgaacctctttaaagaacttgacaaaaccattgtttccaaagagaagcaaatagctttttcaagcatgaccaccaatgttgaactatggcacaaaagactcggacacttccatcttgctggacttttatacatgcaaaaacatgccttggtgaaaggtgtgtcaatgcttgaagacaagttagccgattgcatggcttgccaatatg

SEQ ID NO: 27391 - DNA, 114 bp, Glycine max
  Peptide Sequence Number=SeqID_119076
atggaggagaaggtaaagctgaaaattaatgaaggtctttacaatggtgatttttcagcaggattattagtggaagataaaggagaagaggtgagaggaggcaccatccactag

SEQ ID NO: 27392 - DNA, 396 bp, Glycine max
  Peptide Sequence Number=SeqID_119077
atggccaagtttgatccagacatagtcctcgaattttatgccaatgcttggctaacagaggagggcgtgcgtgatatgaggtcctgggtgaggggtcagtggatcccgttcgatgcagatgctatcggccagctcctgggatatcctttagtgctggaagagggccaggagtgcgagtatggccagaggaggaaccggtctaatgggttcgatgaggaggccatcgcccagttgctatgtatgggcgcctaccagggcaccctctggacccagataaagtccaacagggccctgggatttcccgccttgatcacagggactctgccaagtcggtcgggcgtccccgtcaccactagcaaggtggattcggccacccatcacccgagcttttattga

SEQ ID NO: 27393 - DNA, 252 bp, Glycine max
  Peptide Sequence Number=SeqID_119078
atggcttacacccacattccgggacacctaacaacagctttcaaaattgccccatgtgtggcatctcttgtcaatgtcaggatttacacgcaattctcctcaatttcagccagcccgcatcaattagaccttgcaccttacgcttcagagccctaccatgctcaatggaacgccccgggcttgctccgtgacaagcacacgttgcgttcgagtcgtatctcggagaaatggaggttgatgaaccttggctag

SEQ ID NO: 27394 - DNA, 318 bp, Glycine max
  Peptide Sequence Number=SeqID_119079
atgcacacacaaagcttcacaaatccacaattccttaaaataggcctaactcacaaaaagtccccagtggagtcgccaactgtcgcaacgtgcccttcgcgggcgagcggggcggggtcacggtgcgctttccaaaggaggaaagatgcacggagtcgccaccaacgtttattcgtggaaaacgtcagaaaaccaaggaaaccggtcaaaatgaaaattctaagttcaggagttgtatttacgtttgaggaaggtcgacaaaagcggggctcttgctcctacgtaccctccatcgaagaggaaatcagacctacgtag

SEQ ID NO: 27395 - DNA, 390 bp, Glycine max
  Peptide Sequence Number=SeqID_119080
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaacccggaaagacatgcaaaagcaccactggcagcagccactggtaatgatttag

SEQ ID NO: 27396 - DNA, 234 bp, Glycine max
  Peptide Sequence Number=SeqID_119081
atggcggtgcgtctgttgcccgctgccggccatcccaatgctgatgtggcactccctagaactatgccacgacgacatgaacttgctggggggaacgggcgccctgtagggccgacagaggcccgtaaccagagctggaaaccccagggccctgttggacttcttcaggtccactgggtgtctttgtggggggagattggcattgcggtcactgggcagaatgttgctaagtag

SEQ ID NO: 27397 - DNA, 234 bp, Glycine max
  Peptide Sequence Number=SeqID_119082
atgaagatgaaagcaaacaaaacaagaaatgaattgaaagtctcggattcgaacaattactggttgaagaccgaagaacgaacgaggaacgaacgaagaacggtgaagaacggcggaaaatcttcacggatttgttcacggaaatgtctcggaagcgttacggaagctcctcggcttgaattttcttcatggagacacgtttttcacccaaaacagctgaaatgcatagcatag

SEQ ID NO: 27398 - DNA, 750 bp, Glycine max
  Peptide Sequence Number=SeqID_119083
atggtcattgaccagtcccttttccatgacttaaccaaattacccagtgacggtgtaccatttaaaggtacactgaatgacgactggaaatttgatttctctgcccatgatgcccgccagttggtttgcaccaacaatgcggatatgatcggacgtcttcttgccggatcattggcttttgaaagccgcatccttcactatttaattgtgcgtattctgcttccacggtcttccaaccttgcccaggtttctgaggaagatctaattatcatgtgggcctttcatacagggcgtcaacttgactgggcacacttaatcagatatcgcatgcataaggcattgcgattaaatgctccattaccatatccacggcttttcactctctttttctgccattttcaaattcctcttgattctgaaccttatgttccaatcaagcgatcttttttaattggtgctgctgtgattgcttcttttggttaccgcaaagagcgtgatggctcttggggtgttccacctgctgatgatgaaggccacataccagttgaagataattccactcttcttcaaaggcttatggacaagtttgatggacttcagacttttgttggtgacaagtttgatgccatggaattgcaagttgacatgcggttcgatgctatggaatcaaggatcactagggttgaagaagatgtctccttcatccgaacttgctttgatccaccaccaccgcctccttcatcctcttag

SEQ ID NO: 27399 - DNA, 430 bp, Glycine max
  Peptide Sequence Number=SeqID_119084
atggccaccgctgaagccttggaacgagaaaccaagaaggcccgaaaggaagaacacgaatcatcatgggtcaaaggcatgatcttgaaggacgagctaaaggcttaccttaggtcgaaaagaaatttgtcccaacagttaagcgagactgaagggaatatgtgggccgtcatcgatgagtgcaaagagaagctaaatctagcagcgactcacgagcaaaggctagaggatgagtacgccaagatatcagcagaaagcgaagcaagggagagggtaattgattcatggcaccaagaggcaacaatgtggacggaccgatttgctcttactttgaacaggagtcaagaacttccccgattgctagccaaggccaaagcaatggcggacacctactccgcccccaagaagatccacagacttctcagctatt

SEQ ID NO: 27400 - DNA, 492 bp, Glycine max
  Peptide Sequence Number=SeqID_119085
atgtccagacgagaaaaatactttgaagaggttgaagctcaaaaggaaagccttgtaaaagagcatgagtcaagagaaaaagataaggaacaagcacaacaacaatgggagaagtactcaacagtagaaaaccatcaagaaagtattctccaaatcaataaccatcctcatcaacaaattgacaagaaaagaaggaaaggagagcatgaggaaaccttaagtgccattctttctttaatcattaacacttctcttgaaatgatttggaatgtacttcctgactacatgaagttcatggaatttctagctaaaaagagaaactgcaaggaagatcgcaagcctcgcgctaagcgcatctttgttcatgcgctaagccgcgagtctcaagcgcttagtgcccaacccttgcatctgaggctgatttggtccgctgagctggccaaggttgagctaagccaacttcaattcgatctggatttggctaagcgatag

SEQ ID NO: 27401 - DNA, 354 bp, Glycine max
  Peptide Sequence Number=SeqID_119086
atgaattttgcagcgagaaagcctatagaattcaccccaattccaatgtcctatgctgacttgctcccatatctacttgataattcaatggtagccataaccccaaccaaggttcatcaacctccatttctccgagaatacgactcgaacgcaacgtgtgcttgtcacggagaagccccggggcattccattgagcattgtagggctctgaagcgtaaggattttcaaactttcactggaattgggtgcaagccattggtctatttgctcaagcgacctgtgctcctgagtttggacttccaagaccattcaatcaaagattactcgtcttgcacgttggtggggctgccgtaa

SEQ ID NO: 27402 - DNA, 182 bp, Glycine max
  Peptide Sequence Number=SeqID_119087
gtcaacacaggctctgcctgttgctttgatgattcatgataactcgtcggatcgcacggcctttgtgccggcgacgcatcattcaaatttctgccctatcaactttcgatggcgcgcaaattacccaatcctgacacggggaggtagtgacataaataacaataccgggctcattgagtctg

SEQ ID NO: 27403 - DNA, 360 bp, Glycine max
  Peptide Sequence Number=SeqID_119088
atggcttcgacaatggggttggttgaggatgtgtctgaggtccgcaactttgacaaggatatattgatgcttcctatgaaggttagtgataccattgatgaaacgacgacgactaatactactcttccggtggagcccaagaagatacccgtgttgaaggagaagattccccttcctcctattacccttccgagctatatgttggtggaagaggagtgtcatctccaatcatctttcttccttctccatgccactgtcattgatcttcaagtagcaaaggactccattgatgaagaagatccaaggcctacaagctccacatggtgctacatcatgtggtatcagagcatcttcatatag

SEQ ID NO: 27404 - DNA, 289 bp, Glycine max
  Peptide Sequence Number=SeqID_119089
tgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgcccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaa

SEQ ID NO: 27405 - DNA, 419 bp, Glycine max
  Peptide Sequence Number=SeqID_119090
tgtatgatggtgtttttgaggtgctccagtggcttctgtttctatcagctgtccctcctgttcagctactgacggggtggtgcgtaacggcaaaagccccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttccccagtcacgacgttgtaaaacgacggccagtgaattgtaatacgactcactatagggcgaattggagctccaccgcggtggcggccgctctagaactagtggatcccccgggctgcaggaattcgatggttctgctggcaggagttgagatatag

SEQ ID NO: 27406 - DNA, 75 bp, Glycine max
  Peptide Sequence Number=SeqID_119091
tgaagaacttcgtgactattataacggaaggcataagtcacatcttagaggaaatgcattcacgctaagcgaagg

SEQ ID NO: 27407 - DNA, 774 bp, Glycine max
  Peptide Sequence Number=SeqID_119092
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgtcaccggcatcctcacgcaactgctgccgggtgaactgaccgatcgctaccggttctccctggtcgacaagaacaacgtgatccgcgccagcacgtcgctgcgatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 27408 - DNA, 348 bp, Glycine max
  Peptide Sequence Number=SeqID_119093
atgcatatgacacagatgcaatttacgaatacgggagcccgagaaattgtccccttcttggatacaacgtttgggcagcatggcacccaacgtatgtttttaagaaggcgacacggaccctccgtcggtttgctaaaatccccagtggagtcgccaactgtcgcaacctacccttcggcgggagggcgacgcgtgactcgcgggatgcgtgttccacgaaaggaatacgcgcggagtagccaccaacgtttatttgaggaaaacgtcggaaaaaccggaaaagacgcgatctacgaacttttaagtggaaggctcgggagttgtatttacgcacggggaaggtattag

SEQ ID NO: 27409 - DNA, 806 bp, Glycine max
  Peptide Sequence Number=SeqID_119094
accatgtatgggggctgacgcctgcccagtgccggaaggtcaaggaagttggtgacctgatgacaggggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagtttcctcgggccagacggagattggccctcgagtgcaaaggcagaagggagcttgactgcaagacccacccgtcgagcagggacgaaagtcggccttagtgatccgacggtgccgagtggaaagggccgtcgctcaacggataaaagttactctagggataacaggctgatctccccaagagctcacatcgacgggaaggtttggcactcgatgtcggctctcgccacctggggctgtagtatgttccaagggttgggctgttcgcccattaaagcggtacgtgagctgggttcagaacgtcgtgagacagttcggtccatatccggtgtgggcgttagagcattgagaggacctttccctagtacgagaggaccgggaaggacgcacctctggtgtgccagttatcgtgcccacgagcctccggtagcacagccgagacagcgatgggttctctgccccagcggggatggagcgaaagaagttttgagaattcaagagaag

SEQ ID NO: 27410 - DNA, 537 bp, Glycine max
  Peptide Sequence Number=SeqID_119095
atggatgacttgctgctcagcaacatccagcccagcgatcataaatccaacctccccctgccgaagtgtcagctggtgtacgccatcctgacacggatgagcattcacgtggctcagttaatcgcagatgccatctatctatttgcaggtatggcgcctaccaggcaccctctggacccggataagtccaacaaggtcctgggatttccctccttgatcacaggactctgccagtcgttcggagtccccgtcgcacctagcaaggtgattcggccgcccatcacccgagcttttattgagaagtattgcatgcagagacaggcccaggggggtgctccgcaggccgcagacgcgccgccacctcatcaggctggcccagctggatcatttgatacggagcagtatttgcggcatttggttcgccagcaggtggccaaccaccgggcgcatcctccagagccagggttttacttcttttccgtgccctactccggatcagttcagggcagacgtcgcatggcccggagattggcctga

SEQ ID NO: 27411 - DNA, 386 bp, Glycine max
  Peptide Sequence Number=SeqID_119096
atgaccatgattacgccaagctcgaaattaaccctcactaaagggaacaaaagctgcggccgccaccgcggtggagctccaattcgccctatagtgagtcgtattacaattcactggccgtcgttttacaacgtcgtgactggggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgctttttgccgttacgcaccacccc

SEQ ID NO: 27412 - DNA, 231 bp, Glycine max
  Peptide Sequence Number=SeqID_119097
atgggggtgcaaatagcaactgaaattctgataccaatgacagatgtcgtaccggatgtcacgacatcacgcttcagaacatgcagattatatatgaccatttatgtgtccagtattttcgggcaggatgtcttggacatcgtatccgacatcgtggatcctgcagcttcaattcttcatttgacattttatcttgccttgtgcattgtgcaacccaatctgattccttga

SEQ ID NO: 27413 - DNA, 335 bp, Glycine max
  Peptide Sequence Number=SeqID_119098
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgttgatgatcttggagatgacaaagaaggaggaataggtgttgtgggtgctccggatgggcc

SEQ ID NO: 27414 - DNA, 303 bp, Glycine max
  Peptide Sequence Number=SeqID_119099
ttctacggagtgcccgtcgcccccaacaaggtcatcaagccccctattaaccaaactttcatcaagaagtattgtgccccccaggcaggcgcagtgcaagacaccacaacagcctggggatggccgacagcgggcaatagacgcactgccgccacctctagagtacaaaggatggagcatttcctacgacctgtggccgaccagcaggcgaccaagtccaaagccaaaagtaagcaaagtactaggtccgtgaccgacaagtcatcaagcgttcggctcaagacgttaaagaagcgctactag

SEQ ID NO: 27415 - DNA, 315 bp, Glycine max
  Peptide Sequence Number=SeqID_119100
atggtgggttacacaccttcaagttttacagatttggtcttcgccagcaaaaagatcgaagtgggtccgaaaagaggcaaatttgatcatcctactaggacgactgagaaaactggggcaaatgaagagggtgagaaacagggagaaacccatgctgtgactgccattcctatacggccaagtttcccaccaacccaacaatgtcattactcagccaataacaaacgagctcctccttcccaccgcccagttatccacaaatggcttgcctccctaacatacaccacaaactgtggaatacccacttctcaatga

SEQ ID NO: 27416 - DNA, 597 bp, Glycine max
  Peptide Sequence Number=SeqID_119101
atggagagaagtatgatagatgctgccagtggtggagcccttggagacatgacccctgctgaagccagaaatttaattgagaagatggcttccaactcccagcaattcagtgccagaaatgatgttattgtcattagaggagtgcatgaagtagccacgaattcatcttcatcaggtgagactaagaagtttgaaggtaaactagatgccttggttaacctggtaacccaactggccatgaatcaaaaatttgcacctgtcgccagactctatggtttatgctcctctgccgacccccacacagacctttgcccttctgggcaacaatctgaagcaattgaacagcctgaagcttatgttgcaaacatctacaacagacctcctcaacctcagcagcaaaatcagccacaacagaataactatgacctctccagcaacaggtacaatcccggatggaggaatcatcccaaccttagatggtcgaatcattcacaacagcagcaacaacaacagctttattttcaaaatgttgctggcccaagcagaccatacgttcctccaccaatccagcaacaacagcaacagccccagaaatag

SEQ ID NO: 27417 - DNA, 153 bp, Glycine max
  Peptide Sequence Number=SeqID_119102
atggtgacaacaaccaaaggtagaatcctggagttggtaaaaagaaagccatacatcacatgggttgaaaatgatatggaatcttctgaagattcagaaaatgaagagataaatctctgccttatggctaaaagttatgaaagtgatgaagag

SEQ ID NO: 27418 - DNA, 438 bp, Glycine max
  Peptide Sequence Number=SeqID_119103
atgccaaaggtgaagcgttttagaaatccacaaaaatcagcacctcaaccacaatctcctgaagtcccaactgataatgtccctctttctcatgtatcaacatctgaagttccacaagaagatgaaacaactagatgtcatgttgggcgtgatcaatctacacaatgttggactattgaggcaatagactctgaagaaacgatcaagaagattaaggtgaaagttaggggagtcaatagcttacctagggagttacgcatcattgtgaattttgatgaccaaggccaaacaattggtgaagcacaagccttgcttgcaggatttcttggaacactagcagctgattgcaaattatttcctatggattatgatagatggtctggaccttcaggcgtacctaaagcttattttgattattgctttgaaacaattttaaag

SEQ ID NO: 27419 - DNA, 291 bp, Glycine max
  Peptide Sequence Number=SeqID_119104
atgcagtgcaggccacaactgaatgggatatcctttagtaacattggccagcagcaaaatcagatgttggtgggtaatttttatgagcaggaaataagggctttcaacaaggcactacttggaaaatggaggtgggagatgcttcagcaaagtaacaagttatggtccaagatactggattccaagtatggtggatggagatcattggtggaaggcagtagaaggaataatgagtcagatgaattctatcctccaagatggcactacttggagggtgggatgcggggataa

SEQ ID NO: 27420 - DNA, 189 bp, Glycine max
  Peptide Sequence Number=SeqID_119105
atgcccttttgcgggcgagcgaaggcgaagctcacgggtgcgctttccaaaggaggaaagatgtgcgaagtcgccaccaacgtttatttgtggaaaacgtcggaaaaaccggaaggaaaccgggtcaaaatgaaaattctaagttcgggagttgtatttacgtttgagggaaggcgagaaatgacttaa

SEQ ID NO: 27421 - DNA, 276 bp, Glycine max
  Peptide Sequence Number=SeqID_119106
atgcctgcagcattcaacattgtcgcaacctacccttcggcgggagggcaacgcgtgactcgcgggatgcgtgttccacgaaaggaatacgcgcggagtcgccaccaacgtttatttgaggaaaacgtcggaaaaaccggaaaagacgcgatctacaaactttttagtgaaaggttcgggagttgtatttacgcacggggaaaggtattagcaccccacacgcccgttcccaagggacggcagcctttaatcgaatgtgcaaaacatgacttttga

SEQ ID NO: 27422 - DNA, 342 bp, Glycine max
  Peptide Sequence Number=SeqID_119107
atggtttctagaggtatcatcccctttgaagaacatattgtagcagtagggactactagcaacaataggttttcaaagagaaaagctctagatgagggtgtcgcaacctacccttcggcgggagggcgacgcgtgactcacgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 27423 - DNA, 273 bp, Glycine max
  Peptide Sequence Number=SeqID_119108
atgaaaggtaaaagcttctcatttgatccagcagaggaggagcatacaacctatttcactcaagtcacacccacggaattcaagcacaagagacttgatcattgccatcttgaaagaatgctaaacatgaaaaaaaggaaatatgaagagaaaattttggatctgtcgaaaatcacattggcagaagtgctacatgccctgcaagctcaagagcagcgaaggttgatgaggcaagatcgtgttgtcgaaggtgtttcccgccaaacatcatga

SEQ ID NO: 27424 - DNA, 703 bp, Glycine max
  Peptide Sequence Number=SeqID_119109
ggtttgttggggatttggaggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcggccactggcttttcaaccaagcgcgatgaccaattgtgcgaatcaacgggttcctctcgtactaggttgaattactattgcgacactgtcatcagtaggatgtgccgccccagccaaacctccccacctgacaatgtcttccgcccggatcgaccggccgaagccgcccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 27425 - DNA, 636 bp, Glycine max
  Peptide Sequence Number=SeqID_119110
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgctgatgccgctggcgattcagttcatcatgccgtttgtgatgcttccatgtcggcagatgcttatgaattacaacagtactgcgatgagtggcagggcggggctccagcttggagcgaactgcctacccggaactgagtgtcaggcgtggaatgagacaaacgcggccataacagcggaatga

SEQ ID NO: 27426 - DNA, 267 bp, Glycine max
  Peptide Sequence Number=SeqID_119111
atggtgaaagttggaacctcttacgtgccgatcaaccgtctcattttcgccaaaagttggcccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 27427 - DNA, 624 bp, Glycine max
  Peptide Sequence Number=SeqID_119112
atgaccaccctgactcagatatggatgactctgctgctcagcaacatcctgcccaccgatcataattccgacctccccatgccgaagtgccagctggtgtacgccatcctgacacggatgagcatccatgtggctcagttgatcgctgatgccatctatatttttgcaggtatggcgcccactaggcaccctttggacccacataagtccaacagggccctgggattccccacactgatcacaggactctgccagtcgttcggagtccccgttgcacctaccaaggtgattcggccgcccatcacccgggtttttattgagaagtactgtacccagagacagggtcagggtgatgctccacaggccgcaggcgcgcccccaccacctcatcaggctggccaggctggggcatttgacatggagcagtatttacggcatttggttcgccagcaggcggccaaccaccgagcacatcatgcagagccagggctccgcttctttttcatgccctactccagaccagttcagggcagaggtagcatggcccggagattggcccgaggcccaagcaggagaggcgcccccggaagctcccggcgatggagaagaagcccacgaggatga

SEQ ID NO: 27428 - DNA, 772 bp, Glycine max
  Peptide Sequence Number=SeqID_119113
atggatacaccacaggattctgatcctatgtgttgcttcgggatcggagtaatgattaacagggacagtcgggggcattcgtatttcatagtcagagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggaactgagagctctttcttgattctatgggtggtggtgcatggccgttcttatgttggtgagcgatttgtcttatggttattccgttacactcggatacgagaccgtcagcctgctaaattcgagctatacgtgaagaggtcgtcggatcgcacccttgatgttgggccgcacgcgcgctcattcaaatttctgatgccctattcaactttcgatggtctaggtagcttggcctaccatggtggtgaccggggcaagtctggtgccagcagccgcgctcgtagttggaccttgggttgggtcgatcggtccgcctccggtgtgcaccggtcggctcgtcccttctgccggcgatgcgctcctgtccttaactggccgggtcgtgcctccggtgctgttactttgagaattagagtgctcaagcaagcctacgctctgtatacattagcatggatacaccacaggattctgatcctatgtgttgccttcggatcggagtatgattacagggaca

SEQ ID NO: 27429 - DNA, 282 bp, Glycine max
  Peptide Sequence Number=SeqID_119114
atgaccactcttacacagatatggatgacgttgctacttagcaacattccgtccacaataccgatctccccctgcggaggaatcacacccacaaagacacccagtgtacccggagaagtccaacagggccctggggtttccagctctggttacgggcctctggatcacgcctgcaagacactcggtggacccagagaagtccaacaaggtcttggagttgccagctctgattacgggcctctgtcagttctacgaagcgcccgtcacccacaaaaaggttag

SEQ ID NO: 27430 - DNA, 165 bp, Glycine max
  Peptide Sequence Number=SeqID_119115
atggagaaaaatgaagaaacaacaatggaagagaaggagttcaatattcacttaggatcaacatttcagccagcaattcaatcaccaaaactcaaattcacaatagacacaatcataaggaaacctaaaagttcaagaaaaggttcacaatcaaagactctctaa

SEQ ID NO: 27431 - DNA, 268 bp, Glycine max
  Peptide Sequence Number=SeqID_119116
attagcactcctgaggcctgaccctcaggagttagctactaagctctgtatcccagggaggggattcgagcttaatgctgatggctatccgttgaagatattgaggaagaagatgaccaccctagctcagacatggagtgctctttccttctctaacctgattcctacctctcatacttctgatgtcaccctagatagagccaaactcatttatggcatcatcatgaagatggacattgatgtgttatttttttctcctatttcttaa

SEQ ID NO: 27432 - DNA, 779 bp, Glycine max
  Peptide Sequence Number=SeqID_119117
gcattgcatatgggttctgtcttgatccctactgtaaacaaaccaacggagggtccgtgtcgccttcttaaaaacgtgcgttggggcatttcgctacccctagacgtcgtatctaagaaggggacaaattccccggacccccgtattccatgggaacaaatcaaaccggcaagagttctaccaagtcaaggtcaaaacccagataccaccagcatcaaggaattagggcggttgatggaacccctccaaatgcaagccttccgcaagacttacggaaaaatcttagaattgaccatagcagaggtgtccatagaagccattgcatcacttacccaatactacgaccagcccttgagatgcttcacattcggggacttccaattagtaccaaccattgaagaatttgaggaaattctaggatgtcctctcgggggaaggaaaccatatctttcctccgggtgtctcccctctttgagcagaattgcaactgtggtcaaggattcagccagaggtttggaccgcataaaacagactcggaacggcatagcgggcctaccacagaagtacctagaagacaaggcgaggggtatggccaatcaaggagactgggtcccgtttatggatgtgttagctttaataatttttggggtcgtcctctttccaaacgtggatggtttgatagacctagcagcaatcgacgctttccttgcctaccaccatagtaaggaaagtccggtggtagctgtcttggcagatctatttgacacatttgaccgaag

SEQ ID NO: 27433 - DNA, 213 bp, Glycine max
  Peptide Sequence Number=SeqID_119118
atgggtgcgctttccaaaggaggaaagatgtgcgagtcgccaccaacgtttatttgtggaaaacgtcggaaaaatcgaaggaacccggtcaaaatgaaaattctaagttcaggagttgtatttacgtttgaggaaggtcgacaaaagcgggggcttttgctcctacgtaccctccatcgaagaggaaatcagaccgacgtcattctttcttaa

SEQ ID NO: 27434 - DNA, 744 bp, Glycine max
  Peptide Sequence Number=SeqID_119119
atgggagagccatcgaagaagagaaagggatcatcctccaccgccgctgctgctgcccatcgccgccacggaccatccgaagcacccacaacacctattcatccctctctgtcatctccaagatcatccacattgttttcatccgatgatcagcgtctatgtcaaggtgcaccttttgagggcaccattgttgatgactggaaatttgattattctagtcatgatgctcgccgtatggtctgcaatgaccaggctgaaatgaccggtagattgctggccgggtcattcacatttgataatcgcatcatgcactatataattgttagaattttgcttcctcggtcttcaaatttagcacaagcctctgaggaggatttgattctaatgtgggctttccttaccggtcgtcagatcgactgggcctacttggttcggtaccgaatgcataaggcattacgggccaatgcacctctcccttaccctcaattggtaactttgtttctgcgtcattttcaaattccgcttgatgatgaacaatttgttcaagtcaagcgttcctttgcaattggtgctggtgcagtgacttcctttggataccgtaaggattggaatggtcaatggctgaagaaagacgcattccctcctcaagatgagcgtactccttcacctcttcctcagcgagatgattcagcactcatgaatgaagtcctttccgattacgggtcttcgttcttatgttggtga

SEQ ID NO: 27435 - DNA, 649 bp, Glycine max
  Peptide Sequence Number=SeqID_119120
atggatgaaatagataaggtgcaagagcaaatgaaggccgacccggaggccttgaaagagaaaatggccacaatggtagaggccatgatgagcataaaggagatggtggaggtcggtgcggcttaccaaacccgtgctagagctaaaataatgggtgaagcagaggaggtgcaagagaagatgaaggccgacatggaggccatgaaagagcaaatggccacaatgatggaggccatgatgagcatgaagaagataatggaagccaatgcggttatagttgccgctactagcgctgtcgctaaagtgaacccgatgctcccatctggcctcaagcaaatgaatcatccaacctcaaatatggtaggcaaagatttgggaagtacggatgaccccatgatgtgcaaattcaaaacaagcacgccttcccgccatatggcttgcctcccaaactatacaccacccaatgtggcgtacattcccaatgaggatgtcaataactccacacccatacttattaagagccaacaacctcaatctgatcatgcacatgtctctcgacccatggaggagacacatggaatgccccaccacaatttagccgacttcgagcattggctcggatatgccactgaagggcaagcagttggtg

SEQ ID NO: 27436 - DNA, 246 bp, Glycine max
  Peptide Sequence Number=SeqID_119121
gtcgactctagaggatccccgttgatttgcaccatcgcccgatcgccacctagtaccacatatgacggagtggtacctggagatatgtcgcgggggtcaggagaccttggggacgtcaggcgagctcctggcagtcaaccaataaaggaacaaagaccacaaagcaaggaggtttgtgtggtggctggccaactatggatcttgagtgatatctggaatttggcctcgggtaatcgattaccaagg

SEQ ID NO: 27437 - DNA, 299 bp, Glycine max
  misc_feature (35)..(35): n is a, c, g, or t
  Peptide Sequence Number=SeqID_119122
aggaactagcacgcacgcttcaatgcactgtggantggatattacctacacctactccatatctactagtggagccagtccaagtgattgaggtgacgtcatctaaggaagaccccgaggaggacccagaggagctacctcctgagcctgctgtggatgctcttgactttctagagggtgaggaggacccacttcctgaggtggattctcccgaggacgtcatgtcggcatctgaggcagactctacggaggagagcggtcccggaggcatagcgactagtagaggttcttcatcatag

SEQ ID NO: 27438 - DNA, 570 bp, Glycine max
  Peptide Sequence Number=SeqID_119123
gatgtcacagatatgaccgaacgccttcttgccggttcattggcttttgaaagccgcatccttcattatcttattgtgcagattttgcttccacgatcttccaaccttgcccaggtttctgaggaagatattgttatcatccattttcaaattcctcttgattctgaaccttatgttccaatcaagagatcttttttaattggtgctgttgtgattgcttcttttggttaccgcaaagagcatgatggctcttgggtcaaaaagggtgctcaacccgctgatgatgaaggcaacctaccaactgaagatagttcctctcttcttcgaaagcttttggacaagttcgatggcttcagacttttgttggggacaagtttgattccatggaattgcaagtcaacatgcggttcgatgccatggaatcaaggatcaccaaagttgaagaagatgtctccttcatccgatcaagctgatgttttgatgatgccaaaggattacatgtttctcaaagttttattcaagacaaagaaatcaaagatattcaagatggatgatcaagatagtctctag

SEQ ID NO: 27439 - DNA, 652 bp, Glycine max
  Peptide Sequence Number=SeqID_119124
atgcacacagctctgttgtctggttgggccggttcgatggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggggtggcttgttttggttttggcgcatttcatgtaacaggattgtatgtcctggaatatggtgtccgatccttatggactaactggaaggatacaatccgtcttttccatcttagtgtgcgtccaccccaacgtctatataaaggattacggatgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagttcaatggacaatggagatggaatagccgtcggttggttaggacatcctgtctttagagataaagaggggcatgaactttttgtacgtc

SEQ ID NO: 27440 - DNA, 294 bp, Glycine max
  Peptide Sequence Number=SeqID_119125
atgactcatcaggattttcaagtgcaagccattggtcagtttgctcaagcgacctgtgctcctgagtttggacttccaagaccgttcaatcagagattactcgtctgcacgtggtggggtgccgtaaacacaaagagaagtgggttatcaagaataggatgttggacaaatagcctcagttaccttaagaaaaagggggaatcctctacaacaagagacccacggtctcttaatcccttttcagaaataagaagaagagaagaagaggtctctcctaaaagaggtagattgtaa

SEQ ID NO: 27441 - DNA, 306 bp, Glycine max
  Peptide Sequence Number=SeqID_119126
atgtcttatcaaaatgaagaaaccgacaaaaagaagagaagtatagcccttaaagcctcatcatcaatgcaagaagcaaatgaagaagaagattcagatgatgaagaagacttctcactctttgtgaagaagtttcagaaatttgtcaagaaaagaagaatcgagaggcgtcagaatttcaacaatggaagaaaatcacaagaagactctcaagttcttagatgttacaagtgcaaccaagaaaaggaaatcaaccttctaaccaaggattatgaaagtgatgagaacatttctcaagaagattaa

SEQ ID NO: 27442 - DNA, 587 bp, Glycine max
  Peptide Sequence Number=SeqID_119127
aaaacaccgagactttttcaagtctcacaagttatccagaactacgtaggtctgaattcctcattggaggatacgtaggagcaagagcctcgcttttgtcgaccacaccgccttttgtcgccataactcaagagctggtagcccgcggagacaccttacggttatccgcacctcgtcattcagtgaccccaagtgtgattgatgaacagaggccaatgtggtcatctggccttttccggagatgtcagcattttccgatggagacttttcaagtctcacaagttatccagaactacacccttaggtcatgtgacgcacaccccttttgtcatccagaggcggcgggcccgatgacaagcaaagaccaatcgtgtccgatggcacgcagagaccaagtttggtcattctgcacacatgatacgcggagataccttacggttatccgcacccctttgccattcagacacagtcgtgtccgttggcacgcagagaccaagtttggtcattctgcacccatgatacgcggagataccttacggttatccgcacccttttgtcatccagagcagatgacaagcagagaccaa

SEQ ID NO: 27443 - DNA, 782 bp, Glycine max
  Peptide Sequence Number=SeqID_119128
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcaatagccatgaagatcgttcggaaagacctcgtacccaatggacctggcagcgttaagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 27444 - DNA, 348 bp, Glycine max
  Peptide Sequence Number=SeqID_119129
atgaacattgttaccgacaattttgatattgaccgacgcggcgttgaagttttcaaactccagttcgcctacgatcaagcttatcgataccgtcgacctcgagggggggcccggtaccagcttttgttccctttagtgagggttaatttcgagcttggcgtaatcatggtcatagctgtttccttcggggaaacctgtcgtgccagctgcattaatgaatcggccaacgcgcggggagaggcggtttgcgtattgggcgctagcggagtgtatactggcttactatgtggcactgatgaggtgtcagtgaaggtgcttcatggtggcaggagaaaaaaggctgcaccg

SEQ ID NO: 27445 - DNA, 141 bp, Glycine max
  Peptide Sequence Number=SeqID_119130
atgggtaattacgcgaagaatttcaaccgttcttcgacattcatcgttcgttcttcgtttttcttcggtcttcaaccgtggtccccatttgtttcgtgtacttttattctcgtttcatttactttccatacccccttttga

SEQ ID NO: 27446 - DNA, 159 bp, Glycine max
  Peptide Sequence Number=SeqID_119131
atggatgaaaaatgtaaccaaatgcaagagaaaaatcagcaaatgaatgaacatgcagtcaagtttgggtttaggcttaccttgcttgagcagtggatgagcgggagacatggtggtagtcactttgagaagcataattggttagaagttgaaatgaag

SEQ ID NO: 27447 - DNA, 225 bp, Glycine max
  Peptide Sequence Number=SeqID_119132
atggcggatagttttcttggggacatatcacagcagcaacttcatcccctaagaaataaggaggagggggatgaacacttgttcttcaattgtagtaaaaccctccctttgtggtgggaatcaatgttctgggttaatcttatcactataatgccacaaaatcatagggaccattttctgcaacatggaatagaggtagcagatggagtcaggtccaaaacctag

SEQ ID NO: 27448 - DNA, 177 bp, Glycine max
  Peptide Sequence Number=SeqID_119133
atgtcggagacccatcatgaccacagattcacctctactccttatgttctcatggacccggcctacccttcggcgggagggcgacgcggggctcacgagtgcgtcttccatgggaggaaaatgcgtggagtcgccaccaacgtttattcgaggaaaacgtcggaaaaactggaaaag

SEQ ID NO: 27449 - DNA, 1056 bp, Glycine max
  Peptide Sequence Number=SeqID_119134
atgagtcatcattcatctagtgttaatggcgagggtactagtcataaagaccctttatctagaatcttagatgagttgagttcccccaagttatggaaagaaaaacaagagagaaaagaaaaaggaaaaaaaagagtggaagaaataagtcaagatgaaagaaagaaaataagagaggaagaaagaagaaaaataatgaaagaaatgaaaagagaaaaatatgcctcctatagtagtcataactcttgcaagagcctaagtaaagaacttggtgactattacgaaggaaggcataggtcacatcttagacctcactcccatagaagagaaaaggaaagaaagcctcaagaggctaacattagcctctcatacttccatgggaaggacaatgtagaggctaacttagattgggaaataagggtaaatcaacaacttaaaaagaagtctacttcaaaatcttatggctctcactcttatccaaagaaagaccaaggtcaaggcatcttaggggtgacaccttctattcccaaagatgataaggggaaggcaatagaaaagcaagcccctaaggctagggccaagatttatagtagccaagatgaggctactacttcaccttcctctagtgaaagtgaaaaagcaaaaggggaagaatctagtgaagaaatctacccccaagaagaaggacaaccgttaatggttaaagagaagtgtaaggaggtaagtgtctcctccaagagtttagctaagaaggaaactcattttacaataaagacaaacattaaagaaactttccctcttagacaacctccacattttctcttttgtaaaaaggcacttgctagcattgccacacctcttgggctcgagtttattcctcaagtaaagaagttgttggatgagggtttgtttcgcaagagcttaaatccttgtgctttgttggttcccaaaataggtattattaggcaccaagtccctaaaataggtggtataatgaatgttttgaatggtgcaaccctcttttgtaaaatcactcgtacacctaacatcttcatg

SEQ ID NO: 27450 - DNA, 612 bp, Glycine max
  Peptide Sequence Number=SeqID_119135
ccgaaagatggttatcggttcaaggacgcaaggtgcccctgctttttcagggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcggaaaagaccctatgaaagcttcactgtttcctgggattggcttttgggcttttcctgcgcagcttaaggcctcccaaaaggtaacggaggcgtgcaaaggtttcctcgggccagacggagattggccctcgagtgcaaaggcagaagggagcttgactgcaagacccacccgtcgagcagggacgaaagtcggccttagtgatccgacggtgccgagtggaagggccgtcgctcaacggataaaagttactctagggataacaggctga

SEQ ID NO: 27451 - DNA, 515 bp, Glycine max
  Peptide Sequence Number=SeqID_119136
atggctacctcaccaaaagaaactgcagcttctggttcacccgctgtaccatcatctccgcaccaggaacaacctgaattcaacatccaacccatccaaataattcctggtcaagcttctgtccctgagaaactggttcccagaagacaacagggagcgaagattgctgaaaaccctagccttgcaacaagtcctagggaagtagacacggagatggacaagaaaatccgcagtattgtgagtagcattctgaaagacgcctctgttcctgaagctgatgaagatgtcccaacatcttccaccccgaatgtttctgtgcctgatgttgagaaagatgttccaacatcctccgctccaaatgctgaagccttcccttcacccagtgaagaggaatcaacagaagaagaggatcaagcctcagaggagacccctgcaccaagggcaccagaacctgctccaggtgacctcattgacctggaagaagtcgaatctgatgaagaacccattgccaacag

SEQ ID NO: 27452 - DNA, 306 bp, Glycine max
  Peptide Sequence Number=SeqID_119137
atgacagccaccagggtcaggaaagagtgtgacaagttgagggatgtcaacatggccacgaccgaagcattagagcgagaaacgaagagggccaaaaaagaagaatgggtccaaaacaagttccgaggggctttatggggcagcaacaatggactcaagcttcgaagggctgaaagggactactttgagaagcatgtgatcctttggcatcatcaaaacattcagcttgatcctttgtctacaagtatgatattagaggacaaattgaaggcttgtcaaaggtcgaagaagggcttgactgaatag

SEQ ID NO: 27453 - DNA, 669 bp, Glycine max
  Peptide Sequence Number=SeqID_119138
atgtggatggataggttcgccttgaccttgaatggaagtcaagacctcccgcgtctattagccaaagcaaaagccatggccgaagtatgtatggcccccaaggagactcatcggctaatcaattactgtcaacacatgatagatttgatggcccataaaactatagaggataaagccacggcaaccgcctccagtacagtttgggaagtggagccggtgctgcagcccgccttaaatccgggccgagacagaaacacggcagtgtttggtcggaggtatattccgcaagcttacccctatggcttgccttcggacttcactccccgtgccaccccagaagatttaagccaagcccctactttcgaggggcaactcccaccttatgacgactatcccgggcaagacgatgaggaaggagatacccatctcggtcccctgctccacctcaaagatccgtccccccatgaactaccccaaccaaacatagtccgccatatcccggcttcacccacacccataaaagaatctgttccctttgtggaagataagggaaagattgaggcgcttgaagagaggttgagagcagtcgagggcctcgacaattacccattctcggatttagcggacttatgtctcgtgcccaacatcgtcatccctcccaagttcaaa

SEQ ID NO: 27454 - DNA, 198 bp, Glycine max
  Peptide Sequence Number=SeqID_119139
atggcccgggtgcaaatagcaaccaagcccactggggccttccaggatgttcctccagaaggcggttgcttctggaggaagcaacctagctcgcctgggcgagctgagctcgcctgggcgagttgggtggcaagcatctccttccttttcctatatatagggggaggagggaagaacaaaaatgttcaaccctcctag

SEQ ID NO: 27455 - DNA, 363 bp, Glycine max
  Peptide Sequence Number=SeqID_119140
atgcatgctttgttagggtcattcaatagtgggaactggtctgattctaaagtccttggtagtacgggactaagttgttgtgctatcacgagggagtggggtacaaaaagtactctagttcctttggacttagaaatagaagctacactaagaaggaacagggctgagaggagaaggaaactgttgcaagacaaaacagttgcgtccattcttgaggaggagactcatttttctgattcattatcacctgattcaccatcatcaagggaatccgctaatcaacattctaaaactgctaccacggcagatgagcatgatcaaaggactacccttgaggactattcaagtggctttgtaccataa

SEQ ID NO: 27456 - DNA, 276 bp, Glycine max
  Peptide Sequence Number=SeqID_119141
atgtcaggatttacacgcaattctcctcaaatttcagccagcccgcatcaattagaccttgcaccttacgcttcagagccctaccatgctcaatggaacgcctcggggcttctccgtgacaagcacacattgcgttcgagtcgtattctcagagaaatggaggttgatgaaccttggctagggttatggctaccattgaattatcaagtagatatgggagcaagtcagcataggacactggaattggggtggtgttcgtcattggaagtgcggtag

SEQ ID NO: 27457 - DNA, 697 bp, Glycine max
  Peptide Sequence Number=SeqID_119142
gtgctccagtggcttctgtttctatcagctgtccctccctgttcagctactgacggggtggtgcgtaacggcaaaagcccgcccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatagtcaaacacttcatattttgttggaacactaaacctaagtatacatcgggacagctttttgggcagtggcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggatatattccgcttcctcgctcactgactcgctacgctcggtcgttcgactgcggcgagcggaaatggcttacgaacggggcggaagatttccttggaagatgccaggaagatacttaa

SEQ ID NO: 27458 - DNA, 99 bp, Glycine max
  Peptide Sequence Number=SeqID_119143
atgggtgccaaatacctcgaagtggtcaaacgagggtcgcatcccaacaacggatggtcctcggacgaaattagggaattaatgaagcattgggcttga

SEQ ID NO: 27459 - DNA, 237 bp, Glycine max
  Peptide Sequence Number=SeqID_119144
atgtcgcggaactccacggattgcctaacgatgggtgttaagttcctcaaagcgatcaagcgagggtcgcatgctatcaaacaatggtccccggacgaaattaggaacgtcattcggccgatcaatatccctaccagcggaacctccgccattgcactcgatcgtccctggatgacaaaaggcgcaggagacgatgttagtctcctcatgctatcatgcgttgagtcttacagatag

SEQ ID NO: 27460 - DNA, 809 bp, Glycine max
  Peptide Sequence Number=SeqID_119145
gcgggatacttaacgcgttagctacagcattgcacgggtcgatacgcacagcgcctagtatccatcgtttacggctaggactactggggtatctaatcccattcgctcccctagctttcgtctctcagtgtcagtgtcggcccagcagagtgctttcgccgttggtgttctttccgatctctacgcatttcaccgctccaccggaaattccctctgcccctaccgtactccagcttggtagtttccaccgcctgtccagggttgagccctgggatttgacggcgaacttaaaaagccacctacagacgctttacgcccaatcattccggataacgcttgcatcctctgtcttaccgcggctgctgggcacagagttagccgatgcttattccccggataccgtcattgcttcttctccggaaaagaagttcatgaccctcccagtgtggctgatcatcctcctcggaccagctactgatcatcgccttggtaagctattgcctcaccaactagctaatcagacgcgagcccctcctcgggcggattcctccttttgctcctcagcctacggggtattagcagccgtttccagctgttgttcccctcccaagggtaggatcgaactctccatgagattcctagttgcattacttatagcttccttgttcgtagacaaagctgattcggaattctcttccattccaaggcataacttgtatccaggcgcttcatattcgactggagttcgctcccagaaatatagcccccccacccctcgtgctcgaactgataacttccaccacgtcaag

SEQ ID NO: 27461 - DNA, 867 bp, Glycine max
  Peptide Sequence Number=SeqID_119146
atggattttcagcgcgaggattgctggctgctgtcactgccgctgtttcacgtctccggccagggtatcgtctggcgctggctggcggcgggtgcgcggctggcggtgcgcgagatgcatccgctggccgaggcattggcaggctgcacgcacgcctcgctggtgccgacacagctctggcggctgctggcgcaaccgctgacgggcatgacgctgaaagaggtgctgctcggcggtgcgatgatcccggtggagctgaccgaacgggcggaagcggcggggatccactgctggtgcggctatgggctgaccgaactggcttccacggtgtgcgccaagcgcgccgatgcgcggccgggcgtcggcctgccgctcagcggccgcgaggtaaaactggtggacgaagaggtctggatccgcgccgacagcctggcgctcggctactggtgtcatggccagctgcagccgctggcggatgcacagggctggttcgcgacccgcgatcgcggcgcgatggccgagggggaactgcgcattttgggccggctggacaacctgtttttcagcggcggcgaaggggtgcagccggaggatatcgaacgcgtgttggcggcgcacccgcagatctcgcaggcgtttgtggtgccggcggcggacgtcgagttcggccagcggccggtggcggtaatcgacggcgatccgtcgctgtcgctggcggcgttgctcgcctggtcgcaggacaagctggccaatttccaacgcccggcggcgctgctcccgctgcctgacgagctgaaaaacggcggcatcaagatttcgcgccgccagttgcagcaatgggtggcgcagcgcctctctcaggcataa

SEQ ID NO: 27462 - DNA, 1383 bp, Glycine max
  Peptide Sequence Number=SeqID_119147
atggccaatcaaggagactgggtcccgtttatggatgtgttagctttgctaatttgtggggtcgtcctctttccaaacgtggatggtttggtagacctagcagcaatcgacgctttccttgcctaccaccatagcaaggaaagtccggtggtagctgtcttggcagatctatttgacacatttgaccgaaggtgcgagaagagtagcgcacggatcatctgttgcttacccgccctctgtgtttggttggtttcacacttgttccaacaagacacaagacatccatgtccgctcctgagccatcgctcgtgtactgaaaagaggagaatggattgggaccagctcttggccgggataggaggtagaacaatcagttggttcccccgatggaaggaaggaaaagaaggagtccttttctcatgtggaagatacccaaacattccgctggtaggaacgaggggttgtattaattacaatcccacgctcgctataagacaactagggtaccccatgaggggagcaccgacggaagaaagcatgtctcctttccttgtgagggatctcggtgcacaaaattccaagactatacaaagaatccataaggcatgggaaaccccgttaaggaaagatcaacagcttagaggcattcgtaatggcatcattggtggattggctcgcaagttaaaagtcgtcagcgaagagattttgaagcaccggaagagacgaggaagtccaagctctcaaaagcaagttaggaaaggcaaaactgccaaggagaagttcaagttggccgctacacacgttcggaaggagtgtgccgggttacgggaagagaatgcaattaccgcaagagcccttgaacaagaaaccaagagggctcgcaaggaagagtatggccggaacaaatttcgcggagctctatggggtagcaatagtgaactcaagttgcgaagggaagaaagggaccaatcgcgagcacatggcatggttctgaaagaggagttgatgacttgttcaaggtccaaaagaagcttgtctcagcgtttatgcgagacagagaccaacatgttagctatcatcgccaagtacgaagaagagttaggtctagccacggcccacgagcatagaatcgcggatgagtatgctcaagtatatgcggaaaaagaggctagaggaagggtgatcgactctttacaccgagaggcaaccatgtgggtgggtcggtttgctcttaccttgaacgggagtcaagaacttccccgattgttagccaaggccaaggcgatggcagacacctactccgcccccgaagagatccatgggcttctcggctattgtcagcatatgatagacttaatggcccacataattagaaatcgttag

SEQ ID NO: 27463 - DNA, 834 bp, Glycine max
  Peptide Sequence Number=SeqID_119148
atggaagaaagcatgtctcctttccttgtgagagatttcggcacgcaaaatttcaaggctatacaaagaatccataaggcatgggaaaccccgttaaggaaagatcaagaacttaggggcattcgtaatggcatcattggtgattggctcgccaagttaaaagtcctcagcaaagacagtttcgaagcaccggaagaagacaaagaagtccaagctctcaaaaacgagttaggaaaagcgaaacttgccaaggagaagttcaagttagccgctacacacatccggaaggagtatgccgaattacgggaagagaatgcaactactacaagagcccttgaacaagagaccaagagggctcgcaaggagagtatggccataacaaatttcgcgggagctctgtggggtagcaacagtgaactcaagctgcgaagggaagagagggaccagtcgcgagtacatagcatggtcttgaaagagaagttagttgcctgttcgaggtccaaaaggagcttgtctcagcgtttatgcgagacggagaccaacatgctggctatcatcgccaagtaccaagaagagttaagtctagccacggcccacaagcatagggtcgcggacgagtatgcccaagtatacgcggaaaaagaggctagaggaagggtgatcgactctttacaccaagaggcaaccatgtggatggatcaagaacttccccgattgttagccaaggccaaggcaatggcggacacttaccccgcccccgaagaaattcatgggcttctcggctattgtcagcatatgatagacttaatggcccatataattagaaaccgctag

SEQ ID NO: 27464 - DNA, 525 bp, Glycine max
  Peptide Sequence Number=SeqID_119149
atgcgctggcaagggcgtcgtgaaagcgacaatgtggaagacagacgtagtgattcaggttcgccgctgggcggcggcggtggcggtttccgtattccaagcggtaaaggcggcatcgtcctgctaattatcgttctggtggcgggttactatggcgtggatttaaccggcatgctgaccggcgaaccgatgccgcagcagcagacttcaacccagcgttcgatcagcccgaaggatgatgaagcggcgaagttcacctccgttattctggccactaccgaagatacctgggggcctatttttgaaaagatggggcggcaatacgtacagccgaagctggtgatgtatcgcggcgcgacccgtaccggctgcggcaccggtcaatcggtgatggggccgttctactgcccggcggacagcacggtctatatcgacctgtcattctatgacgagatgaaaaacaaactcggcgctgacggcgactttgcgcagggctacgtgattgcgcacgaagtcggccaccat

SEQ ID NO: 27465 - DNA, 475 bp, Glycine max
  Peptide Sequence Number=SeqID_119150
ttggaacctcttacgtgccgatcaacgtctccattttccgccaaaagttggcccaagggcttccggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttccccatcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 27466 - DNA, 771 bp, Glycine max
  Peptide Sequence Number=SeqID_119151
atggaagaccgcgcgctgcagcacgcgctggaagctgagcgtcggctgagtgtcgcgctcttcttcgccggcgggcagcgtcggtgtggtttgttcgatgaaggcttccagctcctggcgcaacgcggccagatccaccgtacatgcctcaagcgcttctcgcgcggcagggttgctcagcaacgccagcaacaggtgctccacggtcataaactcgtgtctgtgctcacgcgccctggcgaaagccatgttgagactgagttccagttcttgattgagcataagcacctccccaatagattgccttattcaggctttttccagcgtacaaagcaacggatgctcgttctcccttgcgtaccggttcacatggacgactttggtttccgccacctcggcggtaaaaacaccacagatcgccttgccttgatagtggaccgtgagcatcagttgcgttgcgcgttcaatatcataagaaaagaacttttgcagaacgtcaatcacaaattccatcggtgtgtaatcgtcgttgttaagtataactttatacatagacggcggttttaccgcatcgatttgtttttcttcggccaagtgttcaagtttagccagtcgttgttattgcccatcgctgctcatcttctctgctctgccctcagatatgggggcaggtttcggttattcaaagtggggatagttactattttatcatcttcggcttcgtcccgccgcactgtaacgtgcgcaaaaaaacgggccaattgtgactga

SEQ ID NO: 27467 - DNA, 513 bp, Glycine max
  Peptide Sequence Number=SeqID_119152
atgatggtgacccgggtgatgttggggcacggctacgagcccggaatgggtttgggcaaaaacaacggcggcaggaccggcctggtaagtaccagaggaaaccgtaggaagtttgggttaggctataaacctacgcaggctgacataaggaaaaacatctcggaaaggaagaacaaaggccaaggcccatggtcgggacagcgagccaaagaggctccaccgtgccacatcagtaggagcttcgtaagtgcgggtttaagacacgaaggacaagtcgccacgatatgcgatgaagactccccgaggagatcgaatttggtacatccatgccctcccggtttccatctaggaaattcacgggtggaggaacaaccggacgtttatgcgacaagcataatatccgacgacgagtcccgtgaaggtactaataccggggacccagccgtcgatttcaagcaagaagcaagtcggacggaggatgaagaggacgaggatgtagggcattccccatag

SEQ ID NO: 27468 - DNA, 491 bp, Glycine max
  Peptide Sequence Number=SeqID_119153
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttccccctggcggctccctcgtgcgctctcctgttcctgcctttcggtttaccggtgtcattccgctgtatggccgcgtttgtctcatccacgcctgacactcagttccgggtaggcagttcgctccaagctggactg

SEQ ID NO: 27469 - DNA, 1260 bp, Glycine max
  Peptide Sequence Number=SeqID_119154
atggtcggagattcggcgagagagttggatcgtaggaagcaaactcgaaacggcgtagtgggcctaccgtggaaatacttggaaggcaaggcaagggatatggcgaagcaagaggagtgggtcccgtttgcggatatactagctttgctaatctttggggttgtcctctttccaaacgtggacggtttggtggacctagccgcaattgatgcattccttgcatatcaccatagcaaggagagcccggtggtagctatcttggcggacttatttgatacatttgaccgaaggtgcgagaagatcagcgcactgattgtatgctgcttacccgctctttgtgtgtggttggtttcgcacctattccaacaagacataaggcacccatgtccgcttcaaagttatcgctcgtgcgtcgaaaagagaagagtagattgggaccagtacttggctaggattcggcgcgcaaagtctcaaggttgtacaaagagtccacaaggcgtgggaagtccgttgaggaaagataaagaacttaggggcatccgtaatggcatcatcggtggttatcacgaatggctaagggttcataggcgagggttagattggttctccaagttgaaagttgtcaatgaggagaacttcgaagctccggaagaggatgaagaagttcaagctctaaaattagagctaggaaaggcaagactcgccaaagaaaaattcaagtcagccgctacaaacatccgaaaagagtgcaccgagttacgagaggaaaacgtggccactgcaagagcccttgaacatgaaaccaaaagggcccacaaggaggaacatggccgaggtaaattccgaggagctttgtggggcagcaacaacgagctcaagctccggagagaggaaagggaccagtcacgggtgcatggcatgatcttaaaggaagagttagttgcttgctctagatccaagaggagtttggcacaacacttggaagccacagagcaaagcatgctagctatcatagggcaatacaagaaagagttaaaccagtcgttgacccatgaacaaaaactagtagaggacttcgcacaagcgtacaccgagaaggaagcaagaggaagggtgattgatgcattgcatcaagaagcgaccatgtggatggataggttcgccttgaccttaaatggaagtcaagacctcccgcgactaatagccaaagcaaaggccatcgctgaagtgtgtacagcccccgaggaattcacgggctaa

SEQ ID NO: 27470 - DNA, 162 bp, Glycine max
  Peptide Sequence Number=SeqID_119155
atggagggtctcttgtcaggtgaatttgaggctgcagagaactcaagtgaacaatcggatggactcaagcctagcaactggggcaaaagtttcatcaaagtctacaccttcaatctgagtgtagccttgagcaacaagtctgggccttgtttctggttataa

SEQ ID NO: 27471 - DNA, 336 bp, Glycine max
  Peptide Sequence Number=SeqID_119156
atgtctgctagtgatcatgccattttgcgagataaagtgcatcaacccaccaagaaaagcttgttggagttatcatcacaagatgctttgttggcacagaataagttgctctctagaaaacttgaaatcttaacagaaacacttggttgtaccgtttgtggtgaggctcatgaatcaggtcattgcattcctattgaagaacacactaaggaagttcattacatgggaaatcaacagaggcaaggatacaaccaagaaggatttttaggttttcaacaaggtctctacaatcagcaagggcaatggatatcacatgcctggcaatcaattcaataa

SEQ ID NO: 27472 - DNA, 306 bp, Glycine max
  Peptide Sequence Number=SeqID_119157
atggataaccactcgggtatttccgcccgtcagcgtgactcaaaagtcagtatgacagatcttgtaagtgcggaagatgatgggtgcggaatgaccataatttgtctccgcatgtcatcgggcccgccgcctctggatgacaaaagggtgcagaatgaccataatttgtctctgcgtgccatcggacacgactggggtcagtatgacagagattgtggggcggccgacaaaagcgaggctcttgctcctacgtatcctccaatgagaactcagacctacgcagttctggatacttgtgagacttaa

SEQ ID NO: 27473 - DNA, 824 bp, Glycine max
  Peptide Sequence Number=SeqID_119158
ggcttcccggtatcacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttccccagtcacgacgttgtaaaacgacggccagtgaattgtaatacgactcactatagggcgaattggagctccaccgcggtggcggccgctctagaactagtggatcccccgggctgcaggaattcgataatcacaatggacatcatctgctattgtgatcgaactgcacatgcagatatctgtcgcattgtgagtaatttaccgtttttggcatatggtcgtactcactttacgatgatttttccgaaacacaaaaatgtgtctaagtctgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 27474 - DNA, 237 bp, Glycine max
  Peptide Sequence Number=SeqID_119159
atgacagaaatcaaggaaggatcatcaaccaaaacctcacagtccattccattggagcttgtaggcctaggatcttcttcatcaatggattcctttgtttcttggaagatgaatggcagcggaatggagaaggaagagagagatgagacccccttcaaggagaagatgagtctagaagaagctcacccccataggaggccatggataagagcttggaggaagaaaggagatgaatga

SEQ ID NO: 27475 - DNA, 396 bp, Glycine max
  Peptide Sequence Number=SeqID_119160
atggtcgttttgttattttgttcttccaccatctttgccttccccttaacgtttgcgggttgtgttggcaggtcggggggtgcaaacacgcgaccgctgcgggtcatgccgctcagccccgtgatattggtcaccttggctgacaatgagctgatgtcgatggcctcttctttcctttcactcggaggtacatacctccacgggactgcgtggctatttcggtatgggaaaggaactggtttagctaccgaggggtatcggggcttttgtgaagctgcgtccttggtgaaatatatcaccaaaggtttaggcctcccaaaacttctctcatctgcggactacatatatatatgttgttcttccctcccctcatcgccgacttctagtcggccttga

SEQ ID NO: 27476 - DNA, 352 bp, Glycine max
  Peptide Sequence Number=SeqID_119161
atgccgcgtgaaggtagaaggcctacggttcgccgtcaaatcccagggctcaaccctggacaggcggtggaaactaccaagctggagtacgagacgaaagctaggggagcgaatgggattagataccccagtagtcctagccgtaaacgatggatactaggcgctgtgcgtatcgacccgtgcaatgctgtagctaacgcgttaagtatcccgcctggggacgaagaacctttaccagggcttgacatgccgcgaatcctcttgaaagagaggggtgccttcgggaacgcggacacaggtggtgcatggctgtcgtcagctcgtgccactgccggtgataagccggaggaag

SEQ ID NO: 27477 - DNA, 498 bp, Glycine max
  Peptide Sequence Number=SeqID_119162
gcctcacagggttcctttgtcgcctatggacgtcaagtcggtgccacaatcaagcaatactttggaccagctccaaggacctcccacaggtcttcgtccatggctcccgaagacctaaagcagcttatgcaaaaaattagggaccagctagaagagtcgatcacagaaaaaggactcgcactgcctcctgagactgaggttggtccttcaactgcttgtgtcagcacaaaggagagttgtgttgatccctcagggaacgatccaaacacgggaagactttatgaggggtccacaaccgttcacaacattcctttgcgccatgatcaagtcaaggttggtgctgaggaagttacagatgtagatgttcacattcctgtacccactaaagagggagctgtaggaccagcaaaaccagcagataggccgaatcatgatgtcgatgatctcctatatctaatgacattgaccatcccacagctttttcttaagccgttgtag

SEQ ID NO: 27478 - DNA, 213 bp, Glycine max
  Peptide Sequence Number=SeqID_119163
atgcaagtgaaacaagttcaattgaaaatatggtgggaacagggaaggggtcagatttatcttgacgggagcaagagtaataataatgtgtataatgctacagcagcgggtatggaccagaacttcttgtttcagaaggtgaatctatcaaacttgatcagccattacaagtatccaaatgtggtggatttggtcagggggatgcggaaatag

SEQ ID NO: 27479 - DNA, 240 bp, Glycine max
  Peptide Sequence Number=SeqID_119164
atgacaaacgaaaagtatatgttccaatccctaagccctatgtctagtggggtggtcattttcggagggaatcagaaaggtatgataaactatgtaggtaaggtatggcataaaaagcttggtcatgctagcgtgaggttaatctcaaagcttaaaaaacatagcctcgtaagaggacttccaaagctatcatatgaagatgattctcttgtgaagctttctagaaagggaaacaagtaa

SEQ ID NO: 27480 - DNA, 228 bp, Glycine max
  Peptide Sequence Number=SeqID_119165
atgggggctcccgaaaaaagtggaggaatggagaattgggcgaaccagcgctacgcaaataacttcgcgggggctcccagactcgaaggtggagggacacatgaaacaagctctaggcaaataaaattcatgggggctccgaaaaaaagtgggagaatggagaattggcgaacagcgctacgcaataactttgcgggggctccagactcgttggtggaggatgcatga

SEQ ID NO: 27481 - DNA, 445 bp, Glycine max
  Peptide Sequence Number=SeqID_119166
tggctctgttctatcagctgtccctcctgttcagctactgacggggtggtgcgtaacggcaaagcaccgccggacatcagcgctggcaagtgtagcggctgcgcaactgttgggaagggcgatcggtgcgggcctcttcgctattacgccagctggcgaaagggggatgtgctgcaaggcgattaagttgggtaacgccagtgttttccccagtcacgacgttgtaaaacgacggccagtgaattgtaatacgactcactatagggcgaattggagctccaccgcggtggcggccgctctagaactatcggggaaacctgtcgtgccagctgcattaatgaatcggccaacgcgcgggagaggcggtttgcgtattggggcgctagcggaaggtatactggcttactatgttggcactgatgagggtgtcagtgaagtgcttcat

SEQ ID NO: 27482 - DNA, 819 bp, Glycine max
  Peptide Sequence Number=SeqID_119167
atggccccaaggaagcttgcctcaaagagatccaggaaggataaagcggctgaaggaaccagttccgctcccgaatatgacagccaccgttttaggagcgttgagcaccagcagcgcttcgaggccatcaagggatggtcatttctccgggaacgacgcgtccagctcagggacgatgagtataccgacttccaagaggagatagttcgccgacagtgggcatcactagttacccccatggccaagtttgacccaggcatagtcctcgaattttatgccaatgcttggcctatagaggagggcgtgcgagatatgcgatcctgggtgagggtgctggaggagggccaggaatgcgagtatggccagaggaggaaccggaccgatggattcgatgaggaggccatcgcccagttgctatgtataccggggcaggattttgcccggactgctgctggaagacgggtgcggatcatgcgcaccaacatgaccaccctgactcagatctggatgactttgctgctcagcaacatccagcccagcgatcataattcaaacctccccctgccgaagtgtcagctggtgtacgccatcctgacacggatgagcattcacgtggctcagttaatcgctgatgccatctatctatttgcaggtatggcgcctaccaggcaccctctggacccgaataagtccaacagggccctaggatttcccgccttgatcacaggactctgccagtcgttcggagtccccgtcgcacctagcaagctaattcggccgcccatcacccgagcttttattgagaagtattgcacgtag

SEQ ID NO: 27483 - DNA, 372 bp, Glycine max
  Peptide Sequence Number=SeqID_119168
atgatgaatgtgttgagtgttgccaccttcttttgtaaaatcggtcatgcacacaacatcttcatgattcatgtacatagggactcattaggtaggaataatcaacacaaaaatatagaaaaaggggttcccatgaaccctaagagaataaaggtcactcctgagtggcccactccaccaagtgttgagggaaggagcccagagtatgaagaacctcgagatttgaggtcaaatcctttccaaggtggagggaatgatgcaatcctatcccgcaagggcattggtagaagactccaagtagattggctagagatccaagggaggcctagggttctcttgagccttagggtagatttcgagcccatgggctaa

SEQ ID NO: 27484 - DNA, 354 bp, Glycine max
  Peptide Sequence Number=SeqID_119169
atggcagtgcaaggcaagagcattcaaagacgtgtacaacccaaagcaaagatgctgggacgtgcaaaggaaagtgcaaagttgatgtgctctaggatcattatggcggcttgtgcttgcaacctggggagatgttcagtggttcaggccgagcttggtttgggtgatctatcatgggatcatatcagactcattaaggataaaggcatcccagggcaaagagaccaatcaagtggccgagacaggcttgataaacatgatggactcgaggtggctgagggagttctcgtcgtcgactctcctcctccgctcctggcagaccttgctgttgttttcttctttccttggttttag

SEQ ID NO: 27485 - DNA, 965 bp, Glycine max
  Peptide Sequence Number=SeqID_119170
atgtcaggacctgagtgttgctcaaacccaccagttctgaaccccaatgcaggagctggccatgttgaaaaactcgctggtctcaattcctatctctccggttcccctaattccattgccattcttctcatctccgacatttatggctatgaagcaccaaatttgaggaatattgcagacaaggttgcagctgctggttattatgtggttgttcctgacttcttccatggtgatccatataatcctgagaatgctagcaggtctatccctgtttggttaaaagatcatggcacggacaaaggatctgaagctgcaaaatccataattgaagctttgaaaagtaaaggtgtgatggctattggggctgctggattttgttggggggaatgtgcccttttcttcattcccacagctaaagtcgtggttgaacttgcaaaatccagactaatccaagctgccgtgctattacatccatcgtttgtctctgtggatgatatcaaggtcttgcctcactttcagaataatcatatttgtcttcacgttgacttgcagtgcattttgcatattgctgatgtccttatcagatcaagaaatggggtagggattattgtggacaaggagtggaagaaggatgtcgtggatgtaagaagagtaggagatcgtatcatagtcttaaaattggtagtgggacaggacacctttaatgttattagtgggtacgcacctcaggttgggttagcagaacactttaaggtaaaattttgggaggatctagaaggggtacttcaggatataccccaaggagagaaagttttcctaggaggggatctcaatggacatgtaggtagcgtggctagaggttttgagggggtgcatgggggttttggcctaggggagatgaatggggagggtaaatccatcttggagttttcggaggctttggatctttctatagccaatacatg

SEQ ID NO: 27486 - DNA, 342 bp, Glycine max
  Peptide Sequence Number=SeqID_119171
atggtggcagtcaataatgatgacattggtggtggtgacagaggtgatattaatggtggtggtggtaacaatgatgttggtggcgataataatgacgaagtagtggtagcaattaatgtcaatgatgttaatgatgacaacgatgatggtggtaatagcaaagtcagtgacgatgatggaactaagtggtggcgggtggtggtgacattaattgtgatagtgatggtagcaatgttagtgataatggtgatgtcattgacgatggtggtggtgatagcagtgttagtggtcatggtggtggcaaccaattacgacggtgacaacgatgatgatagtaactga

SEQ ID NO: 27487 - DNA, 987 bp, Glycine max
  Peptide Sequence Number=SeqID_119172
atgggagaaaataaacacaccggagttagtgagagagagagaaaggagagggggtgcaaacaacgggaaaagttgaattccaaaaaccatcatcatcgatccgtgccgctctacatcattaagagcccaacaacaatgcaccacgcaaccctggtcaagattcatgttgttattgttgttgttgttagtgttgttgtggttatggtgatgccaaggatcttcttccgtcttggttctcgaatcccgagccttacactgctgcttggaccaccatcacctcagcatggctataactataatctagacaaggcaatgaatccttctctcacttcttcctcaaccttgtcgtcgtcttcttcgtcctggttctccggaatcgttcgagttggccgttccaacagtgtcaaaatgtccaataactccgctgctgcaccctcctccgacactgccggccccgtcgtccgcaaaaatcagttccgaggtgttcttttcaagtacggtcccaatcctattcaggttgcatttaagactggtgatttcaagcggcaagtcatttttattggtggattgaccgatggttttctagctactcctttgcaattgcttgttgaattcacattgaaggatgctaaggagctggatcagctgattaattatttaattaacaaagaagactctgaaggtgtggcattacttgggcatagtactggctgtcaggatattgtgcattacatgcgcacaaattttgcttgctcccgagctgttcgtgctgccatctttcaggctccagtcagtgatcgggaatatcaagctacactccctcatacagcttctatgattgacttggctgctaagatgataagtgaaggccgaggtctagagttaatgccaagggaagcagatcctagtgccccaataactgcctatagggtcagactcagatgtacgattagcatcgattctgatgatgcattgtttggaaactag

SEQ ID NO: 27488 - DNA, 165 bp, Glycine max
  Peptide Sequence Number=SeqID_119173
atgctgctcggtggctcccttcccaatcgtacttggtttgttgattgcgatagggctctcagcgtcacgcgcggaaacgacggcataaatgatagtaggttccaagatgaaggaactgtgaagaacaacaatgatagtaggttccaagatgaagatggaaaatga

SEQ ID NO: 27489 - DNA, 498 bp, Glycine max
  Peptide Sequence Number=SeqID_119174
atggcgaagctaatggatggagccattggtggtgccgccacaattcttggaggttgtcatcatcgtcttgaactcctcaaagttgatgcagccgccaccgttggcattgacagacttgatcatgtcgtgaaatttgtcgatggagcacttgaggccgaggcggttgagcacgagctggagctctgcggcggagatgaggccatttttgtcacggttgtagagatcgaaggcgtcgcgaaactcgttggatttgccatcgatggaggcgtcagagcgacaaaaggcggcaaacttcgtgaagctgatgaagctgtcgcaatcggtgtcgaggtcttccatgacacgatggaggtcctccggagagacaccggatttgagcgaccagagcacgttgtcgagctcgtcggcggagatcttgtcgtcgccgttggcgtcaaggaattactcgaactcttgaagagggatgcaataacacactctgtatgtaacgtaacgtaa

SEQ ID NO: 27490 - DNA, 216 bp, Glycine max
  Peptide Sequence Number=SeqID_119175
atggcaagcaaggagtctaagtttccaccacagagccagaaaactcagccaggaaaagaacatgtaatgaatccactcccacaagaagaaagcagtcttatagataggtgcattatctcaacagaagatgaaggactggctcagacgcataccaacagccacgttggttattatcaagtcgtctcttgcattgcaggccttagtgagacaacatga

SEQ ID NO: 27491 - DNA, 342 bp, Glycine max
  Peptide Sequence Number=SeqID_119176
atggggaaaaaaaatcgagcaaacgttcctacattgaagctgtactggaaggtcatgcttgcactggaaatgaggcattttggggttgttggaattgatctctctgggaatccagctgttggtgaatggattacatatttgctagcattgaaatttgctcgagaacaaggtctttatgtgactcttcactgtggagaggtatcaaattcaaaggagattcacgatatgctcgactttcttctgcagaggattggacatgcttgtttcttcaaggaggaacactggagaaggctgaagtcctctaacattccgggaatcagcttgacaccatgcttttggtga

SEQ ID NO: 27492 - DNA, 1275 bp, Glycine max
  Peptide Sequence Number=SeqID_119177
atgaacactcgcaaacactcaattccttcaccgcgcaacttcccttccgccaacacctctcccgtcaatttccgccgcagctccccgaagactcacctttccgccaggaagctcgcagcgcgtttatggcacttgcgctttttcaatcttgaatcttctccgccacgtgtcaagcgttcagcgcaagaggttaccagacgcgatagcaggaagcttctcggagaaaccaaattaataggtggtgagtctcttctcctctcagaactccttcgtgctcaaacctgcattaacaggctcaatgctgaaaagcttctctggaagcgtcgagaactcaagaagaatcaatcaatgctagaggacttaaaggataagttagccagggaaaggacaagtagggagagaatggaatcaatgaatgccaaattagttcttgagcttgcccaagcaaaactatatgccaagcaatttatggtttactacaaggaggaaaagaggaaaagagaaataatagagcaagtgtgcaacgaattggcgatgcaaataggagaaggcaaggctaagctggagggaatggaggaagagaggaacatgcttcacatagcagggctgctgcgtgaagagagcatccaaatgaagctactcgacgccaaactttccctggaagataagtataatcagatgatccaattgattgcgcatctgcaaagtttcttgagctcaagaggtgatcaacaggcagctcaatcactcaatgttgaaatttcatgtgacttcaccaagtcaaatgatgtttttcatgagagactgattcaagttgaaccgtactatccttccagtctcattggcccctcttccaccgtccacatcgtaagtcttgatgaagatcattccctcaacaataatgctaaccaaaacattcatggattaggaactgaggcagaatgttgtgaaaatgcttgttacaatcactctgattccctggcactacaaaaatcacaagattcaaaaattgttaactgtaaagggagattcgcaagaaacttagttaagactacttttatgagtaaaggttcgggtgaaagtggtttcagacaatgggaattattgggacaaccaaaatctgcagagtctgtgaatccgcacataactcgtgggatgaaaggatgcatagaatggccacgaggcatttccaaaatcaattccaaggtcatccctttggaagaaagagtgcgaaaacagaaatctcagttacaacatatacttaagccgcattaa

SEQ ID NO: 27493 - DNA, 2694 bp, Glycine max
  Peptide Sequence Number=SeqID_119178
atggctcttaaggctgtatccatctggggttgttacaaacctcctcctcaattgggtgttggtgtttccaattctcattctactctgattggaaatctaagatatgattatgacaaatgccgcaaatgggagtgctgttgtttgggtgttttggctcagagagctaccactgctgtggaagatgagggccccagtgtcccacctttggttgactcttcaggggctgctgatggtgttcaccaaaatgagtcaaagggctttcacaaggacttaaacttacttcctaagccattaacagcaattgacatttcttcttatccaagagatggatcaaaggtgcgcgtggcttatcagggacttccgggggcatatagtgaggatgcagctttgaaagcatatccaaaatgtgagactgtgccatgtgacaattttgaagctgcatttaaggcagttgaattatggttggtgaataaaactgttctacccattgaaaattctgttggtggaagcgtccaccgtaattatgacttacttcttcgccataggctgcacattgttggggaggtgcagttgcgagttaaccactgccttttaggattgcctggtgtgagaaaggaggagctcagagctgttgtgagtcatccccaggcttttgctcaatgtgagacaacgcttagtgatttaggtgctgtcaagattgctgcacgtgatactgctgctgctgctcagacagtggcctcaaattgtgcaagagacactggagctattgcaagttcccgagctgcagaagtgtacgggcttgacattcttgcagaaagaattcaggatgatgatgagaatattactcgtttcttggtccttgcaagggagcctataattccaggaactgacaggccccataagactagcattgttttcagtctagaagaaggtccaggtgtactattcaaagccttggcagtttttgctatgagggatattaatttgtcaaagatagagagtcgtcctttgaagcagcgctcattgagggttgtggatcatttaaatgaagggagtgccacgtactttgactacctcttctatattgatattgaagcttctatggcagaacctcgtgcacaatatgctttaggacagttgcagttggcacatgtcatctcctctactcgagctgaagcagggatgaggaagttaagtctaggctccttttcaatggcaaactctaatctcgtcatcatcctctacttctccttcttcaccttcgctgaagcagaagcactacattcccagcttaagcagcaaatccaagaccaagagaagcttccattcgtgggcgtcaacatcggcaccgacgtctccaaccttccatctgcctcggaccttgtcgcgttccttcaactgcagaagataacacacgttcgcatctacgatgcaaactcagacatcctgaaaactttgtcggggaccaagattcgcgtcatcatcagcgtccccaacaaccagctcctggcgattggttcctccaactccaccgcggcctcctggatcgatcgtaatgtcgtcgcttactacccccaaaccctcatcagcggaatctccgtcggcgacgaggttctgaccaccgtcccctcctccgccccgctgattctccccgccgtcgagtccctctacaacgccctcgtcgcctccaacctccaccaacatatcaaggtctcaacccctcacgccgcttccatcattcttgaccctttccctccctctcaggcttacttcaaccaatccctcgtttccgttattctccctctccttcagttcctttctcgaaccggttcccctctcacgatgaacctttacccctactacgtcttcatgcagaataaaggcgtggttcctctcgacaatgctctcttcaaacccctcactcctaataaggaaatggtcgaccccaacaccttgcttcactacaccaacgtcctcgacgctatggtcgacgccgcttatttctccatgaagaaccttaatatcaccgatgttgctgttcttgtcactgagacaggttggcctgccaagggtgattctaaggagccttatgctaccaaggacaatgctgatacttacaattccaatttgattaggcatgtttttgatcgcaccggaacccctctgcaccctgaaactacttccagtgtgtttatttatgaactgtttaatgaggacttgagggctccgccggtttcagaggccaattggggtttgttttatgggaacacttcgccggcttatttgcttcatgtgtctgggattgggacttttttggcgaatgataccactaatcagacatactgcattgccatggatgggtttgattctaagacgttgcaggccgcgctggattgggcgtgtggaccggggcgagccaattgttccgagattcagcctggagagacttgtttccagcctaataatgtgaagaaccatgcttcttatgcgtttgatagctattaccagaaagaaggcaaggctcaggggacttgtgacttcaaaggactggctatgatcaccaccactgatcccacctaccttagtttaattgattccacattcgatgtaatgcagcaagaaagtgagcaacaagacaaaggaagtggtcaactctactatctcaagcagtgcaggagagaagttgaggtttaa

SEQ ID NO: 27494 - DNA, 285 bp, Glycine max
  Peptide Sequence Number=SeqID_119179
atgaagtccttgaagaccctcttccttctagccatgctaatggctttggccgtttttgtgtctggaatatctcccggaagtggagaaccaaaagggaaaattaatcgattcctttctgaccgggtggtgctgaaatgtgacaaatacccaaagatgtctccaattgtgggaaatgtggaaagaaatgtagctatggtaagatatgttgcgaagtacatatatgaaatggacgagcatgtctgtgttacttttggggccaatgcacgcaacaacatctttgtgtga

SEQ ID NO: 27495 - DNA, 753 bp, Glycine max
  Peptide Sequence Number=SeqID_119180
atggagaatcagaaggttgctgctttggcaaaggtggggaagcctgcaactaaggtcaaggctttgtcatttggggagagggctaagctgtcaaaaaatccaatcggaaagaggttgtttgagataatggctgaaaaggagagtaatctgtgtttggctgctgatgttggaactgcagctgaattgcttgaaattgctgggaaggttggacctgagatatgcttgctgaagactcatgtggatatttttccggattttacacctgattttggctctatgcttctctcgattgcagaaaaacataacttcttaatcttcgaggatcgtaaatttgctgatattggtaacacagtgaccatgcaatatgaaggtaacacctcaactcatggcctaacatgtttcttgaaccatgctcagggtttacctcgtggcaggggtctattactgcttgctgaaatgagttcagctggtaaccttgccaaaggagattataccactgctgcattaaaaattgctgagaatcattctgactttgtaattggcttcatctcagtcaatcctgcatcatggccaggggcacctataaatccttctttcattcaggcaacccctggagttcaaatggtggtccatgataggggcagtgacatcatcattgtggggcgtggcatcatcaaagcagtaaatccagaagaggcagctcgtgaataccgtcttcaaggatggaatgcgtatttggctaaatgtacttga

SEQ ID NO: 27496 - DNA, 1083 bp, Glycine max
  Peptide Sequence Number=SeqID_119181
atgtcttgttgggcatgcaaaaaatgcacctttgtgaatctcccttctcaaaaaggggaatgcgaaatctgcttttcccccgcgtccccattgtcaatgggtccttcttgttcttcgtcgcccccaaaatggtcgtgcaaggcctgcactttcttaaacccttacaacaacccttcttgcgaggtctgcgccactcgatgctccgttctctccctttccaatctcaccgacttgaatgacgccaccgatcacgattcttctgtcggttctgttttctttcctcttcgaacctgcaacaagagaaaggccattgatgatgacgattcttctgaggtcatcaatttcaaggtcaagccatccaatatcaccggtgatgagaatatcgacacaggaaaagcgtttaagatattgagttacaatgtttggttccgggaagacttggagttgcacaagaggatgaaggctattggcgaccttgttcagttgcattcacctgactttatctgtttccagttaagcaaactgcctgtgaaatcattcagcaataagcccttcagcaattctataatgggaagagaactttgcattgctgaggttgaagctgcaagtggcaagccattggttattgccactagccatcttgagagtccctgtccagctcctccaaaatgggatcagatgtacagcaaggaaagagtagtgcaggccaatgaggctataaaccttctcaagaaacagccaagtgttgtttttgggggagacatgaactggaatgaccaacaggatggtcaatatcctctacaagatggatgggttgatgcctggtctcagctaagaccaaatgaaagtggttggacttatgacaccaagtcaaaccagatgttgacaggcaaccgtactctccaaaagcgattagatcgctttatttgccaattcactgattttaagataaccagtgttgacatgattgggatggaagcaatacctgtaagtaaagccagtcaggagaatctggctggtgaaaccattgttatgatgttctcactctccgctgttgctgtatctgcatgcaattttgtatag

SEQ ID NO: 27497 - DNA, 2625 bp, Glycine max
  Peptide Sequence Number=SeqID_119182
atgatagagttctcaagatactcaaaacattcgggaactgtccagaggaaagctgacaaaatccctgagtatggtcacaagaaacaagaactaaaaggggaagaaactatgagatgtttaaagaaaattaatgcagtaagattggaagctagggttacacaaggagaacaaataaatcagcttgctaaggacaagatcttaaaatgctcgaaagattttggaactacaaagacgaaaaaggttgaagaaatttataagtgtgataatacaaaatcgaagtcatgcaagaaaggacatgagacacagaagcttactgtctcaaacaagaaaaggaaatttgaagatgatctcttgaatgacgattttgaagatgaagaaatgctcattcttttaaagtcaaggaccaggagaagaagaatgaataatgttatggatgttggacaaaatccccgaaaatgtcatcaatgcatgaaaaaggagagaacattttttgtgccttgtactaaatgcccaaaaatgtactgtatgcgatgtgtcaataaatattaccctgatatgtcagtagaagaaattgcttcaagttgtccattttgccggaaaaattgcaattgcaatgcttgcttgtgttcaaaaggaatgattaagacagctaacagggatatcagcgattatgaaaaagctcagtatctgcaatatatgattaaattactcctaccgttttttgaacaaatttgtcatgaacaaagtcaagaggagcagattgaagctaaattactaggaaaatcttcttttgagattgagatacaccaaagtctttgtggcgatggtgaacgtgtctattgtgaccattgtgctacttcaattattgaccttcatagaagctgccccaactgttcctatgaactctgccttagttgttgccaagaaatacgtgatggaagcattacaccccgggctgagctgaagttcccatatgtaaataggggctatgattatatgcatggtggggaccctctacctgtgccttgtgatttagagacatcagaaggtcatattgagccgtctactgtgtggaaggctaagagtgatggaagcattagttgtgcgccaaaggagttggggggttgcggtagtgctgtattggagctgagatgcatcttcccagatgggtggatatctgacttggaaaccaaagcttgcaatatgctgaaattatgggaaattaaacacaccactcttcagcaaaaagcagcaagttcaagctacacctttttgagaaaggaagctattaaagaaggcataaatgacaataacatatactgtccagactcaagtagcactaaaaatgaagggctgttgcttttccaaaagcattgggctaatggtgaaccaattatagttcgtgatgtccttaaacagggaacaggactgagctgggagccaatggtaatgtggcgagcattatgtgaaaatatggtttcagaaatcagttcaaaaatgtcagaagtgaaagccattgattgcctagctaattgtgaggtagaaattgatactcacacattctttaaaggttatacagagggaagaacatacagagatctctggccagagatgctcaagctaaaagactggcccccctccgataaatttgaagatcttttgccccgccattgtgatgagtttattcgctccttgccatttcaagagtacagcgatcctcggactggaattctcaatcttgctgtgaagttgccagcccacgtcctgaaacctgacatgggtccaaaaacatatattgcatatgggattaaagaagagcttggtagaggagactctgtaacaaagcttcattgtgatatgtcagatgcggtgaatattttgacccatacagctgaggtgatattaactgatgagcagcactttactatatcaaagttgaaagaagcacacagggcacaaaatgagagagaacagtgtgcccaagagagggttgctgaccacctggaggatcgaccttacaaagacaacaaagaacatatagaaaataaggaagttcttgaagccaaaagcatgaagaaacaacctattgaaattgatggaaacatctttccaaataatgtgcttgagaggtacacttctcctgctacagagaatgaatcaatggaaactggtagtgccctatgggatatctttcagagagaggattctgaaaagttagaaacatatcttagaaaacactcaaaagaatttagacatacttactgttctccagttgaacaggttgtacatccaattcatgaccaatgtttttatttgacatgggaacataagaagaagctgaaggaggagcttggtgtagagccatggacttttgaacagaaacttggggaggcagtatttattcctgctggatgtccacatcaagtcaggaatctcaagtcatgcacaaaagttgctgtagactttgtgtccccagaaaatatccatgagtgtctgcgtttaactaaagagttccgccagcttcccaagaaccacaaggctagagaagataagctggaggattatatggtgacgtgttttatccttgacggaacagataaagaagatgatagtttatgccgttga

SEQ ID NO: 27498 - DNA, 1302 bp, Glycine max
  Peptide Sequence Number=SeqID_119183
atggaagctaaactaaactataacagaatgatgcaggcagaacaagctagaaaagcattagaaggtgcactaagtgggaagaaaaatgaatttgacaagtggaacaaggaaattaaaagaaaagaagagctgggaggtggaggtgacactggtggaggtggttggtttgggtggggtaaacggtttggctggtctaatgatgataatttttggcaagaagcaaaacaagctattcttactatacttggtcttgttctagtatatctcctagttgcaaaaggcgatgtgctccttgctgtcatcttcaatccattgctatatgcacttcggggggtgagaaatggatttggtttcatttcatcaaaagtcttgaaaaatacttctaccagcaatcagccagattttggtggactttcacagaagaaagcttatcagcatacttctgccatggagaatgttgtaagaaaatggggtggtggttcttgtaaaaagctagcttccatctgggttttggcaccgttgatgtctttggccattggggtggtctccaattgcaaaagcaatatgggttttgatgacaacaaaggcaaagaggttcctgaaatgcagcactcgggaaaaacggttcatgttcatgaagatgaaagtggcgatgaacgaggcacgagtctcagtagacacatgagtgaaggctccattgctgccaccgaggatgaagatgaggacgttgagaggaggattgacttgggtccccagtgcaccttgaaagaacagcttgaaaaggataaggatgatgagagcttgaggaggtggaaggaacagcttcttggcagtgttgacatgacttctgttggtgatcatcttgatctcaaacaggagtctagtcaatctctggagccagaagtgaagatactgagccttgcaatcaaggcggccggtagagaagacattgttcttccaataccagagtcaggaaatcccagtggcttatggtttactttgaaagaaggtagccgttacagtctcatgttcactttccaggtcagccataatatcgtttcaggtctcaaatacaccaacactgtatggaaaactggtctcaaggttgacagcactaaagagatgattggaacattcagccctcaagcagagccttacacgcatgagatgcccgaagagacaacaccatctgggttattagctagagggcaatattcggctagatcaaagtttgttgacgatgacaacaagttgtatttggagatcaactacacttttgatattcggaaggaatggcattag

SEQ ID NO: 27499 - DNA, 597 bp, Glycine max
  Peptide Sequence Number=SeqID_119184
atgagtcaactcggtctcatattgcaggaatcgctccgcaccgagagagaagcaagaaccattctgggtttgttaacggagcaaatggacagcgtcggtagaggccaacggaggagacggaccctcaaagaacgcctcagattcaccggaatcggctgttgtggagccacgtgggttttccgtccaattgtcagggacgaaggaggaggggcacaagcacaacaacagccgcaggaaacaaatgcgggtcaagatccgaatcatactgggcccgaacatgtgggtccgagtcagtcgagttcgggaatgaatcttgcggcggcgctggcggcggagcgtcagttccgtgagggtgaggggacgcctttgagggtgtcgttgatgcggctgttggaggaaacagagggtggggatgcggcggtggaagcagtggggaatgattgggtgtgctgcgtgtgcatgggaaggaagaaaggcgcggcattcatcccgtgtgggcacacattctgtagggtgtgttcgagggagctgtggttgaacagaggtacttgtcccctttgcaaccgttccatactcgagattctcgacatcttctga

SEQ ID NO: 27500 - DNA, 861 bp, Glycine max
  Peptide Sequence Number=SeqID_119185
atggagggtatttcttctagagtgatgggttttggagagaatacaagtagtagtgggatccccaacaacaactatggaggctcctcttcttccgctatcaaggccaagatcatggcccatcctcactatcaccgtctcctggcagcctacgtcaattgccaaaaggttggggctccgcctgaagtgatgggaaggttagaagaagcatgtgcatctgctgcagtgacaatggcaggtggaacagctagcataggcgaggatccagagctggatcagttcatggaggcttactgtgagatgctgatcaagtacgagcaagagctctccaaacccttcaaggaagccatgctctttcttcaaaggatagagtgccagttcaaatctctcactatttcttcttcgttggacactactgcttgtaatgaagctattgataggaatggatcatctgatgatgttgatgttcagaccaacataatagatccacaggcagaggaccaagaattgaaaggtcaactcttacgcaagtaccgtggatacctaggcagtttgaagcaggaattcaccaagaagaggaaaaagggcaagctgcccaaagaagcaagacaacaattacttgaatggtggagcagacactacaaatggccttacccatctgaatctcagaagctagctcttgcagagtcaacagggctggatcagaagcaaattaacaactggtttatcaatcaaagaaagcggcactggaagccttcagaggacatgcaatttgtggtggttgatccaagccatccacactactacatggaaaatgttctgggcaatccctttcccatgaatctctcccacacaatgctctaa

SEQ ID NO: 27501 - DNA, 741 bp, Glycine max
  Peptide Sequence Number=SeqID_119186
atgcaagagtcttacaccgatagatcctccactattataacagggcaaggcgaaaaccctaatgaaaagaatcagaataataataaaagctcatcaaccctttcttttcttctcttcgttttctccttaaccatgaagaagctctaccgtaaaggaaccgtccacccctctccctcgccgtcgccgccaaccatctccgaccacctatccttcctccccgccgccatcctcaccctcactctttccctctccccgaaggaccaagaagtcctcgcatacctcatctcatgctcctcttcctcatcctccaccaccaacttttccggcaaccatcgccggaaccctaaggttgtcgtggacggcgatcaccctcctgtcttcaactgcagctgcttccgctgctacatgagctactgggtccgctggaactcctctcccaaccaccaactcatacacgaaatcatcgacaccttcgaagactctctggctcacaccacaaaaccttctagaaaggataagagaaacaagaggggctccaaaaccaagccttccgagttgactcgctccgagtttccctcttcgccgccggaatcggtgccggagagtagcagtagcagcgccggtgccggtgaggttgaggctggtcagggcggtgatggtggcggcgatgaggagaaagggtcggtgagaaggtttgttagtttcattggagaaaggatttggggcgcttgggctcagtga

SEQ ID NO: 27502 - DNA, 1011 bp, Glycine max
  Peptide Sequence Number=SeqID_119187
atggtgacggaccaagatatagcgaaaggggtggagtccctactgcgtcactctgacccaaactccataactacggtaaacggcgtcgttcagcagctggaggccaaactagggttagacctctctcacaaggccagtttcatcagagaccagatcgatcatcttctccggtcacagccacagacatttgctcctcaccctcctccacttcacaaagactattttgcccctcacacccaactgcacttcccaaccacccactttgctccccattttgccctccatgacgagatcaacttcctgcagcacccccaccctcctccaccgcgtaaagtcgagacctttcctcctcaaaatgttgcccctcctcaagtgcccaaagaaagtgtgcaaactggaagcaaaagaagaggtggtgctggtggtctaaacaaagtttgtggtgtttctcctgaacttcaggcggttgttggtgagccggcaatgccaagaactgaaattgtgaggcagctgtgggcatacataaagaaaaacaacctccaagatcctggtaacaaaagaaagataatttgtgatgatgccctgcgtttggtatttgagacagactgcaccgatatgttcaagatgaatcagttgctagctaaacacattatcccacttggtcctacaactttcaattttgttgctccagaggagtcacaggctaaacgagtgaaggtggatactgaaattaagactgaaagtgctgaacctgctccatctaccgtggcaatatctgaagcgcttgccaaatttttgggcactgagggaagagagatgcaacagtctgaagccataagacttgtttgggagtacatcaagcttcaccatttggaggatcctttaaattcaatggtgatattatgcgatgcaaagcttcaagagctacttggatgtgaaagcatttctgctttaggaataccagagatgttagcacgtcatcatctatttaaacagtctgacacccgttag

SEQ ID NO: 27503 - DNA, 321 bp, Glycine max
  Peptide Sequence Number=SeqID_119188
atggttgagttatacggccttgcacatatgccttatttcgagtgttacactaatcatgtaaacaccaagcacgatccccatttgaacaatatgctcaaaatccatcaatgcaatgccttcttcgccgatgtggatcatcttcgcaagcaaggaattacaaggctgcaagttaagggccttgttgaggcgagccattttgccaaacacgtggagtgtgtggcacattatgtcgtgttctgcaaaggccttgaggagcatgccaaatacggcttaagggaagagtttggcacgagtgagaatatggaggagaaggcaaaatga

SEQ ID NO: 27504 - DNA, 1032 bp, Glycine max
  Peptide Sequence Number=SeqID_119189
atggcaaggtatgatggtgtcaacagcaaaaacaaagaagagggtaaatccaaggaaaagaagaaaaagaaaagcaagttagtttctgaatctcttgccactaatgtggaagatgatcaattagagtcagtagctactgctaaagaaaataaagaaaaggatgatgtttctacagatgccaaagttattaatggttctgagacagagaaaaaatccaagtctaaaatgaaaaagaaggacaatcgaagtgatgaaggtgatgcaatagagcagattggagatcccaatgaaactgtttcaaaggaagagaatattgaagcaaacaaagaaattacacatgaggagaagaaagattctaagaaaagaaaaagatcgatttctgaagaaaatggtcaacaagttgcagatataaaggcagatgaagaaaccaaacgcagaaaaatagaaaatttgaatgaatctaaggagcaaaccaatgggaaccttgagaaggctggagagaaatcttctgtacagagttctcagaagaaacaacaaaagggatcagttgagaaaaaaccagttaatgcagcatttcagcgagtacaagttgacaagatacaatttgctgatgagaggcttcaggataactcttattgggcaaaggatggtgccgagaatggttatggtgctaaagcagcagaaattctcgatcaagttagaggaaggggttttcgtcatgagaagactaagaagaaacgtggaagctaccggggaggacagattgatttacaatcccactcaacacaaagcgaatcatgctgcggatatgaaatttgtgatgggggagaatgttacatccaaaagacattgctaggttctggtaaacaagttgactttcacctattaactaatgtgaccgaagcaactttgcaaaattatgaggggacgggttccaaactagcagtgaagcggcaaaaatatgggttttataactgtgttagttacatggtagagttgctagctagtattgcatttacggaaactaaatga

SEQ ID NO: 27505 - DNA, 375 bp, Glycine max
  Peptide Sequence Number=SeqID_119190
atgggagtttgtgtggggattgtcgataaaaccggaaaatggaaaatgagagagaaatgggagtttgagctgaatgagacaagaagaagaaaagcaagaggcatgaaggaagaacaaggaaagtcagctcagctgcgaataccgaccagtgtaatgtacggtactattcaacaacacatagaatcttcttctcatcccatgtgccttctgacaaaccagaaatcattatctattccttcattgccacctcagttatgctctttccaatatgcctttgacacgagtgttcatggccttcaatccaatctgaaacgtaatagcaattcatttagaatggattggattggaattgcatcaagaagaaactatcattaa

SEQ ID NO: 27506 - DNA, 216 bp, Glycine max
  Peptide Sequence Number=SeqID_119191
atgaagtctgggacaagcacaggcatacaaaaggaaaaaggtgaaggagactggttcgattcaggtcctaatcacactgatattggagttgtggtaccgtgtccgtgcgtgactcaagacaaaacagaacagaataatgccaaaggcagactaggtgctatgcacatcttaatggcctttcctttgtgtccaaacttgaagcattatctcacttga

SEQ ID NO: 27507 - DNA, 840 bp, Glycine max
  Peptide Sequence Number=SeqID_119192
atggaaactggaggctttcacggctaccgcaagctccccaacaccaccgctgatgattttattttcttgattcgtttccctattataaggcctaatctgagtgtgaggtgtgaggtgtctcttccaccctacctaggtggtttcagtaaagcgcataagtattactcttatcaagaaagcaagcagggcaagttgaaggtctcaagtctcaggttgaagctgtcagtgtcagacatgaacatgaggcagcaggtagcatcatcagatcacagtgcagccacaggagaggagaacgaatgcacggtgagggagcaagacaggttcatgccaatcgccaacgtgattaggatcatgcgcaagattctccctccacacgcaaaaatctcggacgatgcaaaagaaacaatccaagagtgcgtgtctgagtacatcagcttcatcacaggtgaggcgaacgagcgttgccagagggagcagcggaagaccataaccgcagaggacgtgctttgggccatgagcaagcttggattcgacgactacatcgaaccgttgaccatgtaccttcaccgctaccgtgaacttgagggtgaccgcacctctatgaggggtgaaccactcgggaagaggactgtggaatacgccacgcttggtgttgctactgcttttgtccctccaccctatcatcaccacaatgggtactttggtgctgccatgcccatggggacttacgttagggaagcgccaccaaatacagcctcctcccatcaccaccaccaccaccaccaccaccatgctcgtggaatctccaatgctcatgaaccaaatgctcgctccatataa

SEQ ID NO: 27508 - DNA, 414 bp, Glycine max
  Peptide Sequence Number=SeqID_119193
atgagtgagaaagatgaagaaagcaatagaaagatcgaattacactgcaagcccgggggatccactagttctagagcggccgccaccgcggtggagctccaattcaagccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 27509 - DNA, 4938 bp, Glycine max
  Peptide Sequence Number=SeqID_119194
atggctaattggaattgtgagctcagagtgattgtgtctgtcaagtgcaaatcattccacatgcttaagttgttaggagaatgcctagcaattgtgaaagcccttcaagctcagtgtgcacaaagctcaaacctggcactacagtgggttgctcgtttcagtccattgctccttcgtggcagtgaggaggagctggtgaatttactgaaagatgataatgatacaattcaggaaggtgttctaaatgttttagcaaaggctggtggtactattcgtgaacaacttgcagtcacatcaagttctgtagaccttatattggagagactatgtttagaaggcagtcggaggcaggcaaagtatgctgtccatgcactggctgcaataactaaggatgatggcctcaagatgagccttggtgtgatggtaatgttactgccttgtgacctggaggtctcgggttcaaatcctggagatagcctctatgctttcagtgataaggctgcctataaacttgtagatatgctggaagataaaacacatctgcctgcagtacttcagtctctggggtgtattgcgcagacagcaatgcctgtctatgaaaccagagagaatgaaattgtagaatttatactaaacaagattctaaaaagtgatagtaaagaagataacatgaaaacttcttgggatgataaaagtgatctttgtatgttgaagatatatggcattaaagcatttgtgaagagctacttgccagtcaaagatgctcatattcgtccaaatattgacagtcttctggatatccttaggaatattttattgtatggtgaaatatcgaaggatctaaaatcaagttcagttgatatggcccatttgaagcttgcttctgcaaaggcagttcttcgtttgtctagactttgggatcacaagatacctgttgatctttttcacttaactttaagggtgtctgagattagttttcctcaagctaagaagattttcttgagtaaaattcaccaatatatcaaagaccgccttttggatgccaaatatgggtgtgctttcttattcaacatatttggatccaagccagatgagtttgcagaggataaacagaacctctttgacattattcaaatgtaccaccagttgaaggcacggcaactttctgtgcagtcagatgcaaattccttgatcacttaccctgaatatattcttccatacctagttcatgctcttgctcacaattcatgtcccaatgttgatgattgcgaggatgttggagcatatgatgatatataccggcagttgcacctaatactgtcaatgctactgcaaagagaagaagatgctaagtcagaagtaactactgacaaagagaaggaacttatatctactatcacttctatctttctgagtatcaagcattctgaagacatggttgacacatcaaagtcaaagaattctcatgcattatgtgagcttggtttagcaattaccaaacgcttagtgcagaaggatgttgatttgcaaggattgtcccatttggtttctctacctccattgctatacaaagcatctgagaaggaaggagatgacactttggtaactgaagttaaaagctggttggctgatgaaagttccttgacccactttgaatctcttgaactagaaatggttcaatcccaatcagcagaggatgaagcttctaaggaagatgaaaaagatggaaatgaaatacctttgcgaaagatgctaaagaacataaaatctcagggaaccagtggcaaaaaggtgaaaaggaataagtctgtgccagctgaaacaaaaaaggctgaaaatgattttgacatcttaaatatggtcagagaaattaatgtggataacttggagacccccactaattttgaaccaagtaatggccatgaccattctttgagtaagaaggagctgaaggatccagagtctgcaacaggcaaaaagagaaaagctagagaaacaacacctgctccagtgcctaaacgtaggcggtcttcttctgctcatggaaaattgagattatcgactagtatatcaaaggcatctcgaagagtttcaggagaagactcccctcaacccaaattactgcttgatgaagaagttaaccctgatgcagatagcaaaaccatgcagagaaaaatggtcaaaggaagtgagaaagatttgtcattatcctcattaaaacgaaaagttaagggttctgacagttaccataatgatgagttgaacaaacatgatgaacttgacatgatgagtcctgatagtacacaactaagtgataagactgtaggaaacaataacaagtcttccacaggatccgctaaaaaggggaaaagaaaaagtatttcaggattggctaagtgcatgacaaaagaaggtgaaattgatactgaagatctaattggctgcagaattaaagtttggtggcctacagataagaaattttatggaggcaccattaagtcctatgaccctttgaaagggaagcatgtgatattatatgatgatggagacgtagaaatactccgtttagaaaaggagcgctgggagcttattgacaagggccgcaaatctatcaaggtctctggtggatcagatgaggaatttaatggaggattcaatgaaatcacaacaaaggagaagaaatctaacaaaaacacaaaatcagtttccagaggaaagaggctaaagaaagagaaaaactttcattatagaaaagaaacaaatgaagagaagcaggattatagtgaaaggctttctgaagatagagaaagtgtcccacaaggtagttctgaagagaaagaagtggatgaatcaagtggagctttgaggcaaaatattaatggagaagaagaatctgattctgaagggcatcatgataacagcgatgctggcagtaatcctagagaaatggagaaatcacatctagagccatcaaaaagtccccatgatgatgacaacaaaacaatccctgagatttctgatgacgtgcctctggtaaacaactcagccgttgcatcactcatagtaaatggaagtgtaggacggggaagaaaagctcagggaaagaacaatgagcagtttagctattgttatttgtctgtcaagaatgcagcggagttgatgctgtggtacaagtacagtataatggacgaacaattgaggatactaaaagtcattgttgtgcaaggcaaaaaattagtgatccgggattcaagagcagtgacccttatgttgttgtcaagctggggaatcagggtcattcattgttgcttgaatcctgtctggaatgaagagctgaatttcactgtgacagaacctttgggagttctgaatttggaagtatttgataaagattttttgaaggctgatgacaagatgggaaatagttatctgaaccttcaaccattaaactctgcagccagattaagagatattttaaaggtgtcttctggtgagacaacattgaggaaggtgacaccggacagtgaaaactgtcttgctcgtgaaagcagtatcaattgtgttaatgacatcaaaaggccttctttcctcatttcggacgcacgctccccatccatgtctacttgtgtaaaatcccgagatgtttgtattgttggtgttgcacggacgccaataggtggtttacttggcaccctatcatctctttctgccacagagttaggctcaattgctattaagactgctctcaagagagcaaatgttgatccatcactcgtgcaagaggtgttttttgggaatgttcttagtgccaatttagggcaggctcctgccagacaggctgcattaggtgcaggaattcctacatctgtaatctgcactactattaacaaggtctgtgcatcagggatgaaagctaccatgcttgcagcactcaccatacaattcggtctcaatgatgttgttgtggctggtggtatggaaagcatgtcaaatgcacctaagtacattgcggaggccaggaaagggtctcggtatggacatgataccatcattgatggtatggtcaaagatggcctttgggatgtctataataacttcggcatgggagtatgtgccgaactatgtgcagatcagcatgtcataacaagagatgagcaggactcttatgccattcgaagctttgagagaggaatatctgcccaaaatgctggtcattttgcttgggagatagttccggttgaagtttccactggaagagggagggcttccaaaattgttgataaagatgaaggcctggggaagtttgatgctgcaaagttaaggaagcttagaccaagctttaaagaggtcgggggttctgtgactgctggcaatgcttctagcataagggttgtctcgtctcgttgcaagaagtttgctaataaattaatacttatgccttgcaatagttatggttctaaactgcatgctcttctgctgataatggattggtttattggcttgactagtgatggtgctgctgcattagtgctagtgagcgaagagaaggcacgtgagcttggattgcatgtaattgcaaagataaaaggatatggggatgcagctaaggcgcctgaattatttacaactgctccttcccttgcaataccaaaagctatatcaaatgctggtcttgatgcttctcaaatagattattatgaaataaatgaagctttttcggttgtagctcttgcaaatcagaagcttcttggtcttgatcctgaaaaagttaacgcgcacgggggagctgtgtcattggggcatcccttgggttgcagtggagctcgcatcttagttacattattaggggtattgaggcagaagagagggaagtatggtgttgccgccatctgcaatgggggaggaggagcatctgctcttgttcttgagctcatgtaa

SEQ ID NO: 27510 - DNA, 566 bp, Glycine max
  Peptide Sequence Number=SeqID_119195
atgggcttttggggtagtaaaggatatggaagcccaataaacgtagaactgggagcccatcaaagtgctttctatttgttcattttgttgttcgaagccaaaaccctagcagccggcgagaatgacgttgaggttgatgcggcggcagcggcaggggcagcgcagccgaagaagagaacgttcaagaaattcagcttcaggggcgtggatctggacgcgcttctggacatgtccaccgacgaactggtgaagatgttcagtgcgcgtgcacgtagaaggttccagagaggtctgacgaggaagcccatggccttgattaagaagctccgcaaagctaaaagggaagcaccagcaggtgagaagccagaaccagtgcgcacccatctccgcaacatgattattgtgcctgagatgattggtagcatcattggagtctacaacggcaagactttcaatcaggttgaaatcaaacccgagatgattggccattatctcgctgagttctctatttcatataaacccgtcaagcatggtaggcctggtattggtgccactcactcttccag

SEQ ID NO: 27511 - DNA, 2025 bp, Glycine max
  Peptide Sequence Number=SeqID_119196
atggtggttaccagaaatattgtgttgttgctgctttctattacttttgttgctccaattgtgctcttcactgatcgtcttggcaccttcaaatacccctttgctgagcaggagtttattgaagctgtaactgcttttgtgagtgcagctgactctggccatttgaatctcctgccccaggaatcttctacggtctttaaggaaccaatcgggcttgtttatacggaggacacttcaaacacagagaatttgcttcatggcttgcactttgccaaaccgggggagcatgtatctgccagggtattgtcagctacaaacgacgaaggtcaaaccaaaggggagaaccccatcaaactggtgacagatggaattaatcaaggaaatcaaaacagctacatggtgaaagctgatacaactggtgatagtgttaatggggaagatgctattgatgttgatgacaatgatgggaaactcgctaaatcttctgatctagtatctgaaacaacggtttctgtgtccttgatgaacacttcttggaccagacttgacactaagcaggagcaagaacatattaaatcttctagccaagtaacccagaaagaacctatattatcagaagccgataagcataatgaccaaacaccacctgatgctcgggtgcagcaactaaaagatcagctcatccaggctagggtatatctttcccttcaggcagtaaggagcaatccccatctcactcgagagcttcgattacgggtaaaggaagtctcacgaacactgggagatgcaagcaaagattctgatttgcccaggaatgcaaatgagagaatgaaggcaatggaacaaacattgatgaaaggaaggcaaattcaaaatgattgtgctgctgctgtgaagaagcttagggctatgctccactcaacagaggagcagcttcatgtgcacaagaagcagaccctgttcttaactcagttgacagcaaaaacattgcctaaaggtctccactgtcttccgttgcgccttacaactgagtattatagcttgaatacttctcagcaacaattccgcaaccaacagaagttagaagaccccagactataccactatgcaatattctcagataacatattggcaacagctgttgttgtgaattctactgttgcccatgctaaggacacctcaaaacatgttttccacattgttactgataggctcaattatgcggcaatgaggatgtggtttttggtgaatccaccacaaaaggcaaccattcaagttcagaacattgaagactttacatggttgaattcaagttacagtccagttcttaagcagttgggttctccttctatgatagatttttactttaagactcatcgggcaagttctgattcaaacttaaagtttcggaatccaaagtatttatccatattgaaccacctccgtttctaccttcctgagatctttccaaagctcaacaaagtgctgtttttggatgatgatatagttgtgcagaaggatctgactggtctttggtcaattgatttgaagggcaatgttaatggtgccgtagaaacttgtggagaacgtttccatcgttttgatcgctatctcaacttctcaaatcctcttatcgcaaagaattttgaccctcgtgcatgtggatgggcatacggcatgaatgtttttgatttggtccagtggaagaggcaaaacatcaccgatgtgtaccacaaatggcaaaagatgaatcatgatagacaactatggaagttaggaacactgccgcctggtcttataacattctggaaacgcactttccaactgcaccgatcttggcatgtgttgggtcttggctataaccccaatatcaaccaaaaagaaattgaacgggctgctgttatacactacaatggaaacatgaaaccgtggctggagataagtattcccaagttccgaggttattggacaaagtatgttgactacaatcttgtgtatttacgagaatgcaacatcaatccatag

SEQ ID NO: 27512 - DNA, 624 bp, Glycine max
  Peptide Sequence Number=SeqID_119197
atgtggggtaagttaagaggctcgaattccatgtcagatgagatcccacatccaaattgcgacattgaagtctatggatgcagttcccctcttactttctttctcaacgaagctgcaaagaatgggggaaaagctaacaactttaccggaatggaaaagtggaggagttgtgggggaacgagagggttagctgctatcagtgttctccagaagggagctgctgtgaatgaaatccagagaggagttgttgctctctcacaaagaggaattgagaggaggagagtgagagagaaaacaatcaaagaggcatgtaacaatgatgacaagcacatccagtttttggagaggaaagatacatcattaaaatctcgatggaatcaaatccaccctacaattcagaagtttataagttgttacaaacaagcgctcaatcaaaagataagtgggagtttagagaaagacattatggattttgcaagtaagatttacaagcaggatatagatgcatactcgtcatcttctaacccgaagacgcccattaaagttgatgaatatcacacaacaacattaatatcccgcccgataggacaaaaggcaacaaaaaggaagagcaaagaaaaatga

SEQ ID NO: 27513 - DNA, 555 bp, Glycine max
  Peptide Sequence Number=SeqID_119198
atgtatttgtacaatgatataatagaagaaagtgaagtgaaggaaagggtgggagggagtgctactgatactgaaattgaaatggaggagaagaagctcaaactgtattcctactggataagctcctgttccttccgagtccgatttgctctcaacctcaaaggactaccttacgattacctagcagtcacttcattttctgaccctgagtttcttaagctcaaccccattggatttgttcccgtgcttgtcgatggagattcagtaattgttgactctcttgccattattatgtctcacatccagtatttggaagataagtatcctgaccctcctctgcttcctcgtgatattcaccaaagagccatcaatttccaagctgccactattgtttcctcatctatacagccttttcaaaattatactgtagtgaagtacatagaggaaaaagttggcactgatgaaaaacttccttggacccaaagtgtaattggaaaaggctttatgggtgagtttaaattaaagtatcagtgcttcatttcttccccctcgtag

SEQ ID NO: 27514 - DNA, 408 bp, Glycine max
  Peptide Sequence Number=SeqID_119199
atggtactagtggccaaaagcaagaagcagactcaggattctgaatccactcctccaataatcacatccaacgtcaaacaaaacctccgcttcctaaagctatggaaggttgcagctttaaaggaggatggttgccccaaagtctgggtagtcacttctgatcactgtcatcagcaagcagcacatggagctatttatactgctgctgactttcagggagcctttatttggagttgcaaggcattggttactgagatcaaggcatcacaaaaggaggttgaaaggatgcttcaagagcaaagatccacttcttttcaaggtagattattgaagcacaatcttgatgcagaagtagtggatgctctgaaggacctgaggctaaaattatctgaaaatgagttgaagtaa

SEQ ID NO: 27515 - DNA, 1847 bp, Glycine max
  Peptide Sequence Number=SeqID_119200
atgatcactggtaaggatatttatgatgttttcgcggctattgtgcccctctacgttgctatgatattagcatacggctcagttcggtggtggaaaattttcacacctgatcaatgttctggcataaaccgcttcgttgctgtgttcgcagttccacttctttctttccacttcatctcctccaatgacccttatgctatgaactaccacttcatagcagctgattgtcttcaaaaagttgtcattttgggtgctctctttctatggaacaccttcacaaaacatggtagcctagactggacaatcaccctcttctcactttcaacccttccaaacacacttgtcatggggatccctctattgaaggccatgtatggagacttctcagggagcctcatggtccaaattgtggtgttgcaaagtgtgatatggtataccctcatgctgttcatgtttgaatatagaggtgcaaaactcctcatcacagaacagttccctgagactgcaggctccataacttccttcagggttgactcagatgttgtctcactcaatggtagagagccacttcaaacagatgctgagataggagaagatggaaaacttcatgtggttgttaaaagatcagcagcttcttccatgatatcttcattcaacaagtctcatttaacttccatgacaccaagagcatctaacctcactggggttgagatctattctgttcagtcatcaagagaaccaaccccaagaggttcgagtttcaaccaaacggatttctatgccatgttcgcaagcaaggcaccgagtccaaaacatggctacacaaacagtttccagagtaataatggtggtattggtgacgtttactcgttgcagtcttcaaaaggggcaacgccaaggacttctaattttgaagaggagatgttgaagatgcacaagaagagaggagggaggagcatgagtggcgagttgtttaatgggggtttggtttcttctaattacccgccaccgaatccaatgttttcagggtctacgagtgctgctggtggccccaagaagaaagatagcagtggtggcggtggtgctgtagcacctaacaaggagttacacatgtttgtttggagttcaagtgcatcacctgtttctgaggggaatttgaggcatgcagttaatagagctgcctctactgactttggaactgtcgatccttctaaggctgttccacacgaaactgttgcctcaaaagctgttcacgaattgattgagaacatgagccctggtcgtagagggagtggagagagggagcctgaaatggatgaaggagccaaaattcccgcaagtggatctccatacacttgccagaagaaggtggacatggaagatggcaatgcaaacaaaaaccaacagatgccacctgcaagtgtcatgacaagacttattctcatcatggtttggaggaaactcataagaaatcctaatacttactccagtcttttgggactcacatggtctctcatatcatttaggtggcacattgaaatgccaactattgtaaaaggttccatctcaatactgtctgatgctggtctaggaatggccatgttcagtctaggtctattcatggcattacaaccgaagatcattgcctgtggaaaatctgtggcagcattttcaatggctgttaggttcttgacaggtccagctgtgattgctgcaacctcaataggcatcggactccgtggagttcttttgcatgttgcaattgtccaggctgctcttccccaaggtatcgttccctttgtgtttgccaaagaatacaatctccatgcagatatacttagcactgc

SEQ ID NO: 27516 - DNA, 969 bp, Glycine max
  Peptide Sequence Number=SeqID_119201
atgattccagcctatcgccactcagtatcttctgttatgcctctggatcttaatgaagatcaaaaccacgagttcttcagtccaactcaccacccttcctcttcgttttcttctctatcttcatatcctattctcttcaacccgccaaatcaagatcaagaagctcgatcatactactgggaaccaacaaagcagtacttaccaagtcatgaagaagagactgagaagattattccttctagcggatcatgggatcactcggtggcagaaagtgagcacaataaggcgacagtttggaagaaagcagaagagaggaatgaaaatcttgaatcagttgctgctgaagatggttcgttgaagtggatgcctgccaagatgagaattatgcggaagatgttggtgtcggatcaaactgatacatatactaattcagacaacaacactacgcacaagtttgatgatcagaaacaacaactgtcgtcaccgcttggaactgataacagcagcagcaacaactattcaaaccacagtaacaacactgttagggtttgttctgattgccacaccaccaagactcctctatggaggagtggaccaagaggccccaagtcactttgcaacgcctgtgggattcgacaaaggaaggcaagacgagccatggcagctgctgcggcttctgcatcgggaaatggaacagtaattgtggaagctaagaaatctgtgaagggacggaacaagttgcagaagaagaaagagaagaagacaagaactgagggtgcagcacagatgaaaaagaagcggaagcttggagttggatcagcaaaggcatctcaaagtagaaacaagtttggttttgaggatttgacgttgcgcttgagaaagaacttggctatgcatcaagttttccctcaggacgagaaggaggctgcgatccttctcatggctttatcttatggccttgttcattga

SEQ ID NO: 27517 - DNA, 291 bp, Glycine max
  Peptide Sequence Number=SeqID_119202
atgacatctacttttgtaggaggtattgattatcgtgtaactgaggaaagtttgaaggatcggttaaacatcatcatgcttgaagaatgcctgaatattgacaacgaatgcagggtctttacagttcatggtggagcagacaccataatcccggttgtagcagcacatgagtttgctaaggttctacctaatcaaaagttacagatcatagagggagctgatcatcaagctgagttagcgtcccttgtggtgtatgttataaaggaaaccttgcaaatctcattattgtga

SEQ ID NO: 27518 - DNA, 609 bp, Glycine max
  Peptide Sequence Number=SeqID_119203
atgtggatcataacaggttcggaggatgggacgacacgaatttgggagttattgggtacttacgtttctgtggcttatttaccacatttactagattgcaaaagtggaaagtgtacgcaagtgattgatccagcaagagatttgaaattaaagggatctgcttcttgggttggctgtgttgctttagatgcaagtgagagctggttggcttgcagtagtggacgtaatatatcactttggaaccttcctgcttctgaatgcatatcaaagattcctacccgtgcttgtgtacaagacatgttatttgacaataatcaaattttgacagttggtacagatcctctactcaatcgctttgacatgaacggcactatcctttcacaaatacagtgtgctccttcgtcatctttttctatctccttacatcctgcaggggtcagctcaaacatgctgatggactccttgttactctgtgctttatttgatatattgggtgcattaccgcattattcgtttcaggttatggcagttggaggttatggatgtcttgttgatgttatctcacaatttggcagccacatgtgcacatttcattgccagtgtttctaa

SEQ ID NO: 27519 - DNA, 1380 bp, Glycine max
  Peptide Sequence Number=SeqID_119204
atgtccacaccgtcgcggagatcggttgccgttgccgtgagcggcgggtccaagggtagccggcgagcagtgcagtgggctgcggacaatttggtccctcaagccgataggttcatcttagttcacgtcatccctcgaatcacttcaattgcaacaccaactggagagtatattcctatttccgaagcagacgccgatgtgtttgcagcttctgtgctggatgcgaaactaaaatctgaacaaatctttgttccgttcaagaaactctgtgattcaaacacgatggaaacagtactgctagaagatgacaatgctgcagaagcacttcttagctttatttcggagtccgggtcccaaatattagtgctgggttctgactcctcaaatttcataacaaggaagctaaaaggacctgggataccaactaccattctaagatgtgctcctgacagttgtgatgtatatattgtagctagagatagaattatatccaagttggctgacttttcatcttcacgttctcatgagactagccctaggtacttcttgtctactaaagtaaataaagaggacaatggcattggcagagaaatgtctggaattagttcatcctcaaatgaacctaaaattctaaggaatttccggtttttatccatatcagagcgtagttacattggtctgcaatcatctagtcgtaggaattcttttgaaaattctaccaaaaatgaagaacaaaattcagaaaactgtggagatgatattgaaactatcagcctccactcatttgattccattgcttctgcacaacgtgaacagttagtcatgcaagaagaagtggaacggctgcagctggagttgcaaaatactatcaccatgtacaaacaggtctgtgaagaactggttcaagctcaaaaccaggcccttttactttcttctgaatctcttgaagaaactaaaatagttaatgcttccttaaaaagagaggagattttgagaaagtttgctgctgaagagaaaacaaagtacttaaaagtcatgaaggagcttgaggaggcgaaaaataagttttccaaagagtcatatgaaagacagatggctgaacttgatgtccttagagaatcaatagaaagacagagaattgtggatacattgctctcaaatgacaggagatacagaaagtacaccatggatgaaatcaagctagcaacgaacttttttgctgaggacttgataattggtgaaggaggatatgggaaagtttacaagtgtaatcttgatcacacaccagtagctgtaaaggttctgcaccaggacgcaatcaacaagaaagaggagtttctaaaagaggtccttcttgtgcttgaattttcttccctttga

SEQ ID NO: 27520 - DNA, 588 bp, Glycine max
  Peptide Sequence Number=SeqID_119205
tggagttgtggtttctcggtcaaggatatcatgaccacttggagaaaggtgctaatgctgttccaaacgacaagagacttgagtgggaaaagcttgattttcaactctgtgttgtgttatggcaatcggttgagccagatgttttggaaatccttagatcattcaaaacatgttgctctttatggaagaaggaccaagagatttttgccaatgatattcaaagcctgtttgatgcaaccatgaaagttacgactctcaagcaaaccagccatgacatgattgcacatatagtggaaaagctgaagaggtttcttgtggctgattcgttggaggaagtgaataagaagctggacaagttttacatggttcttatcttgaggagcctacactcagattttgatcatgtgcatgatcaagttcttgctggagaccaagttccgtcaatggactctctcatcactagacttcttcgtgtgcctcatgtgttgaaagatgaaaatctagctgatgttgtggagacatcagccatggttgcacctcgtggaagaggaagaggtcgtaacaatagaggaggccgcagtggaaggg

SEQ ID NO: 27521 - DNA, 1548 bp, Glycine max
  Peptide Sequence Number=SeqID_119206
atgttgtcttctctgctgaacccttccttcaccaccacccttccaatccattcaattttaatccctaataaccgccgcgcctccaccgtagtatcatgcacctcctcacacctcaccaccaacaaccactcccatgtttcttcgccgccgaacatcaaggacgaggcccgccgccgccccgcggcggagaacgacttcacggcgaagtacgtccccttcaacgccggcttcgactcgccggaaacctactcgctcgacgaaatcgtgtaccgcagccgttccggcggactcctcgacgtgcagcatgacatggaggctttagggcgcttcgacggcgcgtactggcgcgcgctgttcgactcgcgcgtggggaagacgacgtggccgtacgggtccggcgtgtggagcaagaaggagtgggtcctaccagaaatagaccctgacgacatcgtttccgccttcgaaggcaactcgaatctcttctgggcggaacgcttcgggaaacagttcgtgggaatgaacgatttgtgggtgaagcactgcggaatcagccacaccggaagcttcaaggatctcggcatgaccgttctcgtcagccaggtcaaccgcctccgcaaaatgaaccgccccgtcgtcggcgtcggctgcgcctccaccggcgatacttccgccgcgctctccgcctactgcgcttccgccggaatcccctccatcgtcttcctccccgccaacaagatctccaccgcgcaactaatccaaccggtttcaaacggctctttagtcttaagcatcaacaccgattttgacggctgcatgaagctgattcgtgaaatcaccgccgaattacccatctatttggcgaattcgttgaacagtttgcgtctggagggtcaaaaaaccgctgcaattgagattctgcagcagttcaactgggaggtgccggattgggttattgtacccgggggcaatctgggaaatatttatgctttttacaagggttttaagatgtgcaaggaattagggcttgtggagaggattccaaggctagtgtgtgctcaggctgcgaatgcaaaccctttgtatttgcactacaagaatgggtttaaggattttaacgctgtgaaggctgagactacttttgcttctgctattcagataggggatcctgtttcaattgacagggcagtgcatgctctgaggaacacggaggggatcgtggaggaggcaacagaggaggagctgatggatgcaatggtgcaggctgattccactggaatgttcatatgtccacacactggggtggctctggcggcgcttattaagctgaggaatcgtggggttatcggtgccggtgagagggttgtggtggtgagcactgcacatggattgaagtttgcacagagcaagattgattatcattctgggctcattcctggaatgggccgctatgctaacccgctggtttcggttaaggcggattttggatcggtcatggatgttctcaaggatttcttgcacaacaagtcccccgactttaacaagtcttga

SEQ ID NO: 27522 - DNA, 1134 bp, Glycine max
  Peptide Sequence Number=SeqID_119207
atgatgaatggaaggaacgttgacacaaacaggttccccttcactccttcccagtggcaagagcttgaacaccaagccctcatctacaaatacatggcttcaggtatttccatcccccctgaccttctcttcaccatcaaaagaacaacccacttggactcctcaagactcttgcctcaacactttgggtggaattatttgccaatgggattggggagaaaaatagacccagagccagggaggtgtagaagaacagatgggaaaaaatggaggtgctcaaaggaggcgtatccagattcaaagtactgtgagaggcacatgcacagagggaaaaaccgttcaagaaagcctgtggaagttttgaaaacaacaccaatgacagcagcaacaaacacagatgcctcaaccccaacaacaatcttatcaatcaccaaaaacagtcctgtactcttcccaaccactcattctctgtctcatgacacttaccatcatcatcaccatcatcactctcaccctcagcaacattcctcccactccttcctctatcattcttcgaggccctcttccggtggtgtttctttgtcatttcaagacaacagtgcccccttgtttctcgacactgcttcatgctctcagaataacaacaacactgactgcaggtatgtgtatggactaaaagaggaggtggatgagcatgcctttttcacagaaccttctggaactatgagaagcttctctgcttcctcaatggaagattcatggcaactcacaccactgactataagctcctcttcctcttcaaaacagaggagttgctctggtttatccaatgacagcaatgagtactcctacttgcaacttcagagcctcagtggcaacaactcaaagcatccacagcaagatcaaggttgctacatatcaggcagtgatatcaagtgcgaaacattcatgaaacttgggaaagaagaacctcagaaaaccgttcatcgcttcttcgatgaatggcctcccaaaagcagaggatcatggcttgatttggatgataaatcatccacaacccagctttcaatttccattcccacttctactcatgattttgcaactttcagttcaacaacccaacgagatggttga

SEQ ID NO: 27523 - DNA, 627 bp, Glycine max
  Peptide Sequence Number=SeqID_119208
atgatacgtagaatgggctgttttagttatttactagatatcgtcatcccatttcaggctcatacttcttatccctgtggtgatccttattttggtagttcaatagttgcttatggaccacaggctattaatcaacaaatggtgccccagatgctgggattagcatccaccagaattgcattaccagttgatcttgcagaagatgggcccatttatgtcaatgccaaacaataccatggtatactgagaaggcgacagtcacgagcaaagcttgaagctcaaaacaaactcatcaaaagtcgtaagccatatcttcacgagtctcggcaccgccacgcattgaacagggttaggggatctgggggacgctttcttagcgccaaacagctgccacagtctaatgcagaactagtcactgatgcctatcaaaagaaagatgcatcagaggcagaaaatcatccctcaagcaccggtgaaaatgcatctatcacattcacagccatctctgccttaactagtatgtccagtaacagtgtcaatttccccaacatggctggatcatcgcaatgcagtgggggactcacctttggtgctggagctctccaatgtacttcagttggccgatga

SEQ ID NO: 27524 - DNA, 1353 bp, Glycine max
  Peptide Sequence Number=SeqID_119209
atggcgatattctctgaatcgaatcaccatcacaacacttccgatggggtctcccagcgagtcaacagtccgcgtttctccggtccaatgactcgccgcgcccactccttcaaacgtaacaacagcagcaacaatagcaacaacaccgccaccaccacctcccacggcggcggcggaggcagtggcggcgtcgagattgagcttcaaatcaactcgcccagatcggaggaagcgtcggagggtgtgccggtggggaagcacagccaccatcacgtgacccagagagtgcacgtgagagggttgctgaagaagccccttgcgtccatcgttgaggatttggggttgagagaaaggaagaaaattgggcactggatgttcttagtgttctgtggggtgtgcttgttcatgggtgttctcaagatatgtgccactggttggcttggatctgctattgaaataactcaatccaataaggaactatctgactccattcctagtctaactctaatggacaaaagctcccttggttatgcatatagggggggagcaagtgatgttgaacgaacattaaaaacagtagcaacaggagtagacggcagccatactgccatgactgaagattcagggatctggtccaaacccaacagtgacaatttcaccaaatgcatagatcttccaaagctagatgcaaagaccaatggctacatttttgtaaatgcaaatggtggcctgaatcagatgagatttggggtcaggctgtgttcatttctgatgatatgtgatatggttgctgttgctaagattgtgaaggctacacttgttcttccttctcttgatcacacctcctactgggctgatgacagtggcttcaaggatttgtttgattggaagcattttattaatatgctgaaggatgatgtccacatagttgagaaattacctcccgcctatgctggaattgagcctttcccaaaaactccaatatcttggtcaaaggttcattattataagactgaggttcttcccctcctaaagcagcacaaagtgatgtatttcactcataccgattccaggcttgataacaatgacattccacgttccatacagaaactaagatgccgtgtaaattacagagcattgaaatattcagctccaattgaagaacttggaaacacactgatggaaaagaaagggttgggagagggggatatgatccaattggaagacatgggatttgagtctcacattggaagtgcgatattttgctgtgggatttataagttcctgggtgctctagctgcaaagttgcaaacgagcatgaatggtgatattgacatagcaatgtttgcctag

SEQ ID NO: 27525 - DNA, 726 bp, Glycine max
  Peptide Sequence Number=SeqID_119210
atgccttccatttcttccacaattcaggcgccacaattccatagttcattcttccgcccctatcccaaatgcttggccatgaccatcgacactgacttcttgaacacgaagaagaaacaagtttcgttccaactttcgagtttgatcacaccacctgtctccactgtgaggttctgcgatctcaactttggccgcttgcaaccttccgatgaagaattgggtcctcacaaaagatttgagtttggcaacttcgttgcacgagaagccctgcttgaggaagagtattggtctgcagcgtgcctaagggcagaagagtgggcaaatcgaacagataaactgtatggcacaaggaattttgctgaacaggtaggagttgatgctaattcctttgtggaatttaatgcgataaaaaagcggtgcaaggagctacaagacggtcacagtagcacatgcatcatcacggttaggaagccacaaaagaatgtaaaactcccaataatagaaagtgttgtaggaactcttgatttgaatatcatatatttgcggcgaggggagacctttcctgggatcgaccgaacagcatcaagcagatatggttatattgcaaacttgtgtgttgccaaatcactttatcgcaagggtgttgcaagcaaaatgttgtattttgctgtggagtctgcaaaatctactggtaatgtgagagtaacatttacaactaatgtctga

SEQ ID NO: 27526 - DNA, 1173 bp, Glycine max
  Peptide Sequence Number=SeqID_119211
atggtggagacctcgacgctagggcacttccaccaccaaaggctcgaccttcgccgctgggtccccgcgttcttcacctcgcataagaccctcttgacccttctatggatcgccgccttcgcctccgtttttctgtggcagaggaacatagtgggcgggtttctggtctacggaggaattccgggcaggcccatgcccatgctccgcccaatggccttcaatttgacggatttcggtggggtcggtgacggcgttactctcaacaccgaggctttcgagagggccgtttctgcggtttctaagttcgggaagaaaggcggtgcgcagttgaatgtgcctcctggacgctggctcacggcgccgtttaatctcaccagccacatgactctctttctagctgaagatgctgttatacttggcattgatacacccagtctcagctatgccggaaaagggtaccagcgacctactgcgacgatagtggccgcaagactaggggaggggaggcagaagaattggagggatgcaccagatgtgtattcattctacttcacgcgattcccagaggatgtgggggaaaaggaactatggttcaaaggggttgatgatgtctggaaacttgagaaacagctgggtaatctgatcataggtggccttaaaatgcatgcgaacctcccgaaacatggaagggtggggaagccgatagagaaattccataaggaggatcagtataagcaggggctacaaggagatatgcaggtagacagagtcaacgaaagagtcagggcgataacagcacaaacaccagcgaaaggaggaaaacagcagaattgtactcagcaacagacattgtcagtttcatatgcaacaccggtgacgatgggcagcaaaacgatagagaaaagatggtctccgacagctattcaggcgatgaaaaagccttcccaatcatcaattcggctcacgatatccatggaggagaggaaatggttcagcagtgcttgggtaggcagactacggaacttgttgatgttcgatagattagaggaagaatttttgtgggatggaggggaagatatttggccaaaataccttggtgatgatatggtgctactcttgggccttagtgacgaaaaagcagagaaaagatgggattatgaatacaatcattag

SEQ ID NO: 27527 - DNA, 690 bp, Glycine max
  Peptide Sequence Number=SeqID_119212
atgacgtcgaggaggcagagacgtgaagttgttgtggttgacgaaggcgacgaagttgacagggagaaagatcacatgattgcgaagacaaacacgattatgcctatcattggcaaactgtactgttcatcgtctgagacggtgcttgtggtgaggaggaggccacacgtggtgaatggtgggggttttgtagtcatggattgtagtgcccagagggttgtgttcagggtcgatggttgtggtgttcgtggcaaaaagggagacttgattctaagagaaggagatggagacgctttgcttctcatgcgtcgaatgggaggcatggttgaggccttaagcatttacaagaagtggaaatgctacagcttggactacgaaggatctcggaagctggttttcagcttgagagaacccaattcttgtttggttaagaacaatgcaatcagaatcttcactaggaacagaggccgtgactttaagatcagtggctgtttcccggataagtgttgtagcattgttgactctaaaggcaacgaggtagcacaggtggggatgatgaaggaagtggaggaattgattgaaagcaaggatttgtaccatgtggtggtgaatcctgggatggatcaagcttttgttttcggagtcatcgctgtccttgattacatttatggcgaatctacccaccgctaa

SEQ ID NO: 27528 - DNA, 2316 bp, Glycine max
  Peptide Sequence Number=SeqID_119213
atggcccaggatttctccaaagctgttgatgacggcctcaagctctccaaacgcatatacttcgggaaggacagggcggtggcacctcctaaacctccgccgccgatgacgcgctccgccaccgcgtttctcccctcggcgccgatggtctacgcggtgatctccgatccagggatcgtggacaaccccgacatcccgagctaccaaccgcacgtgtacggaaggtgtgatcctccagcgttgattccgcttcagatgaacgctattcagatggaagctgattgctaccacgaaaccgcgtttatcacagtctccggcacttggagactccactgcgtcatgggaagccgctcctgcgattgccgcatcgctgttcccgtcagccaccagggttcaattctaggtgttgaggtcagcgtttctagaaaatcatattctactcaactggttgtaatggaagatgacaatgggaaccaaaacgcctcgccacctcaaaacggagggtttctcatcccggatatatttactttaactataccgcagattgatggaggttccaatttgtcgatcaaagttcggtggtctcagaaaatagtgttctccaaaggccagttctctttgaatgtgccgtttacctttcctgatttcgttaaccctgcggggaagaaaatatctaaaagagaaaagatacaaattaatgtggatgctgttactggaggtgagcttctgtgcaagacattaagccacccactgaaggaagtgaggcgtcatgttgggagcatgggcttcttatatgattccgatgttctttcatggtctaaagttgattttagcttttcatatgctgtttcttcaagtcatataactggtggtgttcttttggaatctgcatctgtgcatgattttgatcaaagagagatgttctacatgtatctttctacaggagatattcagagtgacaaggtattcaaaaaggacataatattcattattgacatcagcggtagtatgcggggaaagctaattgaagacacaaagaatgcactattgactgctctctctaagcttaatcaggctgattcatttaatattatagcctttaatggagagacttatctattttccaaaacgatggaattggcttccggggatgctgttgaaagggccactgagtggattaacacgaactttgttgctgggggtggtacaaatatttctcatccattaaacacggcaatagagatgctatccaatattcaaagttcagttccaataattttcctagttacagatggaactgttgaagatgaaagacaaatttgtgctatggtaaagaatcgtatgatcaatggagagtcaatatgccctcgaatttacacttttggcattggttcgttctgcaatcattatttcttgcgaatgctcgcaatgattggtaggggccaatatgatgctgcgttggatgtaggcgaggtcattattcagaagaaaagcgttgcaagactaaagcatatgttaaatgagctagagccgctgcatcggcaactggttggaacaaagaatgaaatggatttgattgaacctcgaatgctgacattgtttggcaaagcttcatctctcattcttgcaaatatcaaaatggacacattggatgatcttgatgacctcgaggtataccctcctcatattccagatctttcatcagagggtccattgattttatctgggagatacaggggaaattttcccaaaactcttaaaatcgaaggtatcttggctgatttcagtaattttgtagtagatatgaagatacaaaatgctaaggacattcctgtgcaaaagggtgctggagagctatttagtgcttacatttctgcaagagatcaaatagagcatcttactgcccaagcatggctcatggaaaataaacaactagaacagaaggttgcaaaattgagcttgcagactggctttatgtctgagtatacacgaatgataatacttgagactgatcatctaaagaaagtcaaggaatcagccggaacgaaagaagcgtcaaaaaagagccatcctcagtatgaggcacccgtccaaggccagagaatgattttactaccccatttgggtattggctttggcaacttaactgcaactgctgaaaatactcctccaggatttgaatcaaaatttcctgaatgttgtacccggataaacaaccaatgtgcaactgcattgacacaactctgcattggtctaggatgcttcggctgcatcacatgttgttcagatatatgctgttctggaaacgaaggctga

SEQ ID NO: 27529 - DNA, 2247 bp, Glycine max
  Peptide Sequence Number=SeqID_119214
atggcttgtacagcttccacacatttaaacgaaacatacacattggttgccgcaaatgatgtgttgctagattcttcacttatgaagtatagccccacggattgccagagaccagaacttttaaataagaatttaataaagggaaatattcttctctgtggatattccttcaactttgttgttggcactgcatcgatcaagaaagtctcagaaacagcaaaggcccttggtgcagttggatttgttctttgtgttgaaaacatttccctaggaacaaaatttaatccagttcctgttggccttcctgggattctcatcatagatgtcagcaattcaaagtcgcgtgtgacagtggaggttgaagaggtgtttgtggagaagaggaggagcatggaactgatagattattataatatcactacaccaagagactggactgggcgtgtaaagagtttcgaaggtaaaggtaaaatcggtgatggtttgatgcctattctgcataaatctgcaccacaggtagcattattctctgctcgagggccaaatataaaggacttcagcttccaagaggcagatcttctcaaaccagatatattagctcctggttcattgatttgggctgcttggtgtccaaatggaactgatgagccaaattatgttggtgaagcgtttgccatgatatctggaaccagcatggctgcaccacatatagctggaattgctgctcttataaagcagaagcatcctcattggagccctgcagccattaaatcagctttgatgactacatcaacgactctagacagagcaggggatcctcttctagcccagcaaacttctgaatcagaagctatgaggctggtcaaagctactccttttgattatgggagtggtcatgttgatccaactgctgcattggaccctgggctcatctttgatgcagggtacgaggattatataggcttcttgtgcacaacacctagcattgatgttcatgagataaggaactacactcacaccccatgtaacacctccatgggcaaaccatcaaatttaaacaccccatcaataacaatttcccatcttgtgagaactcaagttgtcacgcgcacggtcacaaatgttgccgaggaagaaacctatgtgatcacagccagaatggaaccggctgttgccattgaagtcaaccctccagcaatgactatcaaagcaggcgcatcgcgccagtttttggtgtcacttacagtgcgctcggtgacaggaaggtatagttttggagaggttttgatgaaagggagcagagggcacaagctgccgcctgtgtttaatttcccaaaatctcaacttcaatgctatggtgaatcagtgtactgcacatcttccaacttgctaagccaatgcaacagtgggcagagtccactggacaggttcacatcagtagtagcatggagcatatctaccacacgccccacatcttttggtgttgctccttataattccactcttggagagacccaccatgtttccaagggcaatctcaacgtcctagttgagcaggtttcactcaatcctccagtatctgccctccatgcaacagatgagaaggaaaacattgagatgatatggtgccagcagcctgttccaaagtttcgggctcaagtgcatggtaaacggctgctgaagctccaaaatcatggagaaacatatgaaatgaattctcctcacctttcaattagaattcttccggttcctgggattgattgggttggcaatgttaatataaggtgcccagagacaggatttgggggaagtcgtaaattgatcaaagggaaaatccttgactcatcattactcaaagttctcttcgaagttgatggtcattgggataagatagttagagtgaaggatacaaatagtggagaagtgagagtgatatatgatgccaaagaagccatttcaggtctcaaaactcctattatcaaggatgtggagagtgtgtggccaaccgaatcagcccttgtttggagtgagttgagccaagccattatgaacaaagattgggaaagagcaagagaagcaaagcaagacgtggaagaaagacagaggaatatgttgagagacagagccatgaaaggagaaacttggtttcctaagaattttagggtgtcttacagtaaagacacatgggaatgggactgttcaccaactcataaatgggtccctgaggcccccatcatagctcaataa

SEQ ID NO: 27530 - DNA, 2424 bp, Glycine max
  Peptide Sequence Number=SeqID_119215
atggctactccaaagagctttatttctctaatagtttgcttttgccttgttattttttccttcattggcacccatgctgttgatgtctctcatgatggaagggccatcaaaattgatggtaagcgtagagtgctcatatctggatcaatccattatcctagaagcacccctgagatgtggcccgagttaatccaaaaagccaaagaaggaggattagatgcaattgaaacatatgttttctggaatgcacatgaaccttcacgtcgtgtgtatgatttttctggcaataatgatatcatcagatttctcaagacgattcaagagtctggactttatggtgttcttcgcattggtccatatgtttgtgccgaatggaattatggagggattcctgtctgggttcacaatctacctgatgtcgagattcggactgccaatagtgtgttcatgaatgaaatgcaaaatttcactactttgatcgtggatatgctcaaaaaggagaaactttttgcttctcaaggtggtcctataattctcactcagatcgaaaatgaatatggtaacgtaatttcacaatatggagatgctggaaaagcttacatgaattggtgtgcgaacatggcggagtccttgaaagttggggttccatggatcatgtgccaggagtccgatgctcctcagcctatgatcaatacttgcaatggttggtattgtgacaactttgaaccaaatagttttaacagtcctaaaatgtggaccgaaaattggataggctggttcaagaattggggtggccgagatccacacagaactgctgaagatgttgcttttgcagtggctagatttttccaaaccggaggcacatttcaaaattattatatgtatcatggtggcactaacttcggtagaacagccgggggtccatacattaccacatcatatgattatgatgctcctctagatgaatatggtaacattgcccaaccaaaatggggtcacctcaaagaacttcacagtgctttgaaggcaatggaggaagctcttacgagtgggaacgtatccgagactgatctaggcaactctgttaaggtcactatttatgccacaaatggatcatcaagctgcttcctgagcaacaccaacaccaccgctgatgccactctaacatttagagggaataactatactgttccagcatggtctgtcagcattcttcctgattgtcagcacgaagagtataacactgccaagtgggtctggagatcagagaacattgacaaggctcttcatggtaaaagtaatgtctctgcacacagacttcttgatcaaaaagatgcggctaatgatgctagtgactatctttggtacatgacaaaacttcatgtcaagcacgatgatccagtttggagtgaaaatatgactcttaggattaatggtagcggccatgtaattcatgcattcgtcaacggagaatatattgattcccattgggcaacatatggtattcacaacgataaatttgagccgaagattaagttgaagcatggaacgaatactataagcttgctcagtgtcactgttggacttcagaactacggggcattctttgatacatggcatgccggtcttgttgggcctattgagttggtcagtgtaaaaggtgaagaaaccatcattaagaatttatcctcacacaaatggtcatacaagatagggttgcatggttgggaccacaaactctttagtgatgactcacccttcgctgctcaaagcaaatgggaatctgagaagttacccacaaacaggatgttgacttggtacaagactactttcaaagctcctctggggacagaccctgttgtggtggacttgcaaggaatgggcaaaggctacgcttgggtgaatgggaaaaacattggacgtatctggcctagttacaatgctgaagaagatggttgtagtgatgagccttgtgattatcgtggagaatattctgactcaaaatgtgttacaaattgcgggaagccaacacaaagatggtaccatgtccctcgctcttatcttaaagatggtgcaaatactttggttttgtttgcggagttgggtggaaacccatcactagtgaatttccaaaccgttgttgttggcaatgtatgtgcaaatgcatatgagaacaagactttggagttgtcttgccaaggtcgtaaaatctccgctattaagtttgcaagttttggtgatccaaaaggagtgtgtggagcattcaccaatggcagttgcgagagcaagagtaatgcacttcccatcgtgcaaaaggcatgcgttggcaaggaagcatgttcaattgatctttcagagaagacgtttggtgcaacggcttgtggaaatcttgctaagaggcttgccgtggaggcagtctgctag

SEQ ID NO: 27531 - DNA, 1332 bp, Glycine max
  Peptide Sequence Number=SeqID_119216
atggaaagcattgaaatggaggaagccgcattcggcatagacgaatccaacgatgacttgtgcagttcgatcctctctcgcttcgctaactccaccgacgaaacccaccaacacctctgcgccgtcatcggcgccatgtcgcaggagctcaaagacaacaaccaaccttccacacccttcgcctacttctgtgccgcacgcgtctctctcgacaaattcacctccgaacccaatcccccgagccacgtcatcgatgcgcttctcaccattctctctctcgccctccccagagtacccctcgagctgctcaagaagcagaattcgcagcagggagagccgttctcggagctccttcttcgagttctccgttctccgtcgtcggcgtccgagactgcgcttgtttccggattgaagtgcctctcgcgtctgttgatcgccagggaaagtgtagactggtctgacgtgtctcctttgttcaatgtattgttagggttccttactgattcgcgacctaaggtcagaaggcaatctcatttatgtcatcgtgatgtcttgttaaactttcaaaattcctcactactggcatctgcgagtgagggagtaacaaacctactcgaaaggtttattctgcttgttggtggagcaaaggcaaatgctggtgaaggagctaaggaggctcagcagattctgtatattcttgatgccttgaaagaatgtcttccttttttgtcacggaagtctaagaccagcgttcttaattacttcaaatatctcttggatctgcatcaacccttagtcacaaggcgcataacagatggtttgaattttctttgtcattatccaacatcagaagtttcccctgaagcactacttgagttgttaaactcattggctcgttctatcgaatcaaataagatgtctggagacagattgacatttactgcccgcttgcttgatgctggaatgaataaagtttattctcttaaccggcaaatatgtgttgttaagcttcccgttgtccttaacgctctcaaagatatcttggcatctgaacatgaagaggctatatatgcagccactgatgccctcaagagcatgataaattcttgtattgatgaaagtttgattaaacagggagtggatcagatcagtttgagtgaaagcaatgaatcaaggaagtcagcaccaaccatcattgaaaaaatttgtgcgactattgagagcttacttgattatcattatactgctgtctgggatagagtatttcaaattgtttcagccatgtttcataaattaggtgcgtgtgtggatgagattattttaaagaggtaa

SEQ ID NO: 27532 - DNA, 912 bp, Glycine max
  Peptide Sequence Number=SeqID_119217
atggccgcattttacggggtttggtggagatgcgccctaccaatcacaggaaattcagtcacggagaagaaggaggagggtattagtgtcttttcagaggcctgtcctctgacaagactaggccacatgggtaatggctacattttttgttgcacttacactcgcactccaccttgtctcagcagcaaacacctcttcttccttgacgttggcgctgttagagtcgtgagggttcggaggaacggcgcgggagacttcacgacggtgacggacgccgttaacagcattccgtcagggaacaagcggcgagtggtggtgtggatcggaatgggcgagtaccgcgagaatgtcaccgtagacaggtcgaagcctttcgtcacgttttatggagaaaggaatgggaccgacaacgacaacgacagagacatcatgcccatcataacgtacgatgccacggcgttgcggtatgggacagtggacagcgccaccgtcgctgtcgacgccgactacttcgtggctgtcaatctggcatcttctcacaagattttaccccctgttaaggcttttacaaattcttttgcaggtgaattattgaaagctggaataatatctaaccccgacaacaatgaagtgatttggcggatcacaaccaacttgtcaagcatagtgtccactctacctgcaaactgtaaagcaatagctggttcccattcccaagggtccatgaacttcggagactacatcagagctgcttctgatgaacagatttatgtgtttgtggttggccagattgacactcagagtcagtcatacattgatgattttgtgaaagtttctgattatgatctagttgccagtcaatgcttgagtagggtgatctcagctatggagacaaaatggggcatttcttaa

SEQ ID NO: 27533 - DNA, 1485 bp, Glycine max
  Peptide Sequence Number=SeqID_119218
atggcatcctccgatggtagagttacgtattcttcactatctaagctagaaaacgagaatacccattttggctacgatgatatgaatcatcatggtgaatctgtgtggtctgagcctatgcctggcaccccgtgtggccaattaggcccaacgttctctaacaaagagtcattgtatcagtttccctccgaggatgatgacttgtttgatggaggttatgaatcaggtgatgatgcacgcggtatcgtaccctctaacaggcctcctgaggtgaacttgaagaatgtgctttctgggatctttgctattttgactggacggaccaaggttccaagcattactgcaaaccagcagctcccaagttcaaatgtgtcatttcttgactctggaaagaatggggatgttttccttgactcttcagtgtacacaccaagtgcaccaccgctttgtctgcctaatggaagtgattatagttcttacaaagaggtcttggaagctgatccccctgagtggctccctgatagttctactactgtttgtatgcagtgtagtgctccttttactgcacttacccggggtagacatcattgccggttttgtggggggattttctgtcgaacatgtacgaaggggcgatgtttaatgcctgttgggttcagggaaaggaatccccaaagggtttgcgatgcctgctatgatcggcttgatcctttacagggtgttcttatcaacaccataagcaatgctgcgcagggggctaagcatgatgtcatggactggacttgtgctagaggatggattaatcttcctattggtttatctatggagcatgagatttataaagcatctaatacattgagaaactactgtcaggtggccaaatccaatcctgagaagtctatccctttaactgttcttaaaagtgccaagggcttagcaattttaacagttgctaaagctggtgcactggtctcttacaaactgggcactggtttggttgttgctcgaagatcagatggatcatggtctgcaccgtcagcaatattctccctgggtttaggatggggtgctcagattggtggtgaacttatggattttatagttgttcttcgtgatatgaaagctgtaaagacattctgcagtcatatgcatttttctcttggtgctggttgtagtgctgcagcagggcctgttgggagagtgcttgaagcagatattcgtgctggtgacagaggctctggcatgtgttacacttacagttgcagtaaagctaacaacacggaatgttgcaaaactgtaggtgcatttgtgggagtttctttggaaggaaatatagttgcaaccaggatggatgccaatttgcgcttctatggtgatccttacctcaccacatctgatattctactgggaatggtggacagaccaaaggctgctcaacccatgtatgccagtcttcaagaactatattcctgtttacgattctaa

SEQ ID NO: 27534 - DNA, 1683 bp, Glycine max
  Peptide Sequence Number=SeqID_119219
atggctattattccatctcctaaaattttcctccttctcttagcattcttcttctcacatgctatacctgccaaatcctccaatgcttccacaaccacaacattgcatgcaaacctctcttcctcaaacagaaccaacccatttcctgaagttagcagcttcaattcatctaagctttcaatttcaataaacataaatccatacatcatcaacacccttcttaattccctccaagcagcaatatctggagccacaaaactatctgatctatcaaccaatgctggaaacaacatcataaataacaaaataggagcagtccaagactgtagagaacttcaacaatccaccttagcttccttaaaacgatcactatcaacccatttcctgaacataaatccaaacatcatcaacacccttcttaagtccctccaagcagcaatatctggagccacaaaactatctgatctattaaacaatgctggaaacaacatcatagataacaaaataggagcagtccaagactgtagagaacttcaacaatccaccttagcttccttaaaacgatcactatcaggaatccgttcccaagactctaaaaaactagttgatgcaagaacctacctaagtgcagcactcaccaacaaggacacgtgtctagagagcatagattctgcttcgggtacccttaagccagttgtagtaaattctgtgataagctcttacaaagatgtcagtgagtctctctcaatgctccctaaacctgagaggaaggcctccaaaggacacaagaaccggcgtttgttgtggttgtcgatgaaaaaccgtcgccgtctcttgcaaagcaatgatggaggagagcttgttgtggctgctgatggaacgggaaactttagcttcatcactgaggctatcaactttgctccaaatgacagtgctggtaggacagtgatctatgtcaaagaagggacttacgaggaaaatgttgaaatcccaagttataagaccaatattgttctgtttggcgatggaaaggatgttacagttattactggcaacagaagtgtcgttgatggctggaccactttcagatccgcaactttaactgtctctggtgagggctttctggcacgtgatatagcttttgagaacaaggcaggcccagagaagcttcaagcagtggccttgagagtgaatgcagacttcactgctttctacaggtgtgccatgtatggttaccaagacactctttatgtccactcctttagacaattctatagggaatgcgacatttttgggaccatagattacatatttgggaatgcagcagtggttttgcatgcatccaaaattatcacaaggatgccaatgcctggtcaattcactgtcatcactgcacagtccagagattcccctgatgaggacactggcatttcaatccaaaactgttcaattctagccaccacagatttgtactccaattctggtagtgtcaagagctaccttggaaggccatggaggggtatattctcgagtcctacattgatcaatttattgacccaatggggtggaaagagtggtctggtgatcaaggcttggacactttgtattatggagatttctgagtttattattggtgatgcttggcttggctctacttcatttccttatgatgatgggatttaa

SEQ ID NO: 27535 - DNA, 5370 bp, Glycine max
  Peptide Sequence Number=SeqID_119220
atgggcaccccggacaagaaagtatctgactttgttgatgtagttaggtcttggatccctcgaagggcggaaccaccaaatgtgtcgagggacttctggatgcctgatcagagttgtagggtatgctatgagtgtgattcacagttcacaatattcaaccgcaggcaccactgtcgaatctgtggtcgagttttctgtgcaaaatgcactgccaattctgttcctgtgccatcggacgagccaaatactggccgcgaagatttggagaggataagggtctgtaactattgttttaaacaatgggagcaagtagctacagttgataataatggaagtgcagatctttcagccaccccttgtctcagcccttcaccatctacaacaagcttggtcagcactaagtccagttgcacctgtcatagtagcagcagcactgctggttcagttccttatacaactgggccttatcagcgtgtgccgtatagtccccatcaatcttcacaaatgaatcagataacagacgagcaagaaaatttgaattctgggaggagtgcaaatccctctgagtctgtagggaatgtgacttctaaccaatttggctattgcttcagcaggagtgatgatgaggatgatgattatggtgcttatcattctgatacagaatcaaggcattattctcatgcccatgactacgacgatccagttaacattcatggggttgaccatgtctatgggccacatcaaatgcatcctgatgaagataacattcaggaaaaaagctcgagttgcctaacccaatcacagaatcttgatctagaaggtgtagctggaattcaagcacctgggaaagaagacgatgagcctgatcatgctgatggatgtgaaacttctccttatcatgaggagagcaattatgcagagcctgtggattttgagaataatggacaactgtggatacctcctgagccagaagatgaagaggatgatagagaagctgttctttttgatgatgatgaagatgaaggtactactggaggtggggaatggggatatctacgatcctccactagttttggttctggagaatgtcgtagcagagataaaacaactgaagatcataggaaggccatgaagactgtagtggaagggcattttagagctctagtagctcagctcttacaagtggagaacctaactacttgtgatgaagatggaaaagagacttggttggatataattactgctttgtcttgggaagctgctacacttctgaagccagatacgagcagaggtggaggtatggatcctggtggctatgtaaaggttaaatgcatagcttgtggacatcgaaatgaaagcatggtggttaaaggagttgtatgtaaaaagaatgtggctcatcggcgaatgacagcaaaaattgataaaccacgttttctaatacttggcggtgctttggagtatcagcgtgtttctaaccagttgtcaagtgttgatactttgttacagcaggagatggaccatttgaaaatggcagtagcaaggattgatgctcatcaccccaatgttcttttggtggaaaagtcagtatctcgttatgctcaagaataccttcttgctaaagacatatcacttgttctgaatattaaaaagccacttttagagcgtattgcccgttgtactggtgcacagattgtcccttcaattgatcatctgacctctcagaagctgggatattgcgaaacattccatgtagacaaattttttgaggagcatggtagtgccgggcaaggtgggaaaaaatcaacaaagactttgatgttctttgagggttgcccaaaacctttaggttgcactatcttgctgaagggtgccaatggggatgagttgaagaaggtgaaacatgtgatccaatatggaatctttgcagcctatcatctggcgctggagacatcttttctggctgatgaaggtgcttcacctctagagtttcccttgaaatctcccataaccgttgcattacccgataaaccatctagtactgtgagatccatttccactatccctggattttctgttcttactgctagagagtctcagggagcaaaaccttttaaagaagtaccaaaatcaaatgatatctacaagactgaaagaaccccatctagctgcagtgagtccactgaaagattattggtgggtgactcaatccatatgcatgaagtgtctggaggtatcacccaattggctctggatatgccatcttccaactgcaatagtttcgtttcaaatacttcttctaaggagaatgataagaaatgtcccaaggaattttttcaatacagaccagatgagagaagggaaactatgttgaacaatggtcttatttcaaattctttcggtacctttgagtcttcacagcaagatggcaatagccacctcagagctgcagcattgtttgctaatcaaggagctaaccctgagccacctaatgtaaaacatgacactaataattttaataacaataatgatcatgatgatatgatacattcaaaagaagattttcctccctcaacttctgaccatcagagtattttggtctttttatcaacacgttgtgtgtggaaaggaactgtttgtgaaaggtcccatcttgtaagaattaaatactatggaagttctgataagcctttgggacggtttttgagagatcaactacttgatccgagttacacatgctgctcatgtgagttaccatcagaagctcatgttcattgttatactcatcggcaaggcagcctgacaatttgcgttaagaaattggagtttgctttaccaggagaacgagaaggtaaaatttggatgtggcacaggtgcctgaaatgccctcgcatacatggttttcctcctgctacacgaagaatagttatgtctgatgctgcctggggcttatcctttgggaaatttttggagctgagtttttcaaatcatgcagcagcaagcagggttgcaagttgtggtcattctctccacagagattgtttaagattctatggttttgggaagatggttgcctgctttcgttatgcttcaattcaccttcattctgtttatctccccccatctaaacttgaattcaactatgatagtcaggactggctacaaaaagaagcaaatgagctgcataacaaggctgaaatactgtttagtgaagtgtgcaacacactgcatcaaatttcagagaaggtttcaggtcctgtgttgcaggagggtggaaatagggtgtcagattttaggaatctaattgctgaacttaaagggatgctgcagtatgagaaagaagaatttgagggaaaagctggtcagcctgtgattgatattctagagctcaataagttgcgcaggcatatccttatccattcttatgtttgggaccagcgcttgatatatgcatccaatttaagtaaaattattcttcaagaaaacttgaagagcttaaatcatagggagaagttgcttggttctagggaaaaggttgtcgaggccgatgttgccactaggcctgcaagaggccatagcagttgtgattcctttcttttggaaacaaaacctgatggaaacctaaatttagaaaacactagccaccttagtcaccctgtggttaaaagtgaggacaagggtaaagacacaaatcatgataaggttgacctttctctttctggtggtgcaaatatcaatgataaatctgattctgtggagtttggaggggctgtacggaaggctttgtctgagggggaatcttccagtgaaggtcatcctacaaattcatcactcaaagaaaatggttgtctacctcccgatgcagcagctgtggctgttcattcacctgtggcaaatatagttacatcaaaatcaaattctaatatttatactgctaatataggtggggttgaggcaggatgcactaattactctaaattgctttccaagggacttgatactacatggaaaggaataccttttgcaaacgtctttggttcattcaacaaaacttcttccttcaatacagagaagcttgttgagtacaatccagtccacattttatcatttcgagagttggagcgccagactggtgctagactgcttcttccagctggcactaatgataccatagtgcctgtctacgatgatgaacccactagtgttatagcgtatgtgcttgtgtcaatggattatcatatgcagatgttagaatatgatagacctaaagacagtggagacagttcaatttcattgccactctttgattcaacaagtctactttctcttaactcttttgatgagacaattactaatacctacagaagtctgggctcttttgaggagaacgtgttatccacttctgggtctcggagtttgccggctggggatccattctcatacacaaaggatttgcatgcaagagtttcttttactgatgatagctcccttggaaaagtgaaatatactgtaacttgctactatgcaaagagatttgaggctttaagaagaacttgttgcccttctgagttagattttgtgcggtcccttagtcgttgtaaaaagtggggagctcagggaggaaagagcaatgttttctttgcaaaaaccctggacgatagatttattatcaagcaggttacaaaaacagagctcgagtcatttactaagtttgcacctgcttattttaagtatctatctgagtcaatcagtacagggagtccaacttgtcttgcaaagatcttgggcatttatcaggtaacatcaaagcacctcaaaggagggaaggaaacaaagatggatgttttggttatggaaaaccttctttacaggcgtaacattagacgactttatgacctcaaaggttcttcccgatcacggtacaatccagatacaagtgggagcaataaagtgctgctggatcagaatctcattgaagctatgccaacctctccaatatttgttgggaacaaggcaaagcggttgcttgagagggccgtgtggaatgacactgccttccttgcatcaatatatgtgatggactactcattgctggttggagtggatgaggaaaagcatgagctggttttaggtatcattgattttatgaggcagtatacatgggacaaacaccttgaaacttgggtgaagacctcaggcatccttggtggacccaagaacacttctccaactgttatatcaccacagcagtacaagaaacggtttaggaaagccatgagcttgtattttcttatggtgccagatcaatggtcccctccagagttacaccccagtgggtcccaatctgacatttgcgacgaaaatgcgtga

SEQ ID NO: 27536 - DNA, 819 bp, Glycine max
  Peptide Sequence Number=SeqID_119221
atgcaccactgtcgatcctgtgggagaacattgtgtaatgaacattcatcaaatcaaatggctttaccacaatttggcctttactcaaatgtccgagtatgtgctgattgtttcaacaacttgcggtctgggaaggatgaaccacagacttcttcagacggagtaaacagtgtgacagatacaatttctaaattagatatcaacgcaaatgttgattcaaaatccatactaactgcagagactaagcttttgtcaggcattaaagagtgtaaatgtggaatgccactttgcatttgtgaagctccaaccccttcctctgatgcattcccccagcagggaagttctatgtttaacgttggtcatgtaactaatggtacctcagacagaccccagattgattatgaagttactggagagggtttaagagaagcaataaaaaatagtgacgttgctgctgttaagaaacttcttaatgagggtgtggatgcaaattacagggacaagcaaggactgtctttattacatttgcaaaattgtggaatgcaaaacctaactgactgtttcttattcaggagaaacacctttagattgtgcaccagctaccttgcaatacaaaatgcgaaagaagatggaggaaggtggagcagtggaccaaagcatttgaacaatctattacttttatcagtgttctttttatgcagtcctcccaaagagagcttcaaatattaccactgtctaaagctcctctgttaccagaacaaaaaatttcgccttctgtataattgtgacagaggagttcaattcatcttggcagactaa

SEQ ID NO: 27537 - DNA, 1044 bp, Glycine max
  Peptide Sequence Number=SeqID_119222
atgtttagattaaggagttgtgaaggccctgtgcgctacttgtatcagcaaactcggcatcaccttcaccataacaacaatattatggcttatttagttggttatgatccttgttcccacttgagcaaggccttttctcagtatccttctcttgcttcttctgatcgtggtagctacctgtctttccgatttctccataatcttgtttatgctgatgtttttggggttagcagaagcattgcttttggtcctagaagttgtagctttgacactagtggtagctgtagtagtactaatagtgataggatctttgtgagggcaaaggcaaggtcccgtggctttgcatcgaattgccgccagccgatgctggctgatttggagcaaaggaattttgttaggagtgatgagagtgatgctactttggttaaggttgataatggatctataaatggatgtcctgccaagcctccttgtttcaatgatcatcgattgtcccagaaacttgtggttgctgttgatgttgatgaggtattaggaaactttgtgtcagctctcaacaagttcattgcagatcgatattcatcaaattattcagtttctgaatatcatgtgtatgagttctgcaagatatggaattgttcacgtgatgaagctgatatccgtgttcatgagttttttaagacaccatatttcaagtcagggatccaccctcttccaggtgctcagatggctcttcagaagttatcaagattttgtagcctatcagttgtaacgtatgcttttggtattgaactttcttcaaactgtaaaagaatcttttcagcattgactaactggaggtctttaaatgccaaggttcttattgatgataacccacggtatgccatagagtgtgctgatgttggaattagagtcttactttttgattatgaaaactcatatccttggtgcaagaacgagtctgttgatcagcatccactggtgaccagagttaagaactgggaagaagtggaacaacaattaatgtcactgatagcttcttag

SEQ ID NO: 27538 - DNA, 1659 bp, Glycine max
  Peptide Sequence Number=SeqID_119223
atgggaacgttccagaccttaagaaaggcctacggtgctctcaaagactccaccacggttggcctagccaaggtcaatagcgaatataaggaattggatattgcaattgtgaaggctacgagtcacgtagaatatcctcctaaggaacgtcatgttagaaaaatattctatgcaacttcagcacaccagccgcgggcagatgtagcttactgcatacacacactagccaagcggctttcgaagacacggaattggatagttgccataaagacattgatagtcattcatagaatattgagagagggtgatcctactttcaaagatgacctcacagcctacgtgcgcaggggacgttttcttcaaatatctaatttcaaagatgactcaagtgctctagcttgggactgttctgcatgggttcgaacctacgcactatttttagaagaaaggcttgaatgttttagaatcctaagatatgacatcgaagctgagcgtttaacaaaaccatcaccgactataactcaaggacatagcagaacacgaatgttgactagtgaagggctattggagcagctgcctgcactgcagcaacttctatatcgcctaattggttgtgagcctgaagggttggctttacgcaatcatctaatacagtatgcactggccttgttctttgatatgccaaaatatgatgcagtgaaggcgttacgtatttataaaagagctggccaacaggctgaaaatcttgctgacttctatgaatactgcaagagattggaccttgctaggaattttcaatttccaaccttgagactgccacctgcttcttttcttgcgacgatggaagaatacattaaagaagcacccctgactgctactaagagactggagtatcacgaaaatgatcaatcacctcaaagtgaagcagaacccaaagaatctgaagaagctgaagcaagtgagcaaccagatgaagaagtcaacgaggaagaactggtagataaagatgaaacacaacctaaggaagaggaagctgaacttcctcctttgatatcaactgatgatttgctgggtctaaacgagataaatccaaaagctcaagaactagaagaaagcaatgctttggcgcttgcaattgtaccacccggcggacattactcaaacaatcttgcgttgactaacataagcggaacttctggttgggaacttgcactggtaacaacaccaagtaaccatacaagccaagcaccagatcgcagaatggctggtgggtttgataagctattactagacagtttgtatgaagatgaaaatgccaggagacaacttcaactacgaaatgcaggctatggatatgagggaatggatacacataatccatttgatcattataatcagcaggatccatttgcaatgtccaacaacatagcgcctccggccaatgtgcaaatggcattcatggctcagcaacaacaacaaatgatgttccaacaacagcaacaatataacacgatgatggtcccttaccagtatccacagactcaatacaatcaacaaatgccagtaatgggttctgctaatccatttagtgatcccttatccgtgcctagctatacttatagttccatgcatcatcaaggaaactaccacttaatgtag

SEQ ID NO: 27539 - DNA, 1122 bp, Glycine max
  Peptide Sequence Number=SeqID_119224
atgtgccaaagaagcatgagtggtggtggcatgaagctgctgaggatgtttgtgtttgtggggttggtgattgtgaaatgggtggaaggctttgaggatgctaatgtgacagacctaggcatgcaatatgtcagtggaagaggtttctacagacctttgatggttggttttactcatattaatggtgctgctgctaaaggagctgtctgcctggatggatctttaccggggtaccacttccaccgtggatatggttcaggatcaaacagttggctcatacaattggagggaggaggctggtgtggaactgtaaaaaattgtctttatagtaagaaaacacgtcatggttcatcattttttatggaaaaacaaataccatttattgggatattgagcaacaaagctgaggaaaatccagattttttcagttggaatagaataaaaatccgttattgtgacggtgcatcatttagtggggacagtcaaaatgcgggagcagggttgtatttcagagggcagcgcatttggcaagctgctatggaagatttaatgtcaaaagggatgcgctatgccaaacaggctcttctatctggttgttctgcgggaggtttagctactattatacattgtgatgaatttcgggaattgtttcctagaaccacaagagtaaaatgcttaagtgatgctggattattccttgattctgttgatgtttctggtcgtcgcagcttaaggaatttgttcggaggtgtggttaccttgcagggagtgcaaagaagtcttccaaggagttgtactagtcgcctcaatccaattttgtgctattttcctcagcacttaattgctggtgtcaggacaccactgtttcttctcaatgcagcttatgatacttggcagattcaagcgagtcttgctccaccatctgctgactaccactggaactggtatgaatgcagaaaaaattatgcacgttgcagtgcaccacagatacagtatcttcaagctgtaactgggattgcggagtctgttgggaactggtattttgatcgagttagtgtccaggccattggctgcccttacccttgtgacaaaacatgccataatttggtatttaagagatag

SEQ ID NO: 27540 - DNA, 2313 bp, Glycine max
  Peptide Sequence Number=SeqID_119225
atgggtttcaagtatttgctggttgtgacgtgtgtgtgtgcttggtttggatccttggttgttacaacttcttctggtgatgggttaatgagggttagtctaaaaaggaggagtttagatattagcagtcttaattctgcaaagatcaaggaggttgttaatcatttaaaagcagatggagtgtatctgaagaattatcttgatgcacagtattttggcgaaattggtattgggtcacctccacaaagcttcagagttgtgtttgatactggaagctcgaacctgtgggtcccttctgccaaatgtgtcttgtcttttttgtttggaaaatgtccaggaacaccttgcaagatcccttatggccgtgggcacattcctggcttcatcagccaagataatataagagttggggacatcatcatcaaagatcaacaatttgctgagattacaaaggaaggaccgctggcgtttttagcaatgcattttgatgggatacttggacttggattccagaataagtcagtgggacaagtcacaccagtgtggtacaatatgatagaacaagggcacgtgagtcaaaagattttctccctttggctaaaccaagaccctgtggcaaaggtagggggtgagattgtctttggtggcattgactggaggcactttaagggtgaccacacttatgttccacttactcaaaaggattattggcagattgaggtgggagatattctaattgcaaacaatccaacagggctatgtgagggtggctgtgctgctattattgactcagggacctctttgattgccggtccaacaaaaattgtgactcaaattaaccgtgccattggagcagaaggatatgtgagttatgaatgtaaaaacatcatccataactacggtgattcaatatgggaatatataatttctgggtatatgctaagaattgaagaaggttgcaacactgtctgctatggtggttttgttcctctagatgtgccagctccacaaggtcccctctgggttcttggagatcttttcttgggggcttatcacacagtgtttgattatggcaatctccgtattggatttgctgaagctgcgattttgcagcatttaaaaaccgcagaccctcagaatttcagtgctgcaggagataaaaggtttaaaggtttaaaaccaaatgcaccagccgggaatcgaacccgggtcaggtttaaaggtttaaaaccaaatgcaccagccgggaatcgaacccgggtctgtaccgtggcagggcctgtgaatcggaattgggatttaaatttaatcattatgtctgtttcttcaatcggaatcacgaacaacatggaagtgagaattgggcaaagggtttctcgcggaatgctccctatcctcgctctccacaccttcagcgagtattaccgctccgaccacaaacctccggtcaccgccgccctcatcgccgccaacaccctcatctacctccgcccctccttcctcgaccccctcattccccccatcgaacaagtctggttcaaccctcacctcatcctcaagaacaaggacttgaaacgcttcttgctgtcaccgttttaccacatcggagaaccgcacctggtctacaacatgctatcccttctctggaaggggtttcagttggaaacctcaatgggaagcgtcaatttctcttccatggtcgcttccttgctcgttctctcccagggcgtaaccctaatgctatccaaatcactgcttctgttcttcgactacgagagatcctactacagcgaatactccgtcggattctccggcgtcctcttcgccatgaaagtcgttctcaattcccaatcggagaactacacctccgtctacggagtcatcgtcccgtcccgttacgctgcgtgggccgaattggttctagctcagcttctcgtgccgggtgtgtcgtttctcggccatctcggtggcattctggcggggcttctttatctgaagctgaggagtacttattcgggttctaaccctataaaagttgtcattagagggattgttgatgctgtcaagtggccttttaagttcttgccgcggcggggacggatcaccggaaggggaaccgttggaagtaacagggcgtggagatgccagacgtgtacctatgacaacaacaatggctccctgagagtgtgtgagatgtgtgggaccaataggggtgtgagtggggtgtcttcttttcagaggacttcccgttctgatgggcttcctttggatgagttgcgtcgccggagaatcgacagatttggaggcagctga

SEQ ID NO: 27541 - DNA, 117 bp, Glycine max
  Peptide Sequence Number=SeqID_119226
atggagggcaaagttgcattgaaaaaattgctggaagttcagaaaaaggcacatgttaatagtacagatgcactcaactggactgaggaaccgtccattaaaaatacttttccatga

SEQ ID NO: 27542 - DNA, 528 bp, Glycine max
  Peptide Sequence Number=SeqID_119227
atggtccacatatcagatattaaactgataagaacagatactacacttgatcttagccaaaaggccgagaaagaccctcagattcttggtgacgcgaagggtctctcctcgtttggtcttcaacaaaccataagcaactgcaagtttttcactatggtagaacaggggattctccctttcctcctcaacaagatcatgcaacacaccatccgtaagaagagagaaaccaagcaagctgaattgaatgaatggaggtgttgcagttgctgggttccgattttacccttcgccattccctttccaagcccaccgtctcccttcctcccactcattcactctccggcggcgctcggtggtgggagcgttcaacgagttgacggagagaatgaacgtgctgtcgacgagctctccgcgtcttctgttcaagtgcctcaaactttccattcccatcttgcagagttctcctctcgctcccgatggtcgttcccttctctccaaagccatatccgtcgctatgctcctcgctga

SEQ ID NO: 27543 - DNA, 798 bp, Glycine max
  Peptide Sequence Number=SeqID_119228
atggcctccaacttgcagatgagtcctcaggtggagcagatccacggtgaaatccgcgacaactttcgagccctcgcaaatggcttccagaagctggataagattaaagatgccaatagacaaagtaatcagctggaagaactcacggacaagatgagggagtgcaaaaggttgataaaggagtatgatcgtgagattaaagatgaagagggaagaaatcccccagaagtgaataagcagctcaatgatgaaaagcaatcaatggttcatatttcttccatttctgcctttgacacaattgcttcttttgaaggttatggaacaaatcagattgccaataccggagcaagtgtatctacagctgaagaaaatgttcaactggcatcagaaatgtcaaatcaagaacttatcaatgctgggacgaagacaatggatgaaactgatcaggctattgagagatctaagcaggttgtacatcaaacaattgaagttggcacccaaactgctgctaccttgaaaggccaaactgaacaaatgggtcgtattgttaatgagcttgattcaattcagttctcaattaagaaggcctcccaacttgttaaggagattggtagacaggtagctactgacaagtgcatcatgctttttctgttccttattgtctgtggtgtaattgccattattgtcgtgaagattgtgcatcccaacaacaaagatattagggatataccaggattggcacctccagttcccaccaggaggcttttgtatgcaaggagtggagatcattttgattaa

SEQ ID NO: 27544 - DNA, 1011 bp, Glycine max
  Peptide Sequence Number=SeqID_119229
atggaggttatgaagatacatgctcctcttgctcatgctgtgggaactacctacttgtcactggaattggaagatctctcgtttcagtacttgtttccttattcatatctttatgtggattttttgtggttgcaaagtcacgagactgggggtgtatctctaattgacatctacaaggaggaattgctccagaatctaaaggctgatcccttgcttgctgaacttgtggatgatgtcttgatcaaaggtcgctataagagtcgttatagcacaatgaagaagctgctgaaggatggtcggaagccagaagatgtgaatgatatcatccaatctatgtggaaggaagtcccttatcggacaaaggattatattgccaggccaaaagcaaatggatataaaagtttgcatttggcagttgaagtgattgaaaatggtaagacaagagcattgatggaaatacagataagaacaactgaaatggacaggctagcagttggtggaacagctgcttattcattatacaaggctggccttactgatcctgaggaagttgttgttgatgctcaggcaaagtgtctgaagaccatcatcttggctgcagctgaattggctgcactgcgccttaaagattttctgacaaatagagtgtttcgccttcttgacaagaacggagacggtaaaattagcattgaggaacttacacaagtgatggaggagcttggtgctccaggagaagatgcccgagaaatgatgcagctccttgactcaaacagtaatggccccctcagctctgacgaattccatatgttccaagaacaggttgagttggtgcgtaatttagaggcccgagatgatcaaaacaataaattattggatgagaagcttcatatggcagatgagagtggtttaattcaagtttataatgagttcgtcaccaggcttgcgagctggtgcttgatccatttgaaacgaatgacagaacaaaacacactcaatttactccacttgtga

SEQ ID NO: 27545 - DNA, 3105 bp, Glycine max
  Peptide Sequence Number=SeqID_119230
atggaggctgagtttggagcgaagaatcagtacttgtatggacctgtggtgtcaggaatgaagaaagctgttgttgggaatgggaagaggagtttggaatgggatttgaatgattggagatgggatggtgatcttttcactgctcaaccactcaattcagtgccatctgattgtaggggtcgccagttttccccacctcatcctgaaattcctgcaaaaaatgctaatccatctaccaccaatttgtcttattctgttttcatctcaggtgaaggaaagagggaattggagaaaaggaggaggggtgttataggtgaaggtgaaggtgagggactgaattatgaggctggttctcttagtttgaaccttgcgggtcaaggttaccctctcatggtggaagaagaagaaaagagtggaaagaaaacaaaggtaattgggaccactacagctagtactaccactgcctctaatcgtgctgtttgtcaggtgcaagattgtagggctgatcttagtaatgccaaggattaccaccgtcggcataaggtttgtgatattcattctaaggccactatggcactagtgggaaatgttatgcaacgtttctgtcagcagtgtagcaggtttcatgttcttcaagagtttgatgaaggcaagagaagttgtcgaaggcgtttggcaggccacaataggaggaggaggaaaactcatcctgatgtttctgttgttaatgaaggctctctgaacgatcaaaggggcagtaactatctgttgatgagtctgttacggatactgaccaatttacattcaaatggctcagatcatacaaggaaccaggatattctctctcatctgctgaagaacctggcaagtctggctggtccaaataatggtggaaggttagcacccttactggaggaatcgaaagacttggtaaatgctgggacgcccggagctgctcaggataaacccaaccttaactcaaatgctcctgaagcttccaggccttcttctttcatcaagacagacaatgtcatcatcactcaggaccctacaatgccggtggcgcagtatgaaacacctgctgatggcaggacacaaaaatgtatagcttcaggtgatggtggagtaggaaattcaaaacctccttcaagaccactgttctcaaatgtatgtcaaccaagggacagccttccatcccaattaactacagcagagactaaagtaggaaggggaaacttgaataacattgaccttaataatggttacaatgatatacagaatactgttgagaatcataagaagccttatcctcctgtggcttcagtgatggggtctattgaccgtgcctcatggttgcagcgtgattctctcaaatcaagtcctccacagacaagtagaaactcagattcaacctctatccaatcaccatccagttccagtggagaagctcagatatctttactgataaagatactattttgccaaggtgcagcgcctctttgcatatgcaagggtaaggctgcgtacaacatccctcccccataccttcgcatagcgaagagcctctggacaatggggtacgaagttttacttaatgatttggatagaagtatgagtcgcacagatcgaattgtttttaaactctttggcaaggatccatctgattttccccttcttatccgatcacagattctcaactggttatcccacagtcccacggagatggagagctatataaggccaggttgtataatattaacgatatacctccgtcttgaaaaatctgcatgggaggagctctactgtaatctaggatcaagcttgagaaagcttcttgccgaatcaaatgattcattttggagaacaggatgggtatatgcaagggtgcagcactctgtagcttttctgtataacggtcaggtagtcttagatgtgcccttgcatctcaaaagcccacaacattgtaggatttcatgcattaaaccacttgctgttcctgcaagtgctagtgctcaatttattgtgaaaggtttcaaccttttccagtctagcacaaggttgctctgtgcacttgaagggaagtatctggtacatgctagctgtcatggtttgattggtggagctgatgcacccattcagcatctaagcttctcttgtcatataccaaatgtaactgggagggggttcattgaggtggtggaagatcatggtcttagcagctgttcctttccatttatagttgcagagcaagaggtttgttcagagatctgcaaactagaaaatgtgattgaggcagctgaaaccactgatgacatccagataaaaaaacaacaaatggaagaaatgactagagctttggatttcttgcaagaaatgggttggcttcttcatagaagtcatgtgaaagttaagcttggtcccatggctcctttccgtgatctcttccaattcaatcggttcgcttggctcgttgacttctccatggaccatggctggtgtgctgtgatgaacaaactcttggacattatatttgagggtggtgttgatgcgggagagcatgcctccattgagcttgcattgttaaacatgggtcttctacacacagctgtaaagagaaattgtagacctatggtagaactactgttaagatttgtgccagttaaaacctcagatggtgcagacagtgaagtgaagcaagttgacgaagcctctgacagattcttgtttagacctgatactgttgggccagctgggttgactcctcttcatgttgcagcaagtatgagtggcttggaggatgtgttggatgcattaaccgatgatccacgaatgttaggaattgaggcatggaaaagttcccgggacagtacaggtttgacccctaacgactatgcatgccttaggggctattactcctacattcaactagtccagaagaagaccaacaaaaaaggtgaaagacagcatgtggttgatatcactggcattgttgtagatagttacacgacgcagaagcaatcaaatggacataggacatgtagagtttcaagcttgcagactgagaagattgaaacaacaacaatgccacgtcaatgtcgggcatga

SEQ ID NO: 27546 - DNA, 6612 bp, Glycine max
  Peptide Sequence Number=SeqID_119231
atgtcgaaggaaactcgaacctccgctcgaagaaaccctcaaaccgaatcaaacgagaacgaattcgaaccatgccccccgaaccaaatcaacttcccacctccccgaacccccttcagctccatacctgacccctctcggttcggaaacgccactcccaggctctccgttaggttcgggaagccgcattccgaacctaactcggcgcagagcacgccttctagaaacacttccaggctttcactcggcggaggaaggttaagttcgtgtgcgttcgttaaagagaccgaattctgcgtccacgttccgcatttcgacctcaaagacgacccgtcgttctggacggatcataatgtgcaggtgctgattagaattcgaccgttgagtaattcggagaaggtttcgcaagggcatggtaggtgtttgaagcaggagagtgcgcaaactttggtctggctcggtcatcctgaaaccagattcacctttgatcatataggatgtgagaccttatcacaggaaaacctgttcagagttgctggagtgcccatggtggagaattgtttgtctggttacaacagttgtatgtttgcttatggtcagacgggtagtggcaaaacatataccatgatgggtgaaattaaggaaacagaaggataccttactgaagatagtgggataacaccaagagtttttgactatttgtttacgaggattaaagcggaagaagagagaaggaagtattacaagctgaaatacagttgcaagtgttcctttttggagatatacaatgagcaaataactgatcttcttgaaccttcatcaactaatctgcaactcagagaagatttgaagaagggggtatatgttgaaaaccttaccgaacatagtgtggacacagtttatgatgttctcaggcttttgttacagggcactgcaaatagaaaggtggctgctactcacatgaactgtgaaagcagtcggtctcacagtgttttcacttgtattattgaaagccaatgggagaaagattctatgacccactttaggtttgctaggttaaatttagtagatttggctggttctgaaagcttggtcataatgactttggtggacttagcccatgggaagcctaggcatgttccgtacagagattcaagacttacatttcttcttcaggattctttaggtggtaattcaaagacaatgatcattgcaaatgtcagcccatccatttgctgtgctaacgaaacactaagcacactgaagtttgcccagcgagccaagctcattcaaaacaatgcaaaagtgaatgaagatgcttccggtgatgtaagtgcactgcagtggcagattcaacagttgaagggtcaactgtcctttctgatgaacaataaaaaatttccaagctctgttccaaatttagagccaaatcctgaaagctgtaggttgagtgaagtgtcagaagaatatgaatctttgggagaaagagtaacaacagatcaccaactacttattccaagcaaagagaacaaatgcatgaaaactgctttggttagtgccctgaggagagaaaaaatggctgaaactacgatccagaatttaaaggctgaaattgaccacacaaattgtttggttcgacaaaaggaagaggaaattcaacatacttcaagtatgctgaggcattataaggagaaaattaaacaacttgagttattggtagatgggaaactgtcagctgagaagtatctaatggaggaaaacagggctttacaggaggagattcagttgcttaaagtgaatattgataaaaattcagaatcatccagacttgctttggagaatgatagacttttgcaacaacttcaactatttcaaaacttctatgagcatggagagcgggaaagattgctgactgaactatctgaattgcgtgatcagctccttgtccatctccaagaaaaatttacatactccatgaaaaatgaaaatcaggatactgatactgcacaagagttagaagagtgccagaatatgaattctaaattacttagagaagttggtatattacaagcaaatcttggaaaatatttgaactacaatcaaattctgaattcttcttttgagcatcctggtgaaattctaaagactgataaatgttcattggttgagacaatatcaatgagaagtgattctggagatgaaattccgtcctctacatgggaagctgatgatgctttagcaaatataattgaaggaaatgctttgcgatcctcaataatgcttgctaaagataatgaatataacaacgaagagttagaggccaaattggaaaaaatgagcaaggatcttgaagaagcgaggttagttaatgaccaatatcaagagaaatgggcattacaattatatcaaaaacgacagactgaaacaatctgtcaagaggttgagatggagacaaccaatacaattcttcatttacaggaagaggttgcccatcttcagtcagagtttgaagagaggttatgcaccattgctcaagaaaatacagagctaagaaatatggttgcagaaaaagaagaggaaattaggtcacggtgtttggactgggaaaaggcaatcttggaactgacaactttcctcctagaaggctccagatctctcaaagatgcctgtggtcaggtgaaaaacatttcttgttcatttcctcaggccaatgcttggattagcgaacatgttgacatggcggtcaaaaagtatattgagaaggaggaaacaattcagcagctacaaagtagcttgaaggatgcacagaagatggtatcggacatggagctgaaaataagttccttaaaggaagcaacagtagccttcaatgcacttcaacagttagacaacaatgaaggcaatgaggaggtgattgagttgcaagtgttgttaaatgagaagaccaatatgataaggatgctggaaaatgaaataaatcataaaaacaatcaactttgtaaggtaaccaaacaagctgatgctgcattccttgtagcaaagtggctctctgattgttataatgtagctcacatgaatgatgatattcaagatatttccattcctgaacttgatgtgcaagccagacttggaaattgtactatttctgagaatcaagatgttcaaaataatttgatactgaatgatcttatggctcaagttgagttaacaaaactagaggtactggagatggagaatgctgtaaaagcctcttttgttgatacagaaacacagatagaagctttccaaactggtgtttcaggcctttattctgcttacaggaacttgattcaggacattgtcaaggaaactcaggatacaaagaaagaaataagggatttaaagatttatcatagaagttccaagggttatagagtagactccttaacatcaaatgcaaacaaatgtaaggagtatgcaaaccagcatcacacactacatcagataaaagagcaacttgttgaagtgaatagaagattgaatgtcatagacaattttatcagagcagaaaatatgtctagctttcaactactggatgaagatctcatagatgctgatgatttgagcgctgatagttcttcagtctctgatttatcaactgaaactgacagctttgcttctggaagcaagtcacatgaatccacatatacttgcaactttaagttccctggaaaaacaactgaacaaattgtacacctaaaatccgaaagatgttctgtaattcaatctcatggtagttgcaaatcatcaaatacaggaaagcttgtggaaaggcgaattcataatgaagcagtagtgtgctgtctgagtaaagaattaaatgtcacatatgatagttttcaaagattgtatcttcgtttgtctgcactcctccaagaattggatgatggatcctgtttttacccaaaagaactgaaaaaggtggctccatatttccagttggagatgcagaaagacaaagcaggttgtgagaatgacaaagagatattgggttatatggaaattaagcctgatgatggcttcttgaccaaatttatggaagctcatgcaacagtgcaggaagctgatcttacactgcatgccttgacggaagcttatgaagattcaaaacagttgactgctatgtggaagcaagctggtgaagacttgatgattgagagagcgagcttggtagaagagattcaaaaactcaaattttcaatttttcataaagaagaagagaatcgattactgaaggaccacatacatttcagtttgatggatatgacaaattcagtttctatgctagaagagcatttcttgcaaatgcaaattgatgtggagaagaaattcttgacaatgtattctgatattcttgtgactgggcaggagatgctatactttatgcacaacctgaggtcatcagtagaagatatttgctctcaaatggtgggtgaagggtttatatcttttgttctgtacaattgctgtgtaacagagcttgtcagtaaatttgcctgcactagtgtgaaccgtgatttacaatcagccagaccaggggaattgcataagttgccacaaatttgctctagtgttgcagcgccagcaattagtacaggtaaagaaggtgcagagaaaagagatcaatgtgtgctaatccaaaaggtgcaagagcagccagacttgcccaatgtcaatgtattatatgaaaatatggctcttagaaaggagttagagaggaagcaagagctattagagggcttactttttgactttaggctattgcaggaacaggcttctaacagcaaggacattaaggatcagactgagaagttaatattttctctaacccaagttcggtatgagctagagattaaagcaagtcagcttgatgatatactggttcaaaacagaaaacttgaaggttctcttgctgacactgagaaggccttaactacatcaaattatgaccttcaacttgctaaagaatcaattgagaagctttctaatcaaaatgtggagttaagggagcttctgaaagaactatatgccaacaaaactgaagctgatgggaaattggaggaacataaagaggtgattagaggtttggaaaaagaaatttctaatttgacagcttcacaggaaaatcaatcacttgccttgtttgaaagcattgaggatgaactaaaccaggtgataatagagagagaccaactccatgaagaagtttgcgtcttgaatggtaagcttgagatggcttattccttggctgacgaaaaggaagctattgccatggaagcgcgtcaggagtcagagtctagtaagctgtttgctgagcaaaaggaagaggaagtcaagattctggaacattctgttgaggagcttgagtctaccataaatgttttagagaaaaaggtacatgaaatggatgaggaggtgggaagacatcggttaattagtgattcactgagaatggaactccaagctttgaaagagagattattgttagttgacaattttcccaagaatgcttattcagaaagcacaagtggtcaaactgatgagcatatatctagacaacccagtaaaatactggaacttcgcgaggcactaagtcggataaggtttcttgaaaaggaaaatgcagaacaagataaagagattaaaaagtgcaaagagtatatatctgaaattgtgttgcatgctgaagcccaagcattgcagtaccaacagaagtacaagtgcctggagtccatgttccatgaagtcaaaacagaagtgtcaaattcaacgtcaatggtatcagcatcagagaaaattgagaaaagttcagtaaggacaagaggttcaagctcaccattcagatgcatttcaaatattgttcagcagatgaatcaggagaaagatcaagaactgttagtgtcaaggctccgtgtggaagaactagaagcacttgcagctagccggcaaaaggaggtatgcatgctacaaacaaggctggctgctactgaaagcatgactcatgatgtcattcgggaccttcttggtgtcaaattggacattaccgactatgcaaatttgatagacgaaaaccaaattgtgaaattagtggaggaggctcatcatcatagagaagagttcattgcgaaggaaaaagagaatctcgatttaagactgcagataaatgatctcattgaagaaagagaatgctgcatatcggaactgaaaaccaaagaggcagatatacttgccactcagatagcaatgcagcaactgcaagagcgagatcaattgctttctgcacaaaatgaaatgttgaagatggacaagaccaatctcatcaggaaggttgcagaattagatgacatggtgaaaacactagttgggacacgaaatacccaacctgctccacagtcatcaaagactaaggcatgtctacttatctttttgtttttggacaagggtgcattaaatttgggtaacggtggatacaataaaaggttgtctttgtctcaacccgaacgacgcctttctcgttttaatgacgagccttctcgttaccgcaaatttgctggtaataattcgcaaggctaa

SEQ ID NO: 27547 - DNA, 1443 bp, Glycine max
  Peptide Sequence Number=SeqID_119232
atgcaaccaacagcagcattgaccatggcggaggaccttactcagatcgctcacttgctcgaccaaacactcagccccgacgccatcgccgtcccagccgccaccgatgcgctcgatcgcctctcccttactccgcacttccctttctatctcctctccatttccaccggagcaggaaatcaaggtcagaaaatcgctgctgctacctacctcaagaacctcattcgccgcaccgtcgatagcaccggcgtcaagccttccaacgtgagcaaggagttcaaagaccagctgatgcaggcgttgcttcaagtcgagttgtccgttcttaaaattttagtcgaagtgtttcgcaccattgctgttgctgattttgttaagcagaatttgtggccggagcttgtgcctaatttgcagtctgctattcagaatagccatcttatcagcggttcaaacaccaaatggaatactgtaaatgcacttcttgttctccatgctcttctcagacctttccagtattttttgaatcctaaagttgctaaggaaccggtaccgccacaattggagcttatatccaaagaaattcttgtgcctttgcttgctgttttccatcaatttgttgaaaaggctttagcaacccatggcatagcagaaaaaaaaactgagaaagtcctccttactatatgcaaatgcctacattttgcagtaaagtcctacatgccatcaactttagctcctctactgctttcattctgtcgggacctaatgagcattttgggttctctaagctttgattgtgtggtcaatcaagaagatgaatatttgacaagattgaagactggaaaaagaagtctgcttattttctctgcccttgtaacccggcacaggaaacattctgataagtggatgccagaaattataaattgtgttttaaacatagtcaaatttaccaaaaataccagtaaacttcctttcctttcagagaggcttttgtccctaggttttgatgtaatttcaaatatactggagactgggccgggatggcgattagtttctccacattttacaactctattggaatctgcaatctttccagcattagtcatgaatgacaaggacatgtcagagtgggaagaagacccagatgagtatatacagaagaatcttccttcagatatagatgaaatttcaggatggagagaggatttattcactgctagaaaaagtgcagtaaacttacttggtgttatttcaatgtcaaagggtccaccaatggagactgccactgacagtttatcagcttcatccaagcgtaaaaaaggtcaaaagaacaaaaaaagcaatcaacgccgctctatgggggagttattggtgcttccatttttgtccaagtttcccattccttccgcttccaacttgtctcaaaagaaaatcttgaatgagtga

SEQ ID NO: 27548 - DNA, 1932 bp, Glycine max
  Peptide Sequence Number=SeqID_119233
atgaagaaatggtatggaggcttgttgataatggctttgggtatgatgttgttgttcctctacaatgtcaaaggaattcagccgcagaagcaatccgcaaaacagtcggcatataatttcttccataatcatacacctggtgattctattaatggaagcagcaatcttccagtaaactcttccgaggtggaactaaaaagggtaacaacaccagcaaaaaggccacatttggtacatgttgcagggctagatgatctgtatgacatgaaaaatctatcgaaagaagagacgaattctgtgctaatttgggattccttacgttccttgctgtcaaggtcagatgctttggctgaaacagctcaaggagttaaagaggcttctgtagcatggaaagaattgctgtccattgttgaaaaggacaaagcttctaagattaataagatggatggcccagaaaatcaaaactgcccattctcggtgacctcgcctggtaaggctgtaccagatagtggaatcactcttgatctcccttgtggtctggttgtagattcttctattacactgattggaatccctaacaacagaagcttccagattgaccttgctgggctagagcaagaaggggagccaaatcctccaattatcttgcattataatgtgagtcttcctggagaaaacatgacagaggaaccatatattgttcaaaatacatggactagtgatttagggtggggaaaagaggaaaggtgtcctgctcgtggttctgccaacattcaagaagttgatggacttgttctctgcaacatacaagctgtcagaagtaacaacaaagggaatgcaaatgttgaccaacctgctagtgatataccttctaatatttcctcagaaagtgtacatagaaccgctaattttccctttgctgagggtaatcctttcacttccacattgtgggttggttcagagggatttcatatgactgtgaatggaaggcatgaaacgtcttttgcatatagggaggttttgtggatgcagaaacttgaaccatggttagtcagcagtattaaagtagcaggcagtttaagtctcttatcaatcctggctaagggtttgcctgttactgaagataatgatatagttgttgatattgagaatctgaaggctccttctatcgccagaaaaaggcttgctttgttgattggagtattttctaccggaaacaattttgaacgtcgcatggccctgaggaggtcttggatgcaatatgaggccgtacattctggagaagttgctgtccgatttttcattgggcttcacaagaacaatagggttaattttgagttatggactgaagctcaagcatatggagatattcagttaatgccttttgtagattattatagtttgatttctttgaagacaattgcaatttgcattatggggacaaaaatcatcccttctaaatacatcatgaaaacagatgatgatgcctttgttaggattgatgaagtgctttccagccttaaaggaaagccatcggaaggcctcttgtacggtctcatatcttctaaatcatctcctcagagggacgaaggcagcaagtggtacatcagtgaggaggaatggccccatgatacatacccaccatgggcacatggtcctggctatgttatctcacgagacatagcaaaatttattgtccatgcccaccaagaaagaaaactcaagctctttaaattagaagatgttgccatgggcatatggattgaacagttcaagaatgatggtaaagaagtacattatgaaaatgatgagaggttttacaacgctggatgtgaatcaaattatgtaattgcccattatcaaagtccgaggatggtgctatgcctttgggagaaattacagaaagaacaccagccagtgtgctgtgagtaa

SEQ ID NO: 27549 - DNA, 273 bp, Glycine max
  Peptide Sequence Number=SeqID_119234
atgggtactagtcaactacagcttgtagctggccttctaggagtagaggcaggccaagatgcagttgttcgagcaatgttatatgaacgggttatgagggaaaagtttcaggaaattaatgtgcttgctgctgataaagattcactttcatattcaagaaatgtacaagaaatattgaggatactaaatggaggtaatgaacgtgtcccgggtagcttcttctctaaaggagcaaatggccgtctagccaaatcttacttaggagcaacctaa

SEQ ID NO: 27550 - DNA, 780 bp, Glycine max
  Peptide Sequence Number=SeqID_119235
atgaggctttttaagacgccggcgacggtggaggatggcatagtggtggtgatggccagggttgtgcaggggagggaagggagcaaaaaagaagatgcagggagtaaaagcctagaacaaccggtggattcccttgggtcaattagaactgtggggtatgataaggcccaatggcaaaaggaagagtttttgtgccctttccttcttcttacaatcagaaactctgaatcagacagcgtcggaggcatgggtgacaaagaggaagagtcggcaatgccaagggacgcaaagattgtgaagtctttgctgaaatcaatgggcgtggaggactacgaacctcgcgtcattcacaagtttcttgagctttggtatcgctacgtcgtcgatgtcttaaccgacgcacaagtctattcagagcatgctggaaaacctgcaattgactgtgacgacgttaagcttgcgattcagtccaaggtcaacttcagcttctcgcaaccaccccctcgtgaggtgcttctggagttggctcaaaaccgcaacaagataccattgccaaagactatagcaggacctggtatcccacttccacctgatcaggacacattaatcagtccaaactaccagtttgcaattcctaacaaaaggcctgcccaacctttagaagaaacagaggatgaagaagctaccattcccaatccctctcaggaacagaaggtagacacgcagccgaatccccatcagagagtgtcatttcccctgcccaaacgccaaaaggattaa

SEQ ID NO: 27551 - DNA, 84 bp, Glycine max
  Peptide Sequence Number=SeqID_119236
atggcatggctcggggcaatggttttcttgggtttcaatgggtggtggcttgggaacgaagacggagctggaaagggtaattag

SEQ ID NO: 27552 - DNA, 315 bp, Glycine max
  Peptide Sequence Number=SeqID_119237
atggcttcatctcataaacaagtaaactcgaaagggaaaagaataggtgatgaggacatgttcaagagcaagggcaaggatccacttgaaggatttggaggacctatgacaagggttagagcaaggaaagtcaaggaagcttttcaacaagtgttgtccatactatttgaatacaagcccaagtttcaaggagaaaagttcaagggcccaattggcaacctaggcatcagccttttgggagaccaaatggtggctgacttgttggctgttgggggtttaatcctagacgatcctaagtcagcccttatgccatga

SEQ ID NO: 27553 - DNA, 669 bp, Glycine max
  Peptide Sequence Number=SeqID_119238
atggcaggttgttgtttcataaaatatgctacctcagaagaagctgatcaggcaattagagcattgcacaatcagcatactcttcctggaggtgttggtccaatccaagtgcgatatgctgatggtgaacgggaacgcctcggtgctgttgagtacaaattatttgtgggctctctgaacaaacaggctaccgtaaaggaagttgaggaaattttctcaaaatatggccgggttgaagatgtttatcttatgcgtgatgagaagaaacaaagtcgtggatgtggttttgttaaatactcacacagagatatggctctggcagcaattaatgcgcttaatggaatctacacaatgagaggttgtgagcagccacttattgtccggtttgctgatcctaaaaggcctcgccaaggagattccaggggtcttgcttttggaggcccaggatttggtcctagatttgatgcaccaggcacaagacatccatccaatattacggatcctattggtgatcgtatgcctccccctaatgcttggcgtcccatgcatccgccaaatgtggggccaccttctaatgctggtcttcagggcatggggccaccgttgatttcaagatctggtgacatggcattgcctacaaatgcgaagagtgataaaaacaatgtttga

SEQ ID NO: 27554 - DNA, 1197 bp, Glycine max
  Peptide Sequence Number=SeqID_119239
atggaggagaagagagagaaagagaaaaactcaaagtcatcatcatctaccatggcaaattctgtggcattttccgacgagattcctaacatgagcatgagcttccctttctcccctgctttctctagtagcatctttgacatgatgccaccaccaccaccttcctcatctcacgatcctaaagctcccaactttgctaatagcttcatggacttgctcgctgtccctgctgattattataccccttctttattcgactggtcccaaaacaccgcccccacgtcagcaccaccaccttccaccacccaaatcaaccaccctcttccgtcgccagccagctccaatgtccccgacggctccgaggttctcaacactccggcgtctcccaattcttcgtctatttcatcatcgtccaacgaagcagcagccgccaccaccgccaacaaaacaacgggaaatgataatgaagaggaggaagatgaaacagcaatagatgcaacagcaggcagagaagaagaagatcatcaagaccaagacaagactaagaaacagctcaagccaaaaaagaagaaccaaaaaaagcaaagagagccgagatttgcgttcatgacaaagagtgaagtggatcacctcgacgatggctatagatggcgcaagtacggtcaaaaagccgtcaaaaacagccctcatccaaggagctattatcgttgcaccaccgcgacatgcggcgtgaagaagcgcgtggagcgttcctcggaggatcctacggtggtggtgacaacctacgaggggcaacacactcacccgtgtcctgccacgtcacgggctagcttcgggttcatgcactccgaagcaagtgggttcggacccaccagtggactaggttcggcacactttatgctgcaacaacaacaacagtttcgggaccaagcacaagcacaagcagcaatgttgtataactccacctcatcgtcattgtcattgccactgaatgttgttaactcagcttcttgtgttaataatagctatgccaatacgtcatcgttgagtggctttcttcagggccaagagaatcatcagcgaggttttgtgccgtctagggtggtggctcctcatattttcttgagggacaatgggcttcttcaggacattgttccaacgcagatggggaatgaggagaatgaagatcgtgtgtag

SEQ ID NO: 27555 - DNA, 561 bp, Glycine max
  Peptide Sequence Number=SeqID_119240
atggcacagctggcaggtgcggatgagatagagtctctgagaaatgagttagcagagataggaaggaacataaggtcctcatttagaagtcatgcctctagtttccagagagtttcaagcatcaatcctgtgcaacaagaagttgataacgacgccggagaagcgttacaatgggctgaaattcagaggctacccacctttgagagaattacttcagctttgtttgataaattcaggaaaagaattgacaaagttggtattaatttgcccacagtggaactgaggtaccaaaatctgtctgtggaagctgagtgtaaaatagtccaaggcaagcccatacctacactgtggaataccctaaaagaatggatctttgacaccactaaattgtcagttctgaaatctcaaaattccaagataagcatcatcaaaaatgacaatggaattattaagcctggaaggatgaccttattgcttggcccaccagcaagtggtcaaccctttttttttagaacacaaattaaatttataacatatagatacatgactaatgttttataa

SEQ ID NO: 27556 - DNA, 864 bp, Glycine max
  Peptide Sequence Number=SeqID_119241
atggatgggcaatcgccggagaaactgattctggtgaagcgcgagtcaaacggcgtcgcactggtgatgattaatcgtcccggttcccttaactcgctgacccggcccatgatggtggacctggcccaggctttcaagagactcgaccgggacgagtcggtgcgggtcgtcatattaaccgggtcgggccggtctttctgttctggcgtggatctcacttcggcagaggacgtgttcaagggcgatgtgaaggaccctgagagcgacccggtggtgcaaatggagctctgccgcaagccaatcatcggagccatccgaggtttcgccgtcactgctggcttcgaaattgccctcgcctgtgacatcttggttgctgccaagggatctaagttcatggacactcatgctaggtttgggatatttccttcgtggggtttgtctcagaagctttcgcagatcataggggccaataaagcccgggaggtatctctctcggccacacctttgactgcagaggtagctgagaggttgggtttggtgaaccatgtcattgaagaggctgaattgttgaagaaaagcagggaaattgcggatgccattgtgaaaaataaccaagacttggttttgaggtacaaggcggtcatcaatgatggcctcaagctggatcttggccgcgcactttctcttgaaaagccattgattactgttcctgttgttgatagaaatgcagagagcataagagcaaaacctcaaaagtctaaagagagggctcatgactattataacggaatgacgaaggagcaattcaggaagatgcaggaattcatagctggtcgaagttccaagaaacagtccaaattgtag

SEQ ID NO: 27557 - DNA, 2808 bp, Glycine max
  Peptide Sequence Number=SeqID_119242
atggcacctgaaaacccttcaacgccagatcccgaatcgccaacctctccttccgttggtttcaacaccgaccagcttcctcacacccacaccagccatgcctcccaagacgacgaggcttccgtcgatcccgatatcgtacgagacgacattgaagaacagcccgaggaagaagaagaagatggagaggatctttacaatgacaattttttggatgattataagagaatggatgaggctgaccagttcgaatcgttcgggctggacgactcgttggaagacgacagagattttgatcagatcatgcaagatcgaagggctgcggaggttgaactcgaggcgcgcgatggtcgcgcttccaatcgtaacaagcttccccagcttctccacgaccaggatacagatgatgacaatcacaggtcttctaaaagggctcgagctgattttagaccttctgtagcaagtgatgatgactttgatggtatgcaaagttcacctggaaggtcacaacggcactcaagagaggatattcttatgactgatcaaacggaggatgatcgagatgacgatgattttgatgatggatacgagatgtatcatgttcaaggtacacttagagagtgggttacaagagatgaagtgcgccgcttcatagccaggaaattcaaggacttcttacttacttatcttaatccaaaaaatgaacatcgggacaaggaatatgtctggctgataaatgagatggtgtcagctagtaagtgcagtttggagatagattacaaacaatttatctatgttcatcccaacattgccatttggctagctgatgcccctcaatctgtcttagaagtaatggaagatgttacgaaaaatgttgtctttgaattacatccaaattacaggaatatacaccaaaagatttatgtgcgcataaccaacttgccagtttatgatcagattcgaaatataaggcagatccacttgaatacaatgatccgaattgggggagtagtaaccagacgttctggagttttcccccagttgcagcaggtgaagtatgactgtaacaaatgcggggcaattttggggcctttttttcagaattcatattcagaggtgaaagtgggatcctgtcctgagtgtcaatcaaaaggaccgttcactgtcaatattgaacagacaatttataggaattttcagaagcttaccctccaagagagtccagggatagttcctgcaggtcgacttccaagatacaaggaagtgatactattaaatgatctgattgattgtgcacgccctggagaagaaattgaggtcacaggtgtttataccaataattttgacttatccttaaacacaaaaaatgggtttccagtgtttgccactgttgttgaggcaaattatgttacgaaaaagcaagaccttttttctgcctacaaacttacacaggaagacatagaagagattgaaaatttggctaaagaccctcgaattggagaaaggattgttaagtctattgctccatcaatctatggtcatgatgacataaaaactgcaatagctttagctatgtttggaggtcaagaaaaaaacgtggaaggaaagcaccgcctgcggggagacataaatgttcttcttctgggtgatccagggacagcgaagtctcagtttctcaagtatgttgagaaaactggacagagagctgtatacactactggtaaaggggcttctgccgtgggtcttacagctgccgttcataaggatccagtcacaagggagtggactcttgaagggggagcacttgttctagctgacaaaggaatttgtcttattgatgagtttgacaagatgaatgatcaggatagggtgagtatccatgaagccatggagcagcagagtataagcatatcaaaagctggaattgttacatctcttcaggcacgctgctctgttattgctgctgcaaatcctgttggaggaagatatgattcctcaaaaacattctctcaaaatgttgaattgacagatccaattatttctcgttttgatatcctctgtgttgtgaaggatgttgttgatccagtcactgatgaaatgcttgcaacgtttgtcgttgacagtcacttcaagtcacaacccaagggtgccaagcaagatgataagtcctttagtgagttccaagatatccatgcatctgccatgccagctgatccagagatacttcctcaacagctactgaagaagtacattacatatgccaagttgaatatttttccaaggttacaagatgctgatatggataaactgtcacatgtctatgccgaactgcggagggaatcttcacacggacaaggagtccctattgctgtaaggcacattgaatcaatgataaggatgtctgaagcacatgcgagaatgcatctcaggcaacatgttacacaagaggatgtagacatggcaattcgtgttctacttgaatcattcatttcaactcaaaaatttggggtgcagaaggctcttcagaagagctttagaaagtatatgactttcaaaaaggactacaatgaactgctcctttatattcttcgcgagcttgtaaagaatgctctgcattttgaagaaattgtcaccggatctgcttctggtctaactcacatagatgtcaaagtagatgatctctaccacaaggctcaagagcatgatatttatgatctgaaaccattcttcaatagcagccacttttcaagggccaattttgtattggatgaagaacggagagtgatcagacatcaccttaccagatga

SEQ ID NO: 27558 - DNA, 2232 bp, Glycine max
  Peptide Sequence Number=SeqID_119243
atggcgcctcgttcattcctactcgccctgctgagtctcctcttgactcagtccgagtcggcacctcaagccttcaagagagaacccggtcaccctcagtggcaccacggagccttccacgacgtaagagacagcgtccgatccgacgttcgccgcatgcttcattctcgcgctgaggtcccgtttcaagttccgcttgaagtgaacgtggttctgattggttttagtggagacggaggctacagatacaacatcgatgcgcatcgattggaacagtttctcaaaactagctttccagttcacagaccttcgtgtttggagactggggagctgcttgatattgagcatcacatggtctataatgcgtttcctgctggacagcccgaactgatagcacttgagaaagagctgaaaggggcaatggttcctgcaggaaaagcaagagaggtacctttgtttgaagttgaggcaacagctgtggagccaatatttcaaaggctgtactcctacatatttgacatggacagtgtgggatcttctgtcacggagatggatagaccagtgccaagtgcaatatttattgtaaactttgacaaggtgagagtagatcctagaaataaggaggtcaatcttgatagttcactgtacgagaaaattcccgacctaaccgaggaagatatgaaaagacaagaaggagattacatctatcgttatcgttacaatggtgggggtgcaactcaagtttggctaagctctggcagatttgtggtgattgacctttcagcagggccatgtacttatggtaagattgaagctgaagagggaagtgtctgttctagaaccctgccaagattacaaaatgtgattcgtcctagtagttcgagcacaacttctcatcaatcaagcaatgatatttttcttgggcagcttgcttctttggtatcaaccacagtggaacatgttattgcacctgatgtgaggtttgaaactgttgatcttacttcaagactgcttgtaccaataattgtgttgcaaaatcataatcgatacaacattatggaaaagggtcacaattacagtattaacatagaagaaatcgaggccgaggtgaaaagcatgcttcacgatgggcaagaattagtaattattgggggtgtacattcattacatcgccatgagaagctggcaattgctgtttcaaaagctatgcgtggacattccctgcaggaaaccaaaaatgatggccgtttccatgttcataccaagacatatctggatggtgctattttaaaagaagagatggaacgttctgctgatgtgcttgctgctggattgcttgaagtgtctgacccatctctttcaagtaaatatttcctccgccagaattggatggatgaacctgaagggtcaactgattctattcttaagcataagtctctctgggattcttataactcaaaatatagccagaaaaggagaaagaaagtaaagaaacaaggggatctacaaccaacatatggaactagagtaattcctgtctttgtgctatcactggctgatgttgatccaaaccttatgatggaggatgaaagtatggtatggacaagcaaagatgttgtaattgtgcttgagcatcaaaataaaaagattcctttaagttacgtttcggaaacacaaagaaggcatgctcttccatctcaggcacagcggcatatattggctggacttgcctcagttgttggtggtttaagtgcgccatatgagaaggcttctcatgtacatgagaggcccgttgtgaattggctttgggctgctggttgtcatccatttggaccattctctaatacatctcacatcagtcaaatgctcctagatgttgctttgaggaactcaatatatgcccgtgtggattctgtgcttcataaaattcgtgatacgtcagagactgtccaaacttttgtagcagagtatctgaaaactccccttggtgaaccagtaaagggaaagaaagaaaagtcaaacactgaactgtggttagagaagttctacaagaaaactactaatttgccagaacccttcccacatgaattagttgatcgcatagaaaaatatctggatggccttgaggagctgcttgttgatatgtcttcactgttatatgatcatcggttacaggatgcctacttgaacagttcagatattctgcagagcaccatgttcactgaacagtaa

SEQ ID NO: 27559 - DNA, 243 bp, Glycine max
  Peptide Sequence Number=SeqID_119244
gtgagaccagagagggcacagggcaaaataggaatttcacgtactatgcctagtgggcaaatttcccaacaaggcgctgttttacaaagttattcccagtttagggctgtttggaaagtatttcccagggggtgctgtttttgcacgtccccagcattggatgcgccatttctgatggcgacttcgtgcatggtggacacatgtcgaggggggaggaaagcgctattactgctggcgatttga

SEQ ID NO: 27560 - DNA, 384 bp, Glycine max
  Peptide Sequence Number=SeqID_119245
atggaaggtgcagacgaaggaatagagagggttgtggattcgaaggacttgcagcaacagagcaaagctttcgacaagctcacagaccgcgtcgaggatcgccaactcgattcttctcgcgtccaagaggttcctctctctattctctctcaaacgttgctacgatatttcacaacaacggccatggcatcaattgctgcatctgctgaagctgactggcaagccatgcgtatgagggagaaagagttagctgctgtcaagataaatgccgctgatgttgacataattgcgaatgaactagagctggataaaaaggttgctgaaaggaccttgcgtgagcataaaggtgatgcagtagctgcaatccggcacttgcttcgctag

SEQ ID NO: 27561 - DNA, 966 bp, Glycine max
  Peptide Sequence Number=SeqID_119246
atggaggaaaaggcaaaagctgagcagaagaagataggtatgaccgagacttggttgaagaagcaccgtcttctttacaatggagccactagacaccctcttattattagcattcgcgatggcaccatcaacactgcttccttcaaaacatggctcgcacaggattacttgttcgttcgggcgtttgtcccatttgtggctagtgtgctgataaaagcgtggaaggaatcagattgcagtggtgacatggaagtcatattggggggcatggcttctctggaggatgagatttcatggttcaagacagaagccaacaagtggggtatttcactttctgacgttgttcctcagcaggctaacaaaaactattgtgggttgctggaaagtttaatgagtccagacgcggaatatactgtggctattacagcattttgggctattgaaacggtgtatcaagagagctttgcccactgcattgaagaaggctccaaaaccccaccagaactgaaggagacttgtgtaagatggggcaatgaggcctttggtaagtattgccaatctctgcagaacattgccaatagatgcttgcaaaaggcttctgatgaagaactcaaaaaggctgaagttatgttgctaagtgtccttgagcatgaagttgaattctggaacatgagccgtggaaatcttgagcgtcaagatcctctttatcatgctcaaacatgcaatgagattgcagagctttggggtcttgttggtgtgctaaatagcatggatgagggtgaaactcacaacaatgcaacttcacccaataacccccataatcctactcctatgcctggaaggaatcactcaattggaaaatacaacaacagtggcactcagaagatcaaaggtctgagtaaccaaacgggcttcaccgaaggcaatgctaacggagccatcaactttggcagtttacatgcctaa

SEQ ID NO: 27562 - DNA, 738 bp, Glycine max
  Peptide Sequence Number=SeqID_119247
atgaccaaaaagaaacaagctacgaaaaggaagaatcttgagctaaatttagatgatgcttcgtccgagaatgactggattgtggaaaatgatgatggaacaatgaaggtttggatatggacaacttggatggggatgctccaaattgaagataaggacttggttctagaccaaggtgcaaaggacatcaatgatgctgctaaatggagaatttggatgatgaagatggacaaaatgaagattcatgtggttgtgccgaaaaacgtcagcggcagccaacgaaggatggtagtagttgtgatgggtgttcacccaaaagggccctacatggggtcactgtggcggagtgttgagttggctgcactcgtggacgttgtgacattcttgaaagggacattggtgaacctcatagcagatgtggaagtgggattccgaaggagggttgttagaggccatgaaacacagcgaaacagccaagcgaggggaatggcagcggaggggtcgccaaaggatgggtctaaccagaaacagcgccacgtgccaatttgtgaagagcaggtcgttggtgaaagggataggcggcgatggccaaacaatggacgcaagtattgtgggtactattcacccaaaaaaccaaagagacgcacatggagacgcgcagtggctgccagagcaatgactggcgtggaggttgccagtggtaggacgacaagcaaagatgttcaccgaggacagtag

SEQ ID NO: 27563 - DNA, 516 bp, Glycine max
  Peptide Sequence Number=SeqID_119248
atgaggttgtgtctgtgtttaacgttgttgctggttctggctagtgtggcaatgggagaagaagatgcagatcataataagcactccctaaaagccaagtcacacgcgcagatccagtgcacaatgtgttcctcttgtaacaacccttgcaaccaagttccatctccaccaccaccatctccttcctccaacaactgtcctccaccaccctctcctccttcctccggcggcggaggcgaaggagctccgtactattactccccgcctccaccctctcagtatacctactcctcaccacctcctcccgcatccaccggcggaggaatgtactactacactcctcccagcaacagaaactacccaagaccgccgccgcctaacccgattgtgccgtattttccgttctactactacagccctctgccgcccgggtccactgcagctcctccgccctccacggcctcctcgattctctgtgcacttgctttctcatcttttctattgttgttgctttga

SEQ ID NO: 27564 - DNA, 297 bp, Glycine max
  Peptide Sequence Number=SeqID_119249
atggcacatatgacttcaactaatcgccaagagcatagcaccacccatcaccatggattcatgtgcgtgtacagcaaacaatacactagtcagaaattgtacatggtattaccctgttactctctcaagatggaagggcatgagaaagacttggaattccttctagtttgtaataatgatccatgtcaccacgatgaagcttcctcccttgatttgacttgggcattaacttgtaagaaaataaatcgaactctcgcgttgtgggggcaacttcacagtaacctgaagcgcctataa

SEQ ID NO: 27565 - DNA, 1800 bp, Glycine max
  Peptide Sequence Number=SeqID_119250
atggcggcgaagaagcatgacgccggagacaccaaaaagagaaagcgactcaatactgaaactcacgaagctcccaaggcttcgaagctcgttgcctcaaagaagcacaaaccagactccgttgctaaagacaacaagaacaagaagacggctcctcttaccggccgagaacgtcgtcttcattccaaggaactagcagatgctagaaaaaagaagagaaagcgacatttcactcttgagcaagagcttgcacgtctatgggaaaagatgagacgtcatgagattgctaaagaggacagagctaagctagtgactgaagctttgcaaaagatgaaggggaagattccagagattgcgggctctcacatctcatctcggattcttcagacatgtgtcaagcattgttcacaagctgaaagagatgcagtatttgaagagcttcagccacattttctaactctagcatatagtgcatatgctgttcacttagtgaagaagatgctcgacaacgcttccaagaaacaactagcaggctttatctccactctccatggtcatgttgctcctcttcttcgccatatggttggatcagttgttgttgagcatgcttatgagttagcaaatgctgcacagaagcaagaactgctttcggaattatactctacggaacttcggttgtttaaggatctagtctcattgaaagagagcagattattagatgtgatgtccaagttgggtctacagaaaggttcagttctgcgacatatggcatcagtgattcagccaattttagagaaagggatagttgaccactctattttacacagagtcttacttgaatattttagcattgctgataaggaaaggaagaagattatcaaaggattgaaggggcacatagacaaaacagcttatcatcaatatgggtgcatggtgctggtttgcatcctttcagttgttgacgacaccaaactgataacaaaggttatcattcgtgagcttcagtcaattttaaaggagcttgttctagataagaatggaaggcgtcccttactccaattactacatcctaatagttcacgttatttcagtcctgatgatcttgcttctctgaatttatctataccttctctgtctctcaaggatcagtcagaagcaagctctctgacagaaacttcgaaggtttcacttggtgacaaggaatccaaggatgacatagagttggcattgaacgaagttaataaagataaaacttctgtggatgattctgacttagctgagagtgggaaaaaagacccatttgtcagaaggcaggagctgttgatcaagagtgggcttgcagatagtcttcttgatatatgtattgagagcgtgggagaactgattcagtcaaattttggcaaagaggtcttatatgaggttgcaacagggggttctgagggcataatgcacccagctttaggtgataagataaattccctccacaatgcagtagcttctcttgcagcaatgcctaaatcagaagattcacaagaggagcatgtccttgaaaatttccattcaagtcgcaccattagaaaactgattttggattgccccaactttgcttccaccttatgggaaaaagctttaaaagggaaaagtgagttatgggtgcatggccacagctgtaaggttatttctgcatttttggaatcaccagacccgactgtacaaaaacttgttaaaaaagagctacagcctttaattgacaatggaattctcaaaaacccaaagcctaaagaacaagcaaaccaataa

SEQ ID NO: 27566 - DNA, 294 bp, Glycine max
  Peptide Sequence Number=SeqID_119251
atgggcaccgtgtacaatctacgtgaacaacaaaagttagagttactttcaattttaaccaacaaattgccacaacaggcattcctgcaaggagttggatgtcggatgtatcacagaattctcagtggcggtgccataattcttggtggcagagccatatggggtggtggagaccaaggggcagtggaggtgggtttcgacgttaagggagagaatatgaacttgaggttgacatcgacagatccaacccaacaatctaaggttgatggcaactacagagaggttggaagatag

SEQ ID NO: 27567 - DNA, 1743 bp, Glycine max
  Peptide Sequence Number=SeqID_119252
atgactgccggggcagtggcgacggcagccggagcggcggtgatgctgtacctcgtattccggcggaggaggaaggccgaaaaggagtggtcgaggtcgcggacgacgtggaggttgaagccagctcaggcgccggcgaatatgttagaatcgattgcgacgttatcggagacgttgaggttcacttactcggagactattgggaaatggccaatcgccgacttggccttcggcatcaattacttgatgcgcaaacagggtgatttggcagttgcgagtgtgtatggtggaagcagttgtgtggagctgaaaggccctggagttgtagatgagttacaagagcttttgaggttgttgactttgtgcatgcttttctccaagaaaccgtttcccgagtttttagattctgccggattctctctagaccatgttcttcttcacaaccccgaagctgggcttctgaagcccgctttcacaattatacatgatacgcagtcaaaatgtttccttctattgatccggggaacccatagcataaaagacacactgacagctgcaactggtactgtggttccctttcaccattccattttaaatgatggaggaataagcaacttggttttaggatatgcacactgtggtatggttgctgcagctcgttggattgcaaaactctgcactcctacactacttaaagcccttaataaatgtccagactcagaagtcaagattgttggacactcacttggtggtgctgcttgtatgacatgggagttaggtgaatcagggaagcacttcatcactaccattataaatggttacgacttggtacccacattatcagcttcctctgttgatgatctccgatctgaggttgctgcgtcatcttggatgagtgatttatgggatcaggccgagcatacaaaggttctgaaagccgtccacaactcagcaactgcacttggatctcacttacaattcatatctagtgcaaaagacaaggtagctggtgtaggtgctattctacggcctgtgaccagtggcacccaggttgtgatgaagcatgcacaaagtgttgtcgaagctgttgtcaaaactatggcttcacaccgtcagaatattggaccattgccaaaatctaaattaaataacttggccgaatcttctctggaacccaaaaatataagtaaatctcttttgactgaaagtgtgcctgtgctgaataaggatgaaccaaactactcaagtggaagatctggacttgatgccatagatgaagaggagcaactgattgatgctaacgagcacattacctcttctgttgtaaatgacatcactgaaggtgaattgtggtatgagctggagaaggaacttgaaaaacagaacaatatcctgaacattcgggcgcaggtagaagaggcagctgcagcaaaagagataactgaggaagagaatcagcttattgatgctgcacaaggcaccagcaattcaatcacggcatctgacaaagtagatagctatcgtttttatcccccaggtaaaatcatgcacattgtctccactccttcgtcagatgactttagttcaagctccattgaggaacatgtcaaattatatgaaacacctagacagctttatagcaagctcagactttcaagaacgatgataaatgatcattacatgcccacatataggaagatgatccaactattaatcagacaactagagaaagatataatgtga

SEQ ID NO: 27568 - DNA, 1524 bp, Glycine max
  Peptide Sequence Number=SeqID_119253
atgcttgcagaacagaaattccaaaagacatacccgacagtcaccgaggtattggaagaagtaaggagaatgacagacatagggttcccaatagcagccatgagtcttgtgggttacctcaaaaacatgaccttagttgtgtgcatgggaagattgggaagcctggaattagccggaggttctttggccataggcttgaccaacataaccggttactctgtcctctcaggtctagccatgggcatggaacccctctgcacccaagccttcggttctcgaaacttgtccttactctctctaactttgcagagaacaattctcatgttactgctattttctctccccatttctcttctttggctcaacctcgaatctctcatgctatgccttcgccagaatccagacataacccgagtagcaaccctctattgccgcttcgcaattccagacctcattgccaatagcttcctccaccctcttcgaatcttcctacgtagtaaaggcacaacttggccactgttgtggtgcactttactatccattcttctacaccttccaaccctcacttttctaaccttcaaacttaaccttggcgtgccgggaatcgctatctcatcctttgttgccaattttagcaaccttttcttccttcttttgtacatgttctatacacgtgtccccaaggagtccttacacgtgtctttactaatgtcacataataatttaataataacatgtagcagcagtactagtactattgccaaggaatggggtatgctaatgaaattttcgatacaaagttgtctagctgtttgcttggaatggtggtggtacgagttgatgacaatttcagcaggttaccttgataaccctcgtgttgctctagccactgctggcatagtgatacaaaccacgtctcttatgtacactttgccaacggcactaagtgcatcagtgtcaaccagagtaggaaatgaacttggagcggggcagggtgaaagggcaaatttgtcaacggtggtggcaataggattagcacttgtaagctcaatatttggtttgttgtggaccacaatgggaagagaaaggtgggggagagtgttcactagtgatagcgaggtgttacaattgaccgtggcagtgttacctataattggactgtgtgagttagccaattgtccgcaaaccacaagctgtggaatccttagaggaagtgctaggcctggtattggggctgttattaacttttgctcattttacttggtaggagcaccagtggcaattgttttagccttctattggaaactcgggatggttggtctgtgttatgggttgctggcagcacaaatcgcatgtgtggtgtcaatttttggtgtggtatataagactgattgggaaagagagtcattgaaggctagatgcttggtgggaaaggcttcatgtggcacatttgcatatgatgaggaccaaactgatgcactcaaatgtgaagaaggtgttgtctttctcaactcccaaaagtga

SEQ ID NO: 27569 - DNA, 177 bp, Glycine max
  Peptide Sequence Number=SeqID_119254
atgaaaacacaccgtggtcgcaactctacaattttcaaaattattgttttagtgtttgttactcttatcgctactgatttacgacaacaactaaagtggaaggggtggaactacaatttaaatccttcattgaaagacattcacacaatcacaatcattcaatcgtcgctcaagtga

SEQ ID NO: 27570 - DNA, 2397 bp, Glycine max
  Peptide Sequence Number=SeqID_119255
atgggtggccagatgcagcagagcaatgcctccgccactgctctgtatgaccacgccggccccggatccctgcacaatgcggcaggaccggccaccgatgccggcgacgccgtcatggcgcgatggttacaatccgccggcttgcagcacctggcctctccattggcttccactgccatcgatcaacgcctccttcccaaccttcttatgcagggttatggagcacagtctgcagaggaaaagcagaggctttctaagttaatgagaaacctcaattttaatggggaatctggttctgagccatatacgcccacttcccaaaatttaggtgttgtatcagatgggttttattctccagacttcaggggagattttggggctgggcttttggatcttcatgccatggatgatacagagcttttgtctgagcatgttatttcagaaccatttgaaccatcaccctttatgcctggaggcactagaggttttgtagatgacttcaattcaattagcagaaagcaggagagaggagaagcagattctgatgcatcacttttcttacctacaaatgaaaaagagaataatacaagagaaaataatgttgctaagattaaagttgtggtacgcaaaagaccattaaataagaaggaacttgctaagaaggaggatgatattgtaactgtatatgacaatgcatatttgacagtccatgaacccaaactaaaggttgatttgacagcttatgtggagaagcatgagttttgttttgatgctgttcttgacgagaatgttaccaatgatgaagtatatcgagttaccgtagaaccaattattcccacaatttttgagaaaaccaaagctacttgttttgcttatggtcagacaggaagtggcaaaacatacacaatgcaaccgttgccgctcagagctgcagaagaccttgttagacaattgcatcgaccaattgctgagtggctgtgtttgtacactgtgaataggaaactctgcatgagagaagatggacggcagcaagtgtgtattgtaggactgcaagaatttgaagtttctgatgtacaaattgtcaaagaattcattgaaaaggggaatgcagcaagaagtacagggtcaaccggtgcaaatgaggagtcctccagatcacatgctatcttacaactggttgtaaagaggcacaatgaggtaaaagagagcaggcggaacaataatgatgtaaatgaggcaaaaagtgggaaggttgtggggaagatttcttttattgatcttgctggaagtgaaagaggtgctgatactactgacaatgatcgtcagacaaggattgaaggtgctgaaatcaacaagagccttttggctttgaaggagtgcattcgtgctttggacaatgaccagatccatattccttttcgtggaagcaagcttacagaagtgctccgggactcctttgttggaaattcaaaaactgttatgatctcttgtatatccccaaatgctgggtcatgtgaacacacacttaataccttgagatatgcagaccgagttaaaagtctatccaagagtggaaatcctagaaaggaccaggccccaaatcctataccaccaccagcaattaaagaggtttcatccacatcttcacttccaggtagtgttggtgcagaggattttaataatggtcaacgtcaagaggtaaaaacaatggacatgagcaggaaagttgtcgaaaaggaaagttctttgtacagctccgctgctgatgttgacaaacaatcaagtttttcttctagttgtcaattcaatgggcgagaggaaaaaagctcagcttctgccccaatggacagggaaaagtttgaagtaaagaattcttacggtggtgattctaccagtcagaagatgaactcttattccctaaatgttacagatgagaaagtgcaaagggtgtctcctccacgcagaaaagggactaaggaggagaaatctgaaagatctgtaaattgggtaaaacgggatgtcgatggttatgatcattccaccacaagctccaaacagcagagcacaggaaattataacattaccactggatcggggcagtctgaaacagaatcctcttctaatgtgaatatcagcgcaatacttgaggaggaagaagcactaattgctgctcataggaaggaaattgaagacacaatggagattgttcgtgaagaaatgaaactactggcagaagtggaccagccgggaagtcttattgacaactacgtgacccagttgagtttcgtgctttctcgcaaagcagctagtctcgtcagtctccaagcacgccttgcaagattccaacatcgactaaaagaacaagagatactaagtagaaaaagagtgccccgttaa

SEQ ID NO: 27571 - DNA, 1482 bp, Glycine max
  Peptide Sequence Number=SeqID_119256
atggcgagtgcgcattacactctttcctctgttctcgcgcctcaagctaccggacgaaccactcttcgtattccaatttcttcaaaacgccacaggaaaaaccatttgcgacccaaaattctgaaaatccttactaaaccttacccactcacccttcctcttctaccatcaccaccgccgccgccacaccctatcgtcttgcctcaagaaaacaacaacctctgtgtcgagcttcccgccgaagagacgctcgccggagaaccagataaattggaagagttacaagtctcggagggcaccacgaaggacaatggtgttttccagaacgtttctgccgtggatatattgaaatacggcggtatgtattttcttgggttttttgtgttgcagacgatttacaccgtttggattgtggggattttcaaattcaaccagaaggatagggatttggagatagatagggatgagaaaactgtgtcatggcctgttcatggtgctagcaatgtttttctttctgaggaacaagttttaatggataagaaaatcgaggaaattaagttaatggccagagaagcgcggcgaattgaatcggagaagaaaggtaaagaggatgaggatgaggattttgaagtggatgatgatgatgacgacgaaggtgctgtttctagtaatagacttggtattgagaaagagattggtgagcgattgttaaaggtgcagaataggattaatggtagtgctaaggatatttcagcagcgttacagattaattctcgtgggaattctgcagctggagtggataggggtgtcaataagaatgtgaagaataagggaaatgaggcattggtgttcaagaagaagtttaaattcaaaagcccttctactaaggatacaaagactcccaagggctttccagggaaccgagattggaaagaatctaaggcaacgaagaggggttcagaaagtaagaaagcagctcaagatcatggaagtgatgatgtttctgatcatgcacaaatgttacatgaagataaacgagccaatcagccggagcttgtgacgcagaagagtgtttctagtgttccttcggaagaaggaggaaaagttgttgatgacaagtccaaggtcattctcatgcaaagagattccgaggaaggattagaaggtctatattatggcctaaagttcacctctaaggaacaggaacaaagtgatgatgattcctatacagttgcttttgaggatcatgctgatgccaacaacttctgttttctattaaaatccttttttgaagatttggggtcttttagtgcttatgcagttccaatgccaatacaagaactgaatgaagaaataatatcacgtgccaagaaagtggtagttgtgaaaaagaggcagcttcaactctatgctgggcaaccacttgctgatgttgaaatgcacttgcgctctataatagagcaagatcaaattgcaccataa

SEQ ID NO: 27572 - DNA, 1170 bp, Glycine max
  Peptide Sequence Number=SeqID_119257
atgggtgatttaagagttaagaaaaagaaaggaagcaacaagaagaagcatgggtctgtgtctgtcaccgccatcaaatttcttcctaaggagttgcaagtggagatttttgccaaggtggccactcgctccgtatttgaccactgcatgattaaactatgttgcaaagaatttcttcgcgcagcggaggataattacgtgtaccgtcacgcctccatggagaattttgcgttggtgccgctaccatggttcaaaggcaataataaagaattcccgtttctgaaacgttgcagggagagcggtaactcggagattttgtaccgtgaaggaatggttcaatatttcacttcttcaatgatggaattgggtctcaagaatttgaaagaggcggcgctggagggtcaccatgatgccaaatatgtttattgcatgcttttgatgtgcggtgaagatgaattaggagaaagaaagcaagtggctggtttaggagtcaagaaaagaagaaatgaaaagcagcataaacacgatgggtctttcaccaccgtaaaagctcttccaaaggatatgctggtagagatttttgccaaggtggccactcgctccatcttcgacctctgcatggttaaacaatgctgcagagaatttcttcacgctgcggaggacgattacgtgtaccgtcatgcctccatggagaattatgcgttggtgccactgcaatggttgaaagaatcatcatttcttaaacgttgcaaggagagtggtaactcggaatttgcgtatcgtgaaggaatggttcaatactttacttattcaagggtagaattgggtctcaagaatttgaaagaggcagcgctggagggtgatcacgatgaagccaaatatgtttattgcatgcttttgatgtgtggtgaagatgaattaggacaaagaaagcaaggttctgatctcttatgttccttgaaagcgtcgtccacgtctcttgtgagatgcagaaagagggtaaaatcttttgttggaaccatgtggctgaataataagcctgtggttccaaatcgcaagtcatgtttctgcggttctgacacgtccgatagtgagagattgaagaagctttcaagaagcttaagatggtcgtcttttgatgccaacgttgcgctgctgatcatgaacttg

SEQ ID NO: 27573 - DNA, 234 bp, Glycine max
  Peptide Sequence Number=SeqID_119258
atgtatttctattcacactgcttcattataaagtatgaaactagtggtggtaagcagttttataatgtcagatatcaaccaacgcccaagctgctgtccttgcttgttgaaactggagataatcctcgcatcaactctcatgttgctgacatttcagacatcaaacaaattaaggtttatcaaattcgctcaaagaaggggctgacaaaagtcttttacaatgttgaatcctag

SEQ ID NO: 27574 - DNA, 237 bp, Glycine max
  Peptide Sequence Number=SeqID_119259
atgcagttgaacaagcataattttattcttcacaacgaggaagttgtcctaccatgtcccaaaaaaacagcaatcaaacgcggcactaatcacgctcggtcaatggatttcacaagtgtcctcgttattggagcaaatgcaccacaccacagtcctaacgaaatgccctttggagatggcattgacacggtatcttcttatctcccatctctttgcacgcatgacatgagacattaa

SEQ ID NO: 27575 - DNA, 2828 bp, Glycine max
  Peptide Sequence Number=SeqID_119260
atggaaataaaaattgggcgaggcaaggaaaggcaaatgcaagccaatattgagttcgaggaaggagaggctttcttctgttataaggatgatgatgacgacgacaacactgaccttgattctctctcttacattaaattcagcactataatcgtaaagattttgaaaaataatgtattggcaactgacaaacaaaggactaataatttgcttcctgttctattcaaggatgagaggattcagcatgctctgggtcattttcgaaaggaatttgaaggaggtgtttctgctggccgtttgggtgcaaaatttggtgactatggctcctttttacctacctgtgaacactctcctcctttgcgatcttgttcaaagactccacaaaagcacaatagttcaccaaaatctcctagcaatctccacatggcggctgcatttcgtaactcaaaagcacttccaaatatgcctttttctatgagggttggaactgcttcctatgaagctccaccatttcgtaatataagagtaccttcagcagattactcagtaaagaacacagatatttcctccaatgaagtaatagagaagttcactttgaaagactgtgcaaataagtcagaaattttgactgaccaaagaacactgaagttgcgaatcaaagtgaaatcagatatcttggcaaaaaagaatgcagcaatttatagtggtcttggactcgatgactctccatctccatcaatggagaacagccatgaggaaagtgaagatatgccacatgtatctcaagaaacccctgaagaatctccaaccagcattgttcaggttatgacttctttcactatccctggaggtgtgctaatatcacctctacatgacagtctcctgtacttgataagaaaggaaaaagctcttggaaacatcaaacccatgtcttctcttaatggaaatagaactccggatcgtaaggactttctatctaatgacctgagatgcactccactgtcaagctcaatttgtgatgctggtgaaacagctgaagtcactgttaagggttttgaagtatccaaggaggttgatggtgtgaaatgtagaatggtttccactgaagcagtgaaggaggattcactagagtcaatatctggtcaggattttgacaagattgagaagcaaaatacagggagtggctttatgaaaaatgttttagagcataaaatgataatttctcagaataataattctactaatcctaagactaatagcaagtgtaacacatttgcaatttcaaaaaggatcaagtgtgatgcattgaaatgtaaggtggatcaagatactcaaaagtgtgaaactaatcaggaaggaaaggtgaaatctgaaagcaagaatgagtcaaaaggtgaaaggagtcctggaaatgttatgactcttgctgaaaaagatagcattggtactagtaataatgcaatggtaaatgatagaaagagaacaagcattgatgttacttctttgaaaagtaaaatgcataaaataaagtcactgaaggttaataaggtcagagattgtgacagagattcattgaaaggaaaaaaatcacaacagaaagttgatagaataaatccaactgatgggcctactcttaataaggccacagtaaattctagccttgatcacgttgataagagtgcatatagggttaaaggaaatgaaagaccaagtggcaataaagttgttaaccagttgtcagctgggccatgtgtaaaagatgcaccaggtgcatttcctattgctgaaaataaaccaacttctgaaatggttctgtcatcagaagcagcaacacctcaagttatcgaagaagattgggtatgctgtgacagttgccagaaatggcggcttctacctatgggtttaaagcctgagcagcttccagagaaatggttgtgtagcatgctatattggctgcctggaatgaatcggtgtaacatcagcgaggaggagacaacaaaagcactttatgctttgtatcaaatgccaatttctgagggtcaaaataacatgcaaagccatgccgctggacctgaaactggagtgggatctgttgatgctctgcaacttggcctgaatcgcaaaaagtccagttctgatgtaatgcttgatcgaggaaagaagaaacatggtattaatgaaaagacaaggtcaggagtcaataatgacatgcatcggttgtcaaataatgctcaagagtctgttaaaaatagaagcttgaatgagatgaataagcagtctacagactcaaaccgtataaagaaatctatttctaaacattcaagcaggttgaacaatttgatagaagaaaaaaacacacctaaggtgaaagaaaagcaaatgaatggaggtgacagaaatcatgttagattgaaacgtaagatggaggataatcaacatggatctggaactcctaagaaatctaaggctgaagatgtttgctatgctgataaaccactgaatcctggcatggaatttaaaaaggtgggtctaatctcaagaaatagtttaccaacaaaggctagtgggagaaatatgaggaaatatgatgattattgttggtctgatgatctagtggacaagttggtagttccagtgaagaaaggagaccgggcacagttttcatcagatgatggttcattggatgctacaaacaccagaaaaagtggttcaattaagaaaaggaaaatggccgattggctggataatgagaaacataacaaaacattgtccttggaaggcaatatgcaatgtggtaaagaagggaatgcaaataagaaggagaagaa

SEQ ID NO: 27576 - DNA, 2559 bp, Glycine max
  Peptide Sequence Number=SeqID_119261
atggctccttctaggaaatctagaagtgtaaataagaggttttctactgttcgtgaggctgcatctagtaaagacaaaattacagagaatgctagcaaaaataggctgaaggtgagtcctggtattcagaagaagagaaaattggctgacatgttagggccacaatggaataaggaggagcttgagcatttctatgaagcttaccgtaaatatgggaaagattggaagaaggttgctcttgcagtgcataatagatctgtggaaatggtagaggccctgtacactatgaatagggcatatttatctcttccagagggtactgcttctgttgttggactgatagcaatgatgacagatcattatagtgttctgggaggaagtgacagtggtaaagaaagcaatgacgatgcagaaatatctaaaaagtctcaaaagcgtttgcgaggaaagcatctaagtgacagtaaagcattagaaggccacttttcagatcattctcagtcacattctgttgcatcaggtgatggttgcctgtcattgttgaagaagagacattctggaattaggcctcatgctgttcgaaaaaggactccccgtgtccctatttcatattctattggtaaagataatggggataggtttttttcatctgccaggcagggctccaaacaaatggttgatactaatgatgttgctcataagattgcattagcattgacagaggcttcacaaagaggtggctcttcgaaaatttctggatcaccagacaaaaaatttgtgccttcactgggtctgaaaagtgggaagaagcatcctaaatcagaaatagctggagcaaacttttgcagttctgatttggatgatggtagttctgagttgagtttaggaagcacagaaggaaataatgaagattattctagaaaaacaattcatcggagtggtagagaaaatactggaagagaaaggaatcaagaaaagaaaattaaaaaatatgggaagaattttgagacgggagagaatttaaacaagcatttgaatgacgtaaaggaagcctccagtggaacagatgacggtaaaaatcttagttttatcaaatcggattttgtcacagattttgcagatgcgaaaaatgcaaggtcctcttacaagggttccaggacgaaaagtaaaaagctacggttagagaaagatgaaggttctgcttttgatgctctgaaaactttggctgatttatctttgatgctgccagtaacgaaccctgataccgagtcatctgcacagttcaaggaaggaaaccatgatgctgttgatgaatctaaaatggaaacacataaagtatttcctaggattgaaagcactgcttcaagtaaattgggcaaggttttttctgataatggagttgctgttcctgaagcagaaggagcacaccagcttaatgcaggattcaggaaaaggaaacaaaaatcttttaacttgaaatacgatgaaattcatactggttctcatttaagtggttcccagaaatccaaggctactgacgaggtgaagaaatccattgttaaaggtaagcggtcatctgtttctacagcacattcaagacaactaaaaggggtgaaatcgttaggaaatctgtcttcaagcgctaatgacaaaggggaaaaggatgattcatctttttcgctgatgaaggtttcctcaactaatcaaggtggtccattaaacagaggaaagccaagaagaaagatggaaaaaccaaaaccaatggtacaacaagatttggtggtgtccagaaatatttttagcagtcaacataagaaatccattgcctcactccaagatggctcttatagtcaaaagggaaagcttatcaattgcctgtcttcatatcaaatgcggcgatggtgcactttggagtggttttatagtgctatcgattacccatggttttcaaagagagaatttgtggagtacttagaccatgttggattgggtcatgttcctagattgactcgtattgagtggggtgtcattagaagttctcttggcagaccacgaagattttcagagcaatttttgatagaagaaaaaaataaacttaatcaataccgggaatctgttagatcacattatgctgaaattctttctggtaccaaggaaggacttcctactgatttggcccagccgttaattgttgggcagcgtgttattgctattcatccaaagacgagagagattcacgatggaagtgtattaactgttgaccactgtaggtatagggttcagtttgaccagcctgaacttggggttgaatttgtcatggatattgactgcatgcctctgtatccatttgaaaatatgcctacgtctctgatacaacacaatatctcttctgctcaaataaaccaggactttattgagctcaagcctaatggaaaactgaaacagagaaaggttgctgggcacacaatattgtcccctagtgagaacttggataccataaaaaatcttcatataccccccactatgcacggaagcagtactttatcaaaacaggtgtaa

SEQ ID NO: 27577 - DNA, 1170 bp, Glycine max
  Peptide Sequence Number=SeqID_119262
atgcaagttttctctaacgctcgccgagcctcttggcttctcctctttcctcatctccgaacctcggaagctcctcactccaccgcgctctctctcttctcagggctcgcgcaacgtgattcccggcaagtgaacaccgatccggtacactgtttgtcgaaggcttttttctcttccggaatggataccgttgaagcaactccatcagaggatgtgaaggaattatacgataaaatgcttgactctgtaaaagttaaacgatcaatgcctccaaatgcttggttatggtcaatgattgcaaattgcaaacagcagcacgatattagacttctgttcgacattttgcagaacctccgcagatttaggttgtcgaatcttcgaattcatgacaattttaattgcaatctttgccgagaagttgctaaggcatgtgttcatgcaggagctcttgattttggaatgaaggctttgtggaagcataatgtctatggactgactccaaatattgcatctgttcaccatttactgacgtatgctaagaaccacaatgatactaaactgttggtggaagtaatgaagcttctgaagaagaatgatttaccactgcaaccaggcacagcagatataatttttagcatttgttataatacagatgattgggagttgattaataagtatgcaaaaaggtttgtcatggctggcgtaaaactacgacaaacctcatttgaaacatggatggaatttgctgccaaaagaggacacactgagtcattatggaaaatagaaaagttgagatctgaatcaatgaagcagcacactttgataactgggttttcttgtgtcaagggtctactgttggaacgtaaacccagtgatgcagttgctgtcattcaagttctaaatcagaccttgtctgatacaaagaaatcaggcatcaagggtgaacttcagaagcttgtatccgagtggcctttggaagttattaagcaccaaaaagaagaggacagaaaggcattatcagcctctttgaaatctgatatccttgtcatgtttggaagacctggacagaaaggaatgtattccacgatagcatggagttcagaatttgatgacattgtgtttcagaatgtgcttgtttgcagagtatctccttaccaggatgcttcctag

SEQ ID NO: 27578 - DNA, 3213 bp, Glycine max
  Peptide Sequence Number=SeqID_119263
atggggaggccctccaagacgcaggtttcgaacgaattttcctccgaagaggaaaaggaggaggcctccgccgccgccgccaaccacgagatcgaagatgacgacgaggagctcgaagcggtggctcgctacgttagctccgatgacgacgataattcgccggatgaagccgctgaagacgacgacgaggataaacaggatgagagtaatgttgatccggaagttagcaagcgtgagaaggccagattgagagaaatgcaacaactgaagaaacagaaagttcaggagatattggatgcacaaaatgcgaccattgatgctgatatgaataatagaggaaagggcagattgaactatctcctacagcaaactgagctgtttgctcattttgccaagggtgaccaatcttctcaaaagaaggcaaagggaagaggtcgccatgcatcaaaagtaactgaagaagaggaagatgaagaataccttaaaggggaagaagatggcttagcaaatacacggttggtgactcaaccatcatgcatccaagggaagatgagggattaccaacttgctgggctaaactggctcatacgattgtatgagaatggcataaatggtattctggcagatgaaatggtaggtagcagatgctggcctcagataaatcacattcaagtagctgcatatgaatacaagtacctgttgacatgtaatttgatggaatatgagttgattgttaaaagccatggccctcatatggtggttgctccaaaatctactcttggaaattggatgaatgaaattcggcgcttttgccctgttttacgtgctgtaaagttccttggcaatcctgacgaaaggaagcacataagagaggagttactcgttgctgaactcactcttgtccaaaacaatgaggctatacaatacaaactatcgactcctcataactggcacaccattacagacttagaagtagattacataagagtaggaatgagtgcatcagaggaaaaagctggagcagcacctattgtagaaaagatggttgaaacttgccttgggtggtttaaccataacaatcttcacgaactctgggctcttctcaactttcttttgcctgaaatatttagttctgctgaaacttttgatgaatggtttcaaatctctggtgaaaatgacgaacatgaggttgttcaacaactacacaaggtcctccgtccattcctccttcgaaggttgaagtcagatgttgagaaaggtttgccaccgaaaaaggaaaccattctcaaagtaggcatgtcgcaaatgcagaaacagtattataaggcattactgcagaaggatctggaggttgtgaatgcaggtggagaacggaaacgtctcctaaatatagcaatgcaactacgtaaatgctgcaatcacccatatctcttccagggtgctgaacctggccctccctttacaacaggagaccatctcattacaaatgctggtaaaatggtcctactggataagttacttcctaaactaaaagaacgtgattctagggtccttatattttcacagatgactaggctgctagacatacttgaagattatctcatgttttgtggataccaatattgtcgcattgatggcaatactggtggagatgatcgagatgcttccattgaggctttcaacaaaccaggaagtgaaaaatttgtcttcttgctatctactcgcgctggaggccttggcattaatcttgctacagctgatgttgttattctttatgacagtgactggcaagatcgtgctcataggattggtcaaaagaaagaagttcaagttttccgattttgcactgagtatacgattgaggaaaaagtcattgaaagggcttacaaaaagcttgctcttgatgctctggtgattcagcaagggcgattagctgaacagaagactgttaataaagatgagttgcttcaaatggttagatttggtgctgaaatggtttttagttccaaggacagtacaattacagatgaggatattgacagaattattgctaaaggagaggaagcaacagctgagcttgatgctaagatgaaaaaatttactgaagatgctatcaaatttaagatggatgacactgctgagttgtatgattttgacgatgagaatgaagagaacaaatttgatttcaaaaaaattgtgagtgaaaattgggtcgagccaccaagaagagaacggaagcgcaattactcagagtctgaatacttcaagcaaacaatgcgccaaggtggtcttactaaaccaaaagagcctcgtattcctaggatgcctcaattgcatgacttccagtttttcaacacacacaggctgagtgagctgtatgaaaaggaagttcgatacctcatgcaaacacatcagaagaatcaggtgaaagattccatagatgttgatgaaccagaagttccattgactgccgaagagttagaagaaaaggagcagttgctagaggagggattttcatcatggagccggaaggattttaatgctttcattagggcctgtgaaaagtatggccgaaatgatataaaaggtattgcttctgagatggaaggaaaaacacaagaggaagttgaaagatatgcaaaagtcttcaaagaaagatacaaggaattaaatgattatgatagaattattaaaaacattgaaagaggggaggcaagaatatcccggaaagatgagatcatgaaagctattgggaagaagttggaccgctacaggaatccttggcttgaattgaagatacaatatggacaaaacaaaggaaagttatacaatgaagaatgtgaccgattcatgatatgtatgattcacaaacttggctatggtaattgggatgagttgaaggcagcttttcgaatgtcgcccttgtttcgatttgattggtttgtcaagtctcgcacaacacaggaaattacaaggaggtgtgacaccctcgttcggctggtagagaaggaaaatcaagaatatgatgagagggagaggcaagctcgtaaagagaagaaaattgctgctaagagcatgaccccatcgaagcgttccatgcctagacagagtgagagtccatctctgaagaagcggaagcagttaaccatggatgactatttgagctcgaagtcacattgcgattttcctgaagctgactttatggtattgtga

SEQ ID NO: 27579 - DNA, 1200 bp, Glycine max
  Peptide Sequence Number=SeqID_119264
atggagggggttgagagcaaagaaagagaagtgatggtggcaaaaccagttgcagtgggtgtcagtgatttgcttctgaggctgttggccttcacagtcactcttgtcgctgctatagtcattgcggtcgataagcagaccaaggttgttcccattcagctttcagattccttaccacctttggatgttcctctcactgctaagtggcatcaaatgtctgccattgtgtactttctggtgaccaatgcaatagcatgcacgtatgcagtcctgtctctactccttgccctcgtgaatagaggtaaaagcaaaggcttgtggacattgatcgctgtcctcgacgcattcatggtggctttgctcttttccggcaacggagccgccgcggcagttggtgtccttggctacaaaggaaactctcatgtgaattggaacaaggtgtgcaatgtctttgggaaattttgtgatcaaatggctgcttcaattggtgtgtcactgattggatcattagcattcctcttgctcgtgattattcctggggaatacaaagacacaagacgatcgagtgaggaaagtatattgaccaagatgcaaggccacgctgaaactaataactctatcatggcaccgctctctcaaatcccaccttcttcttctcttcacccttcaaacattgctgaaacgggtaacatctacaccaccacctccagaaagcgtgttaagaaaatggaccacaccaattgcgagagcctcaacgtggaacgtgaaagaaggtcgaagatgactcaaatgttcactcagcttcaaaccactgtccctggtgtcttacctcaggctacaagggaagtgattataaacgagacaattaagtacattaaggagcttgagatgaagatgcaaaagctggaggagttgaaggagtcaatgaaagaagggtccatattgcttgcatgtggtaacaacaacatgaattgctccgtcacggtttctgtctctgctaatgttgcattctttggtattcaatccctgcctcgatccggtttggtctcggtgatcatgaaggtgttctgcaagcaccgagctgagattttggctgcaaatgtctcagttaataatgggaaattgatattggcaatcacggcgatggtgcaaaatggtggtgtcgttgaaaatattagaagacaaattttgagtttgtag

SEQ ID NO: 27580 - DNA, 1227 bp, Glycine max
  Peptide Sequence Number=SeqID_119265
atggctcacagtataaaggagagcattgcagagcagccatctagtttgcaaggcgggaaattgagggaatatcaaatgaatggcctgaggtggctggtttccctatacaacaatcatttgaatggaattcttgctgatgaaatgggactgggtaaaacagtacaggcaaaaaatgatagaggaccgtttctcgtggttgtgccctcttcagttctacctggttgggactcggaaataaacttttgggctcctggtgttcataaaattgtctatgctggtccaccagaggaaaggcgtcggttattcaaggaaaggattgttcaacagaaattcaatgttcttttgactacgtatgaatatttgatgaataagcatgatagaccaaagctgagcaaaatacattggcattatataataattgatgaaggccaccgcataaagaatgcttcttgcaagttgaatgctgacttgaaacactatcagagctctcacagattgctgttaactggaacacctttacagaacaatcttgaagaactatgggcactacttaatttcttgttaccaaacatattcaattcatcagaggacttctctcaatggtttaataagccatttgagagtgctggagatagctcgcctgatgaagctttattgtccgaggaggagaatctcttgattataaatcgtctgcaccaagttttgagaccatttgtacttaggaggctgaaacacaaggttgaaaatgagttgcctgagaagattgagagactaataagatgtgaggcctcatcatatcaaaaacttttgatgaagagggtggaagaaaatcttggttctattggcaattcaaaggctcgatcagtacacaactctgtcatggagcttcgtaatatatgcaatcatccatatctcagtcagcttcatgcagaggaggtggataacttcatacctaaacattatctgccaccaattattagactttgtgggaagcttgagatgttggaccgtttattgccaaaattgaaggcgacagatcatcgggttcttttcttttcgacaatgactaggcttttggatgttatggaggaatacttaactttgaaacagtatcggtacctccggttggatgggcatacatcaggaggtgatcgtggtgctctgattgatctatttaaccaacctggttccccatattttattttcttgctcaggaaatttggctga

SEQ ID NO: 27581 - DNA, 1785 bp, Glycine max
  Peptide Sequence Number=SeqID_119266
atgaggtgttgggtagcagtagcagttgcagtaacagcgttgattattacaggaggaggtagaggttgtgcgcctcatcggattcttgtggatacagatgttgacactgacgatttctttgctcttctctacctcttgaagctcaacacttcacaatttcaattggagttaattttatacaacgtaagcaacatattttggatgagttttaacgaaaaattaaaagaaaaatataagcggaaagcgaaaaagggcatcagcatcagtgcaaatgcttggacgagtgctggtcatgctgttaatcaaatatatgatctactttacatgatgggtcgagatgacgttgccgttggagttggaggcgagggtggaatactacaaaatggtactatactccctaacgtcggtggatatcttccaataatagaacagggaatgacaacagtaggtggttgcagatacaggcgggccattcctgttggtcttggagggcgcttagacatcgatgccaattatggcatcaggaaagctttcctaccacagggaactaggaaatacactccactacagcagccaactgcacaggaagtgttgattgaaaaaatatctgcaggtccaataactctgcttgtgattggagcgcatacaaacattgcaattttcctaatgaataatccacacctaaagaaaaatgtggaacatatttatataatgggcggcggtgtaagatcaagcaacccaacaggttgttgccccaaaaatgcttcatctacctgcgtgccaaggcagtgtggtgaccgtggcaatatgttcacagattataatactaacccttatgcagaatttaatatatttggagacccttttgcagcataccagacttggatgatactacctcaagtgatccattctggaattcctatcacccttgttcctcttgatgcaacaaacacaatccccatcaacgaacaattctttgatgcatttgaaaagagtcaagacacatatgaggcacagtacattttcaaatccttgaaaatggcccgtgatacttggtttgacaacgaattctattcgagttattttatgtgggactctttcgcagctggtatagccgtctcaatcatgagtaagcccaacaaccaaaaaggtgaaaatgaatttgcagaaatggaatatatgaacataactgtaatcacttcaaacaaaccatatggggtatctgatggctccaaccctttctttgatggccgaagagttcctaaattcaatctagaaaaaggtggggtgcatagtggccatgttcaacaaggacttagagatccactttgctttgtgaataatgggaaagggaaatgtcaggatggttacacagcagaggtgagtggtccagactcagtgagggtacttgttgccacaaaagcaaagcctaacaaggatgttgggagctcacttgacagagaatatttcataagcttcttgaatgttctgaagcatccacaaaatactgggaggttcaacttcaccacacagtttccttactacaaagaagtaacttacaagccagattttgaaaataaaacaccggggaaacctgttgtgtttgatatggacatgagtgcaggcgattttctggctctattttacctcctaaaagtgcctgttcaagtaatcgaccttaaggcaatcattgtgagccctactggatggactaattcagcaacaatagatgtcatctatgacttactacacatgatgggtcgtgacgatatcccagttgtctag

SEQ ID NO: 27582 - DNA, 3012 bp, Glycine max
  Peptide Sequence Number=SeqID_119267
atgaatatgagtacgatgatttacgatggtgtctgtctctctctctcactttcagaaccgagaagtcatagccgggtgaatctgaaatcgacttctgtataccgattgggggactggtgggatgttggattaaatgtagcttcacttggccatagcatccactataatattttcccatctggatctttgatggactgcaataaagaagaggccttaagggccaaggacattgctgaaaagaagatggaaaacagggattttgttggggctcgcaaaattgctctaaaggctcagcagctgtaccctgatctggaaaatatagctcaaatgcttgttgtttgtgatgtgcactgctctgctgagcagaaattgtatggtaatgagatggattggtatgaaattcttcaggtcgaacagacagctggtgatgcaataattaagaagcaatataggaagtttgctctccaacttcatcctgacaaaaacaactttgctggtgcagaagctgcatttaagttgattggggaagctcaaagagtgcttttggacagagaaaaacgttctctctttgacatgaagcttagagttccaatgaacaaacctgctatgtcacgttttgattctacagtgaggaacaatgtaagatcccactctacaagctcaaatgctcggcagcaacagcagcaatctaggcagccagcacagcagcagcagcaaaatggtgaccgccctactttttggacggtctgcccattttgttctgttaggtatcaatattacaaagaaattttaaataaatctctttgctgtcaaaattgcaaaaggcccttttttgcatatgaagtgaatgtacaaagtacatcatcaccagcatctaattcaactcagcaagcttctgaccagcagaaagatggtttgaatcatggtactttcaagatgggtgctggatctcatggcaattcacaggctgagaagtccaatatggggccttatgataaaaaaagacctagtaatgtctctggaaaaccatatggaaagaggaagaggaagcaggtggctgaatccagtgaaggttctgattctatgagaaccaatgattctgaagaagatatagttgccggcaaggatggtaattctggagtagaaaaccattcaacttcaagagaagggcttccacgcagatctacacggcaaaagcatcaagtttcctacaaggagaatgtgaaaaacagtgataatggcttcttgaaaccacgtggtgatggtgaaagtcatggtgagacaactaaaataaatgatcagaatggtttagctcctgaacttaaagaagtaaaacagaaacaacacttgtattctgaaagaaatgaggaaactaagacagataagggaaaagatgcagtgggagggtcaacacagatggatggaacttcagagcattccccagattcaacctccaaagcagaaaatcatccaaatgtttatgtctatcctgatgcagagttcagtgattttgacaagggcaagaataaagaatgttttactgctgggcagatatgggctatttatgatacatcagaaggcatgcctagattctacgctttaatcagaaaagttctgtctcctggattcaggctgcagataatatggtttgaaccacatccagattgcaaggatgaaatcaactgggtaaatgaggaaatgcctgttgcttgtgggaaatataaacttagtgacattgacatcactgaagatcatctaatgttctctcatcccgttttgtgtgaaaaaattagccgtaatacttttaaagtgtatcctagaaaaggagaaacttgggccctttttaaaaattgggatattaaatggtacatggatgtgaaatctcatcagctgtatgaatatgagattgttgaaatcttgacagattatgttgaaggtgagggtgtatatgttgcatacatggctaagttgaaaggttttgaattatttagattctctcacagggttccgtctttcaaaatgactggtcaggaaggagtgggtgtaccagcaggatcttatgaacttgatcctggagctctgtcagtgaatcttgaagagattgctgttcctgaaacttcagatgtgaaggttggtcatagttcatctggccttgtgaatacaagtccttcagatagatcagaactccttatgacatctgagggagatgcatctattcccaaggttaatttggaaagaagcaatttggcaagagagaacaaggattctgttgatgacagtgataattgttgtgcccctccagtattaagctcagaaaccatcgaagttccagatactcaattcttcgattttgatgctgggagggcccttgaaaagtttcagattggtcagatttgggcattttacagtgatgaggatggattgccaaaatattatggtcagattaaaaagattgcgacaagcccggatcttgaattgcatgtttactggcttactagctgctggctaccagagaataccattaattgggatgacaaagatattcttatttcctgtggcagatttgaagttaataaaacagatgatcttctcagtgtttatagtactacctcttgtgtttcacatcaagtgcatgctgatgctgttggtaagaataagaattatgccatctttccgaggaaaggtgaagtttgggcattatatagaaaatggacaaataaaatgaaatgttttgagatggaaaattgcgagtatgacatagttgaagttgttgaagaaactgatctgtccataaatgttttagttctggagtttgttagtgggtatacttcagttttcaggggcaaatcaaatgaaggatcatcagtcaatctacgaatacccagagaagagttgcttaagttctcccaccaaatcccagctttcaaactgacagaagagcatggcaatcttaagggcttctgggaacttgatccaggtgcactaccaatgcattattatggcttgaaatga

SEQ ID NO: 27583 - DNA, 96 bp, Glycine max
  Peptide Sequence Number=SeqID_119268
atgccagcagatgaagaagagagagactttttgcatataaaaattcagacagcgatttcagctctcaatgatcctctaagcccaatgagtatctga

SEQ ID NO: 27584 - DNA, 987 bp, Glycine max
  Peptide Sequence Number=SeqID_119269
atgggtcgtgacgatatcccagttggtctaggagatgtttttgcaatgaaccagtcagatccaatattcccacctgttggagaatgcaagtatgtaaaagccattccccatggaagtggggggttactggactctgacactctttatggtcttgctcgtgatctaccgcgcagtccaagaaggtatacagcagagaactctgtgaagtttggggctcctcgggatacagatcaccctgagctcagacaaccattagccatggaagtttggaactctgtattgcaaagaactaaaccaaggtctaagattacagtattgactaatggacccttgactaatctggcaaaggttgtatcggtgaaaaacatacgctcaagaattcaggaggtatatgtagtggggggacacataagcagcaatgtcaatgacaaaggagatatcttttcagttccttcgaaccaatatgcagaattcaatatgttcctggatcctttagcagccaagatagtgtttgaatcagaagttaacatcacactcatcccactcaacacacagcgcagagtaagatcattttcaaccattataggcgagttgcgtagaacaccaagaacacccgaggctgtattttctgagcgtctgctgtcaaggctataccgtttaaagcaaacccataacagatatcagcatatggacacattcttgggggaaattctaggcgcagttgtcttggctgagagccattcaggtcttaatccaaaatttgaggcgaaggcagttaaagttttggctgatggcaatgaatcaagtgatggaaaaactgtggtagatgagaaaggtggaaaactaatgagaattttaagcagtgtggatgcaaaggcttatcatagtttgtatgcaaaaaagcttggcgatgagaaccaatcagctaagataggcagctttgaggaacagcggagaaaatggagtcatcctcacattataaattag

SEQ ID NO: 27585 - DNA, 630 bp, Glycine max
  Peptide Sequence Number=SeqID_119270
atggccgcagacaatccaactagaaaaacaaatagtaccagcaaaaacggaggtaaaggcgtgacaaacacgacattctcagcatttggcagcctcataaagctgctccctacaggcactgtcttcgtgttccaattcctaaaccccgttgtgactaacagcggtgaatgcaacgccaccaacaagtggctcagcagcattgttctcgttgcatgcgggttgagttgcgcattttcttccttcaccgatagctacataggcagcgacaaccagaggcattacggcatcgtaacccccaagggactgtggcctttttccgaaccagaaaagtccaagtccgttgacaaactctggttgggtgacttcgtgcgtgctgcgttatcgttgttagtgttcgcggtgttggggctgttggacaccaacactgtgcactgcttctaccccggctttgaggttactcagaaaagtctgcttcaggtgctccccacggctattggggtttttgcaggtggggttttcatgattttccccgacaagcgaaatggaattggataccctttgaattctaattctgattctaatcacacctctaatatatctgatgaaaccgccccgattgacaatgcttag

SEQ ID NO: 27586 - DNA, 1041 bp, Glycine max
  Peptide Sequence Number=SeqID_119271
atggtctttcggagctccacctccctaattggcctcctgtccctcctcttcctcctctccgtctcctccgccattcgcctcggccttgtccgccgtccttccccggagctccctctcttccgggaggcccctgccttccgcaacggcgaggactgcggctcctcgccttccgccaccattaacgtagccatgaccctggatactaactatcttcgtggcaccatggccgcggtgctctccatgcttcaacattcaacgtgtcccgagaacctggccttccacttcctctcctcccatgacgaccctcccgaactcttctccagcattttgtctaccttcccttacctcaagatgaagatttacccgtttgactccaacagggtccgcggcaagatatccaagtccattcgacaggccttggaccagcccctgaattacgccagaatatacctggccgataccataccagaaaacgtgaaacgtgtgatatatttggactctgacctggtggtggttgacgacatagccaagctttatggtgttgatatgaaaggaaaagtcgtggctgcgccggaatattgtcatgcaaacttcacgctgtatttcacggataatttttggtcggacccggttcttgccaagacgttcaggggaaggaagccgtgctatttcaacacgggggtgatggtgatggacgtggacacgtggaggaaggagaggtacacggagaaggtggaggagtggatggcggtgcagaaacagcagaagaggatctatcatttggggtctcttccgccgtttctgttggttttggcggggaacataaaagcggttgatcatagatggaaccagcatggtttgggtggagataacttcgaaggaaaatgtagaagcctgcaccctgggcccattagtttgttgcattggagtgggaagggtaaaccctggttgagattagattctaggaagccatgcatagtggaccatctatgggctccttatgatctatatcgatcctctagacacttttttgaagaatag

SEQ ID NO: 27587 - DNA, 294 bp, Glycine max
  Peptide Sequence Number=SeqID_119272
atgccaagaagaatagtgttgagcagaacgattgaacgaaggtggcaacaagcaggcattaggaccaaatcggaattggaaggaaaaaagaggaacaagaagaagcccaatgtctattttaaaaatgaaaatagcaaagcactgtttccattcgaaatggaatgtactgaaaaggaaggcaaagcggtcttgaatttgatttcaagtgaagaggacaactgcgcctcatcttcttcatcttcttcttctcccacaaacctaaaactcttctcttttctttcagatctaatataa

SEQ ID NO: 27588 - DNA, 732 bp, Glycine max
  Peptide Sequence Number=SeqID_119273
atgatctttgcatcaaaccctaatcctaaaaaagtgtacctcatcggaggtttgcaagtggagtttccctaccaaccatatggatctcagtttgcgtttatggctagagtgatttccacccttaatctagctcagaaagaaggccattgtcacacgttgcttgagtctccaagcggtactgcaattgtcctgcttttagtttcagaaattcccgaccatacgcaatttgagatcaacaacaagaagcagaagaaaaaggaagcaccaaccatatattatgcctcaaggagaacgcactcacaaatttctcaagtggttcgtgaattgcggaaaactgcatacagggtgcctatggctgtgttggtgttaatgaaaactgaaaataaactattattgaaagatcaggcaacagggtgtccagaattcaaaaatgctcataaagtcaaaggtcatccttcccttcagaaaggaggatgcaatgtggtgcgtgacagaagatcttgtaaaagttggacaattggttgctgttattatggtgctcgttctatgtcaaatgatgctcaattagtattttgtccatataactacatcaataatccagtcattcgggcaccaatggaagtggatattaaagtaggtatagttattcttgacgaagctcacaatatggaggacattacttgtgatgctggcagtgtggataatgaagatgttttggatagtatgttatga

SEQ ID NO: 27589 - DNA, 252 bp, Glycine max
  Peptide Sequence Number=SeqID_119274
atgatctatcactgtgattcctcacttgagcaagcttcttccaaagctggaaactacatcccttatatagaggcactagccaagggtgcccctacgaaaatagaaggtgctagaatgcgaaaagaaaataacagaaaagtggaaaatgacgacaatgcagtgctgcacgatgggaagcaacatgccaacagcatatttcctatgaaccagtatcctcctgacagctcagcaccttctaacagattctgttaa

SEQ ID NO: 27590 - DNA, 567 bp, Glycine max
  Peptide Sequence Number=SeqID_119275
atggcaggcaagtttgatcccaaagattatcctaatgctatagacaggatgttgggtaagaagttggctttcaggtttaaggctataccaactgaggtgatttcaaaggctaggaaagaaatatcatgcttatctgtccgaaaaaattattatatggatggtagccaatgcttctttgcaactgctgaattggatccttataatgcacaatctgtcacccctgttaagcgattatcatcacaatcaaattcaaagtattcagttaatgttggaaggcgtccaatatttggaacagatcatgtaaagaaagtagcagaagctgatgtgaagggtacagaactgacattcccctccaacagcgttgcgtcggagggtaacatgacctggttttggtctgatgggcataagaaggggtgggttaagttgatgaacagggcaacgggcaataggtgggttcggaccacacttgtttcatttgcggtccccattcccttcattttcccgcgcaaaggatcagatgaggacaaccacttccttgggccccacacccctcctccttcactttaa

SEQ ID NO: 27591 - DNA, 495 bp, Glycine max
  Peptide Sequence Number=SeqID_119276
atgattatgaatacaattagagaaggaaaaattgttccatcaggagtgactgtcaaattgattctaagagagatgaaatctagtgacaatcataagtttcttattgatggcttccctagaagccaggagaaccgtatagcttttgaacaaattattggagcagaaccagatatggtacttttttttgattgtcctgaagaagaaatggtgaaacgtgtgctgagccgtaatcagggtcgaattgatgacaacatagatacaatcaagaaccgtcttaaagtatttgagtcattaaatcttcctgtgattgactattatgctaagaaagggaaactttacaggatcaatgcagtgggaacagtagatgaaatatttgagcatgttcggccagtttttgaggcatgtgaggagacggctcttgttgccttttttcctttccttatgccgtcgaaagaatggcctataggtggagctaagctgtctctagcaacatag

SEQ ID NO: 27592 - DNA, 1164 bp, Glycine max
  Peptide Sequence Number=SeqID_119277
atggctcaagtgaccgggcgggcagatatttggtggaggactaaagagtgggagaacatgaatacttttactcatgtcccccccggtttcaggttccatcctacggatgaagaacttgttgattactaccttaggaagaaaattacttcagggaggattgacctagatgtcataaaagatgttgacctctacaaaattgagccatgggatcttcaagagatttgcagaataggaacagaagaacaaaatgaatggtacttctttagccataaagataagaagtatccaactggaactcgcacgaatagagcgactgcagcagggttttggaaagcaacaggaagagacaaggcaatctattccaagcatgagctgataggcatgaggaagaccttagtcttttataaaggtcgagctccaaatggacaaaagtcagattggataatgcacgagtatcggcttgaaacagatgaaaatggcactccacaggcaaccaccataagtcataaccttgttaattacttagctagcatatttacaactttctttttggaagaaggatgggttgtgtgtagagtattcaagaagagagtaacaaccatgcgtaaagtgagtgagcatgactccccctgttggtatgatgaccaagtccctttcatgcttgacttagactcaccaaagcaaacctctcaatctaatttggtctaccagctaccatatccttgcaagcaagagctagatttgccataccaattgcctcgtgaccactttctccagcttccacttctagagagcccaaaactgcttcaatctgcttctgctataacccctaataatcccatggcagcatatgttctagaccatgtaaaccactcaacttctctgcttcccccatccctcatacaagaagaacagcaaaactttcaggcaacctatggcaacagcaattccaatgaacaagcagtggatccagtaattgattggcgagtgcttgacaagtttgttgcttcacaacttagtcaagatgcttccaaagacaatatctttcaaggcacggacaatagcaatgtacagttcagacatctggacaaacaagagctagtggtgcctgaacaaaatgcatcaacatcaaactccagctgcccaattgatttgtggaaatag

SEQ ID NO: 27593 - DNA, 1236 bp, Glycine max
  Peptide Sequence Number=SeqID_119278
atggacttgaagtcgaatcatactcctgttctcactgatgctgcacctgtaacaaagtctagactgggtgtgcattccagtttgttgccttactcccatgctgggacaacctttacacatggaatgttattgactatcccgaggaagaagacaggaattcttgaagatgttcgttctagtggttggttggatgccatgaaatcatcttcacctccagccaggaagataacaaaggatgttggccatgggtttgcatcatctgattctgaaactgctggtgcttattttagctggctgctaaaatacccatccgcacttgcatcttttgatcaaatcatgaactatgcaaaagggaaaagaattgcgctgtttatggattatgatggaactctttcaccaattgtggataatcctgactgtgctttcatgtccgacaatatgcgtgctgctgttaaaaaggtggcagaatattttccaacagcaataattagtggaagaagccgtgataaggtatatcaatttgtaggactaacagaactctattatgctggtagtcatggaatggacatcattgggcctgttagacaatctgtatctgataatcacccaaattgcattaggtctacagacaagcagggtaaggaagtaaatttattccaacctgctgctgaatttctgcccatgattaatgaggtacttaattctcttgaagagtgtacgaaagacattaaaggagctaaagttgagaacaataaattttgtgtatctgtgcactaccggaatgtagatgaaaagtattgggatttggtggggcaacatgttcatgatgttctgaagggttatccgcgtttgcgcttaactcatgggcggaaggttttagagatccgacctgtgattaactgggataagggaaaagctgtcacgtttttacttgagtcacttgggctaaacaattgtgatgatgtgcttcctatatatattggagatgatcagactgacgaagatgcatttaaggttttgagagagggaaataaaggttatgggatcttggtgtcttcggcaccaaaagaaagcaacgcaatttactctctgcgtgatccgtcagagaaacattccaagaggtttactggagcagatttacgcacagaagaacctcttttggtaacaacagcgttgtcgctacccagtttttttgctcgaagctcttgtggtagctgtaaattcgtcaactcataa

SEQ ID NO: 27594 - DNA, 834 bp, Glycine max
  Peptide Sequence Number=SeqID_119279
atggttctgactcagaagcttcacgaagccttcaaaggcaccgtcgagaggattactggcccccgaaccgtttccgccttcaaagaaaaaggagttctcagtgtctctgagttcgtcaccgctggcgataatctcgttgccaaatgccccacctggtcctgggaatcgggtgatccaggcaagaggaagccatacttgccacctgagaaacagttcttgattactagaaatgttgcttcatacttaacagtgccttgtcttcggagagctgcatctgttgaagaggaatatgaagctgctggaggggaagttctactcgatgatgaagataatgatggctggctagcaactcatgggaaacccaaaggcatgtattatttgtattggactggaggcttcctagaaatcagcaaaaagggttctattaagcaaattcattcctacatgggagctgaagagggagaagatattccagatatggcagagtttgacgatacttccaatgttgaaaatgatcctgccactcttcagtccacatatctagttgctcatgaacctgatgacgataatattcttcgaactcggacttacgatatcagcatcacacttgttactgatttagtgattccatgttcaatcttgtggcagtcaaggatgcttttgcaaccagaacttgttcttgaagatgttagtcaagaccatgcacgcaaaacggaccatcctcacttgccagggaagcatgcatctattcatccatgtcgacatggagcagtgatgaagaaaatcattgatgtgttgatgtcacgcggagttgagcctgaagttgacaagtaa

SEQ ID NO: 27595 - DNA, 453 bp, Glycine max
  Peptide Sequence Number=SeqID_119280
atggtttcccacactcttcatcaacccaccgcaggcatcgtcaagcaacttcgactcgagaacttcatgtgccattccaaacacgagaccgagttcggaaaccacgtcaatttcatcaccggtcaaaacggaagtggtaagagtacaatcctagctgcactgtgtgttgcatttggctgtcgagccaaagagactcaaaggacttccactttgaaggatttcattaaaactggcgccactgatgctgtcatccaagttgaaattcaaaatgaaggggagggtgcttttaaacctgaaatatatggtcctgttatcatcgtagaacgtaggatatctgaatcaacaagttctgctacattaaaagaccaccaagttgacaacacattaattttcatgagatatagggcccatccggtctccaaacatcactatgaagtcaagcaaatggactag

SEQ ID NO: 27596 - DNA, 441 bp, Glycine max
  Peptide Sequence Number=SeqID_119281
atgagttcgtcgaacctgagagatctccaacgcgaattggagaacaaagccaacgatctcagcaagcttcaaaaggaaattgcaaagaatcaccaaatgagaaagaagtacacactccagcttggcgagaacgagctcgtccttaaggaactggatttattgaaagatgacacaaatgtttataagttgattgggccagtacttgttaagcaagatttggccgaggccaatgcaaatgtccgcaagaggatcgaatacatctcagctgaattgaagcgtcttgatgccactgttcaagatttggaagagaagcaaaatagcaagaaagatgcaatactaaaattgcaacaaaggattcaatcacttcaggctgggaaaggcaaggcatatcatttgttgcaagggctactttttgtggaaaagccattggcttttttctaa

SEQ ID NO: 27597 - DNA, 3501 bp, Glycine max
  Peptide Sequence Number=SeqID_119282
atgtatcgaggggttcccgttgcatgcaggacgcgtagcaagcggggaagggtggttggaagtggtttaataatgggccagaagaagaaaaaggtgcatgaccatgaacctgtgtctttgaagcgtgtaagggtatctgaacgaggttttgattgttcgggagggcatgctggtgaccctattgtaatcggtgacagtggtgatgatgtcagtgaggctgaagaggggttgaggcatactgagaagaggtttctggtagaaaaggaatggaagagcgaggagggtaaaaggtgttctgtatttgttgataaagttgataactttggcaatgatgactatgcttgcgtacctgaaaaccgggtaattttgccggatgattcatatggggataatcagagtgagaaggaacattgcgcggataaaagtggttcagatgattcttttttgtgtttaacggagagtgaggatggcgccaccagtgatgaagattttcaggttgattatgatgagaatgattgctgctcgagcagtgaggacagtgattcttcttcttatgatgatgatgagagagggggatacagcaagacggtgaaggagagggtgagaaaggtggagggtgaaactgaaagtagtggagtttgcaaaagaaaaggtggaaggaaagataatgaagagggggagcaatggattggtgctgactgtgctagtgcaacctctagtaaatctgagatttataagcaggaagcaaggaatgcagcacagaaacatgaatcaaagagagtcaaaagtgccaatgttgatgcagaagtctttggtgatcactggaaaagttcaggttgctctatgccttctgaagctgaagcactagagcataggaagaaaagagatacaggtcatcaaagtgcgtcattgcagaaaaaaacagaatattcaactatgatcaagaagaatcttgatgaccatgaaggaaaaaagcatcatcacgtcaaaggagattcagctaaagttgtgacaaaaaaagacaggaagggaagaaagcataaatatgggtttaatagcaataaatgtgagaaggtacgggtggtggatgatgaaactggtgacaaagatgagctgcatgaagtcctaaggatgccatctagaacaaaaaaccgatgttttaaattatttaatgaatgcttttggggcaagaatgattctgttaaagatgattccaatcagttggaagaaaaggatgatgattttggtcagggtcagactaagccattagcttctagggaaacaatccctttggattggaactttatgaagaaagaacctattgaaaatttggagtttgagaaggagttagatatcttgtggggtgaaatggatatgttgcttcgaggtgaagaaattgggtctcaggttgataatattggaacaaatgaagcaagagaaaatgaagaaaattcagcgtcgcagtgcaagcatgatactatttttaatgaggaaattgggatatactgcagatggtgtggttggattgccactgaaatcaaatatatcactccaccatttgtggattctgaaagatgttgcagaagggtgtcatctggtggagggaacacctcacagtttgatggggatctgtttaatgatcctggtgatgactcagaggcagtttggtctcacaatgaaggcacagtttgggaccttattcctgacataaaacaaagcttgtatcctcatcaacaagaagggtttgagtttatttggacaaatttggcaggaaccactgaccttgccaaattgaagagggttgacccatgtagtgaaggtgggtgcattgtttctcatgctcctggaacaggaaagacaaggttgaccatggtttttcttcagacatatttgcaatcgtttccaaagtgtctacctattatcattgctcctgccaacatattgcttacatgggaagatgagttaaggaagtggaacataggaattccattccataacttgaacaattctgaattatcgggaaaagagaaactcattaatgaagttgactggtctggcaatcaaaagcagaataaggatgccatacgtatggtgaagttgtgttcatggtacaaagagaagagcattctattaatcagctacaatttgtatgagaagttagcaggatccacggctgaaggtgatgggaaaaaagagaagaaaaataataagatgaaaaaaaagaagaaacgtgcaaggccaagggagtacattgaaagtggaatgggaaaggttctgcgtgactatcctggtttgctagtacttgatgaagggcacactcctcggaatcagaatagttatatttggaaggttctttctgaaagtagaactaagaagcgaatccttctttcggggacacctttccaaaacaattttttggaactttacaatattttgtgcttaatgaaaccatcctttcctgacagcataccacaagaactcaagaagttttgccaaagtagacaaatgcaggaaaggaaagatgtgagctgggattgggaacctgtttcgtctggaaatacagctgatgagaaaataaaactgctaaaattgctgatgaatccctttgttcatgttcacaaaggtagcattcttcaaaagaaccttcctgggttgagagattgtgtgctggttttgaagccagacattttgcagcaagaaactctagagagcattgaatattctcaaagtgcactgaactttgaacacaagttggccttggtctctgtccatccatcccttttcctcaactgctctctgtcaaaaaaagaagaatctgttgttgacaagggtaagttggaaaagcttagattgaacccttatggaggggtcaaaaccaaatttctgtttgagtttataagactatgtgatgcagttaatgagaaagtcctcattttcagccaattcattgataccttatgcttaattaaggaccaacttgagtcagccttcaattggtctgtggggacagaagtgctgtatatgtatggaaagcttgaccataagcaaaaacagtccctcattcgtagtttcaatgattcaaatagccaagcaaaggtgctgcttgcttctataaaagcatcttctgaaggcattaacttaattggagcttcaagggttgtgcttcttgatgttgtttggaatccctcagtggaaaggcaagctatttgtcgagcatatagacttggacaaaagagggttgttttcacatatcatcttcttgcacagggcacccctgaatgcacaaaatattgtaaacaagcagaaaagaaccggttatctgaacttgttttctcaaatagaaatgctgaaagtcataagctcaagagtagtggagtaatgcttgaggatattgaggatagagttcttgatctcatggttcagcataaaaaactcaaggatatgtttggtgaatgtctggttcaaccaaaggagagatatttggagactttgggcccttga

SEQ ID NO: 27598 - DNA, 2682 bp, Glycine max
  Peptide Sequence Number=SeqID_119283
atggcatttcacgtagcttgtccaattacatgtcgccgaatctgtttctgcacgctagggtttccgcgcgcgctccacgcttctcccgacgctcccaatgccttcgttcacgacgtttcagctctccgcgacttcctcgccgacacgcgcagggacgacgccaccgttcaggtcctcgtccccaaggtcctgccgccgcttccgcctccgtccgacgctgttcctcttggccctgacgcgctcgatgagtccgcctccatgaaggccaagcgcatcgccctccagcgcaagggcgccgccgccatgatcgccgccgaggagtacgctcgccgcttcgagtccggcgatgttgtgctcactactgatgaaattttgatgttgaatgcgtggcttgaaagccaagctgggggaaatactccgggaaatcttactggagaggagcagggtcaagccaataggagctattgtcgaatttgcaagtgtggagaaaatgaaggaagtgagaaagctcagaagatgctatcgtgcaaaagttgtggcaagaagtaccataggaactgcttgagaagttggggtcgaaatagaggtaagaagatttgtttcattggagttcatggacctgtcctctttgccggatttgtgaggacatttgtacagaatgggaaagtttctatttgtgtatcttttttttttataaattacaagaaagtcattttataccaggcttgcagaaggactggtgatccaagtaagttcatgttttgcaaaaggtgcgatggtgcttaccattgttattgtcttcaacctccgcacaagagtgtttgtaatgggccgtatttgtgcacaaaacacgcaagatgtcacagttgtggatccaatgtacctggaaatggactaagtgtgaggtggtttatggcatataccaactgcgatgcatgtggaagattgtttacgaaagggaactactgtcctgtttgtttgaaggtttacagagattcagaatcaacacctatggtttgttgtgatacttgccagctctgggtacattgccagtgtgataatatcagtgaagaaaaatatcaccagtttcaagtggatgggaatttgcagtataaatgtcctacgtgtcgtggggaatgttatcaggtcaagaatcctgaagatgctgcccaagagatttggaggagaaggaatattgctgagagagatttgatttctagcttgagggctgcagctggtttgccaactcaagaagaaatattttctatatcaccattttcagatgatgaggatagtgggcctttaaaactaaagagtgaatctgcccgttcctttaagttctctctaaaaaatttggccaatgactcaccaaagaagaaaacttcaagcaaaaagactgctaagaaaaaaaactctcagtcatttatgactagtaaaattgacacacacaatagttgtgaaggacatagtgatattaaatctttgcatagcttagatgatgataagaatgatgatatacaatcccagagaaatgaaggtccagatgtatactcatctcctgctactggaagcttgagtcaaactgaagcatcttttcctattaatcagccagggattttgaaacaaaagtttgttgatgaggtgatggtcagtgatgaagagaggaaacccagagtagttcgaattaaaagcaacaaggcacatattccagatagtgaagaggaaagtggaaaacacagtcttaagactcagaatgtgaaagggaagaagttggttataaatttgggagcgcggaaaattaacgtggctagttccccacggtctgattcatcaagctgccaaaaagatcaagatccggtgactgttaatggaaatgaagatagaagccaatggaggaagggagacaagtttgcattagatagacaagatgacacagctaggcatattgacggtaaaggaatcaaagttgattctgggcaatcaaaatttttcagggtttcgggaagagaagggaatttgattaagcttggaaaagttaagccagacatttctgaattcaacctgacctctggtagaggcaatatgtctgatgggcggataaaacatagtattgatggaatgattaatcaggttggaataaaagctacatcaagaggtgaaaggacatatttggggaggcagtcagaaggcagctctgatgcatatgagacagatgacaataataatcgtacaccttcacattctttgccaaaagattccaaacctttactaagatttaaattcaagaaacccagcattgaaagtcaaaattctcctcatcaggaggaagagaagatgacaatcaagggccagaggtcaaaaaggaagagaccttcaccttttaaggagaaagcatcttttaatgagtctgaaggtgtaagtcaatcacatcaagacagtgcaatggatgggataatggatgcaaactggatattgatgaaattgggcaatgatgcaattggaaagagagttgaagttcatcagacatctgacaattcttggcacaaaggactggttactgacgtagttgaaggcacttcaaagttatatgttgcattagacgatgggaaagtgaagaccgtggaactcaggaaacagggggtccgttttgttcctcaaaagcagaagagatcaaagacatga

SEQ ID NO: 27599 - DNA, 330 bp, Glycine max
  Peptide Sequence Number=SeqID_119284
atggcactcattgttgactcagttaacgcggaatcatccaagaataatgtagcatgcggtgcatacattgtggtgtgcaccagactaatgggttctaagagtagtaggtggtcggttacttgggtggttctttttatttgtttgctgttatgtttttctgccaaagcaatagcaacaagaaaccttgctggttatgcagatgaaaagggtccgagtaggagactccttggccgttctccatgcaagaggggaagaatgacttctgaagtggttcaaggagacaggaagcagcaaagggaggacagtccacgttgcaacaattatctgtga

SEQ ID NO: 27600 - DNA, 2676 bp, Glycine max
  Peptide Sequence Number=SeqID_119285
atgattgggagggaagaccccactaaaggtggtcagttagatttcccggtgaagattaatcatcagcaaagccagtggatattccgcaccaatactattataacgagctatctggagcaaaggtgttacagggagttgagaactgaaaactaccaatctgtcaaagttgttatctgtatttataggaagttgttgatttcttgtaaagaccaaatgcctttgtttgcaagtagcttgcttagcatcatacagattcttcttgatcaaccacggcaggacgaagtgcagattttaggttgccaaactctgtttgactttgtgaacaatcagagggatggtacttatatgttcaatttagatgggttcattttaaaactttgcaatctagctcaagaaatgggagatgatgccaaagtacaacttttgcgggctgctggccttcaagtcctttcatccatggtttggttcatgggtgaattcactcatatctcagctgaattcgacaatgttgtttcagttgttttggaaaactacggggatgtcaaacaagattctcaaaatgagaatgcaatgaggctttattcttggagagtggtagtgaatgacagaggagaagttaacgtgcctgtggataatgccacgaaccctggattttggtcacgggtttgcatacaaaatatggcaaagttagccaaggagggaacaacagtacgacgtgttctggaatccttgttccgctattttgatgataccaatcgctggtctccagaacatggccttgctctttctgttctgcttaacatgcagtctataatcgaaaattctggacataatacacatttgttactatccattttagtcaagcaccttgatcacaagaatgtcttaaagaatcctaaaatgcagcttgacattgttggtgttattacccatcttgctcaacaaacaaggtctcaacaatctgtggctataattgatgcaggtcctgttattgataccatggctgtgttgttggaaaacatgtctaatattactgttatggccagaaccttgattgctgcagcattccctgaggcattatttcatcagttactcctggcaatggtccatgcagaccatgaaaccagggtgggtgcacaccgcatattttctgttgttcttgtgccatcttcagtttgtccacaaccttcctcttcaggaacccccatgacaaaggcagctggtattcaaagaatgctctcacgaaatgtctctgtgttttcttcttcatctgcactctttgagaaattggagagaaagcaaaattccttgtcagaagatagtcatacagatggaaatgttaatgataactccattttgaacagattgaagtcaacttatagtcgtactactagtacaagaaaatctgctatgatcagtgctgaatctacagataacaagaactcaaaggttcataattcttctatgatgaatagattgaagtctagttacagccgtgctactagtgcaaagaagccacaaatacccacaaccgtggaagaaaatactacaaatacttcaaataaacaacaggtattacccattaggctgagtagtcatcagattaaccttttgctatcatcaatctgggcccagtctatctatcctctaaacacatctgaaaattttgaagcaattgctcatacctacagccttgtcttgctagttgctcggagtaagattgtagagaagacatggaagaacaattccatttcaatcgtttattctgcaaagacagggattacccctttccacccttgtgaggttgatccattcctgcaactggttaatgatagcaagttacaagcggttattgatacagataggcagccaagtaaagtttatggatcaaaagaggatgatgaagatgctttaaaggcactttcagcaataaggttaactgagaaccagtctaaagaatcatttgctaccatgatagtgcagagtctgggaaaatcatctaatgaatcatccatcttaagagaacagcttctgaatgatttttcacctgatgatgcctgtcctttgggagcccagttatctgctgagacaacaggaaatatgtaccagtctggactaaaagaagataaacttcctgatatggttgatatctcattatttactattgacgatgacattccaccttgtggtttggagagccaagctaattctgatccacagcaacagccttcacaaaatctaagcctgctgagtgttgatgacattttgggttcagtttcggagacaacacatcaagtaggacggatttctatttcaacaccgtttgacatgccttacaaggaaatggctctccattgtgaggccctcctcatgggaaagcagcagaagatgtccactttcatgggtacccatccaatgcagggatatttttcatttaggattcctgctcctgaatacaaccagcaaaaggacgagtcctcaaattccagtgttcaacagactttaccttcgagtggaaatccgtttttggattcaaacttcgactcgaattcataccacacattgcctgacacttctccaaggctttgtgcaacagcataccagcatcaggctgccttctttcaactgccagcatcacgcccgtatgataatttcttgaaagcagccggatgttga

SEQ ID NO: 27601 - DNA, 3552 bp, Glycine max
  Peptide Sequence Number=SeqID_119286
atgaagagattgagatcgagcgaggatctccattcctacggtggagataagggtaatggttgcaaggattcgaacaatctgaaccgttcgttttcgtcggcgcagcggagcttttactacaagccggagtatgcgcgcaagggtttggtctcgtcgtcttcgtcgtcgtcgcggtacgagagggatcggacagtggaggaggatcgggagggttcgcggctggttcggaagcgatcagagcacgatttcgaggctttcgatcggaggaaggggttcgatcggtacagggagagtgaccggggtttgattcaccggtcagagagtttctgcggcggcggcgggtcgcagagggatcagtttccgaaggggtttcggtcggagagggagcgttcgcggagggaggggagcgtgtcgtcgtggcggcgagggttgaaggatttggatgatagagagagggtagtgcgttcccctaagggtttgagggatgcgaagtctccttcgtggtcgaaggattctgtttctgagagcgagcaatcgaagaagagatcttcttcttctcccaggccctccagagatggtaactccatcaagtctaagtccaagtctcccacttggtctaaggattcggagagcgagcagtccaagagtgttgaggtgaagaaggctgaggaggagtcgttgcagcaggttcagagtgggagtgggagtggtagtgagatggaggaaggggagcttgagcctgaaccccaagcggaaacggttcctcccgtgagcgaagacttgccctctgttgctatggagactgatgagaagcaagctcagaagaatgaatgccaccctaatgatgacagcactgatgctgctgtggatgagagacgggagttgtccagtaaggaagaagtgaaacctaatgaggaggttggttgttgtgaggtaaaggatggagaggagatagaagctgatgagatggcagatgttcgggatgatttgtctgagaaaatgcttgttactgagactgaagttgagtctgtgggtaatggtgatgatgataaaaaggaggaggctttggatgctggagctgagtgcgaggaggaaacaaagaagggtgcggatgtggataagcaggacaaggacaagaacaaggttgtagatctaggaaccggcgcggatgttgtcaaacctgagttaaatgatggagtatcaacaggaaatgaagttccaaaggaagtggatagagaaatgatgatggagagtgcggtcaatattgcaaaggataaaggcaaaggtgtctctgttgcacttgtaccacctactaatgttgttcatgctttagatgatagcttgtggttggacagagggtcgagagacctcccgacgtgttctgttgatgttatagaaggtccaagcacaaggggattcgagttgttttccagatctcctgttaggaaagtggagaaagtagaccactcagttctcaacaagcacaaggatgacatggagcagcttgatcttactcttagcttgccgaatgttctgttacctattggtgctcatgagacaacatcgcaagcccctggatcccccagtcaagcacggagtgtgcagtctttaagtaatacattttgtactaactcagatggttttactgcatcaatgtccttttcaggttcccaatcattctatcataatccaagctgttctctgacaaaaacttcagtggactatgagcaatctgttggcagtcgccccttattcgggggaatagatcaagtttcccagggatgttggcaaggtcagtctcagagcgatcccaaacagaaagaagttccttttggtcaaagaacctcggcaaacggaaatggctcccttttccagcctcaggcatcatggggtgttttagacagtcaagctgtaaagggtcaacattccagggttctagaaggaagttcaaaaatgggcagtggacttgacaggcaattgagttttcataaacagttttcaggccagtcaagacgccatgacgatgttagatctccgtcacagagtgttgggtctcatgatattggatcaaattatagctttgagaaaaagagagaggtaagagagaggggtagtggtagtctgtatcgaactacaagccagaaggaacaagaacaacttctggtgggtggagttgattttgttgagacaatcattgcaagaattgtttctgaacctgttcatgcaatgtccagaaagtttcatgaaatgaccggacagtccatagtatgtctgaaagagggtattcgtgaaatcatgcttaatgcagataagcacgggcagatacttgcttttcaaaaagttctgctgaacagatctgatataatcttggatgtcctattgaagtgtcacagagtgcaactggaaattttggttgctttaaaaactggtttgactcattttcttcacctagagagcagcatttcatcttctgagttggctcaaatttttctgaacttaaggtgtaagaatctttcatgtcgaagtcagttgcctgtggacgaatgtgattgcaaggtttgtgcacagaagaatggtttttgcagggagtgtatgtgccttgtgtgttcaaagtttgacaatgcctcaaatacatgtagttgggttggatgtgatgtttgccttcattggtgccatactgactgtggattacgggaatcttatattagaaatgggcctgggacaaaagggatgactgagatgcagtttcactgtattgcttgtgatcatccttctgagatgtttggctttgtcaaggaggtgtttcaaaattttgcaaaagaatggtcagttgaaaccctttgcaaagagcttgaatatgtaaagagaattttttctgcgagcaaggatatgagagggagacagttgcatgagattgcagagcaagtgctgccaaggttggcaaataagtccaatctccctgaggttttgaggcacatcatgtctttcctttcggatggtgattcttccaaattacccatgacaacaaacttttctgggaaggaacaaattaaagaaaacaatggagtagctgggcccagccaggaagcaacttggatgaaatctatttattcagaaaagccacctctgttagaaaggcctgcaaatatccttcctacctttgaccagaatgataaaagaactcttgtgcaagaattgcagatgagtagtatccagaaggacttctgttttgatgaattggagagtatagtaaaaattaaacaggcagaggctaaaatgtttcaatcacgtgctgatgatgctagaagagaagctgaagggttgaagcgcattgcccttgcaaagaatgagaaaattgaggaagaatataccaatcgaattgccaagttacgattgactgagactgatgaaattcgtaaacaaaaatttgaagaagcccaagcattagaaagagcacatctggagtatttgaacatgaaaatgagaatggagacagacattaaagatctgttatccaaaatggaagctaccaaaatgagccttgccatgtga

SEQ ID NO: 27602 - DNA, 612 bp, Glycine max
  Peptide Sequence Number=SeqID_119287
atggtaaatgctttgagagttggcagtgttatctcactctactcccttcggaacacgagaccccatcttccccttctctccaacgccacgcgcttccgttccaagttcccatttttcaccctctcatcatcgccaaacccatctgggtatcctccatttcgcacactctcttcttcttctgcttccacagatgaggcaatgaccaccgaaaccatcactagcaataatgcaagtggtgaagctgacaacagtattaaggatgcggcggggttgcttgacatgagggttgggcgcattctgagagcatggaaacatgatgaagctgattctctctatgtggaagaggttgatattggtgaacctgaacccagaatcatatgcagtggccttgtcaaatacatccctcttgaaaaccttcagccaagaaatatgcgtggtgtcaagtcctgtggaatgctgatggctgcttctgatgcaaaacatgaaaatgttgaacttctgttccctcccgaggaagcaactcctggtgaaagaatttggtttggaacggaagatgaaaaggataatcaacctgatgctgccactccgaatcaggcaatcgctcttccttaa

SEQ ID NO: 27603 - DNA, 139 bp, Glycine max
  Peptide Sequence Number=SeqID_119288
atgcagaattcagtttttgggcatcgctctactagtggatctggaccatgctgtcaagcagaggatatgaagtggaagttggtttgcaaatgtttgaattcacgtcaagcaaggtttcccagtgtggaaatagaagcgg

SEQ ID NO: 27604 - DNA, 2775 bp, Glycine max
  Peptide Sequence Number=SeqID_119289
atggagaagtacctgagagaaaactttagcgtgcagccgaagaacccttctgaggatgctcttctccgatggagatccgccgtctccgtcgtcaagaatccccgccgccgcttccgcatggtggccaatctcgcccaacgcgctgacgccgaacaaaagcgcaagaagctccaggcaccagctgggaaccgtggtggtggttccatgctctccaaagagattcaggaagcaggctttggaattgagcctgacgaattagcctccattgttcgatcccatgacaccaaatgtttagaacatcatgaaggagttgaaggactagcaagagctgttcgtgtgtcattgcaacagggcgttaacacactagatgttcagcacagacaaaacgtctatggttttaaccgccatgccgagaatccccccagaagcttttggatgttcgtttgggatgcaatgcaggacttaactctaatcatccttatggtatgttcttttgtttcagtaggtgttggaatcttaacagaaggttggccaaaaggtatgtacgatggagtgggaatcatactatgtatccttttagtggtctttgtcacttcaatctgtgactataaacagtctttgcaatttaaggatttggacaaagaaaagaaaaatgtgagcattcaagttacaagagacagcaaaagacaaaaagtttcaattcatgatctagtggtaggagacatagtccatctgtcaataggggacatagttcctgcagatgggttattcacatcaggtttcggtttattaatagatgaatcaagtctatcaggtgagagtgaggctgtgaatgttgatcaagagaagccttttcttctatcagggacgatggtgcaagatggttctgctaagatgctggtgacatccgttggtgtgaggactgaatggggaagattgatggatactctgaacgaagggggagatgatgagacaccacttcaggtcaaactaaatggggttgccaccattattggaaagataggtttgtgttttgcaatagtcacattcatggttctcacgggaaggtttctctgcgggaaaatagctcaccatgagatcacaaaatggtcactaaatgatgcatctagccttctcaatttctttgccactgctgtcattataatagttgtggcagttcctgagggactgcctttggcagtcacactaagccttgcatttgcaatgaagaaattgatgaatgacaaggcactagtaaggcacctctccgcatgcgagacaatgggttcagctagttgcatttgcactgataaaaccgggactttgactacaaaccacatggttgtggacaaaatatggatttgccaacaaactaaggccattaaaatcggcaacagtgaaaatgtgttgaagtcctcaatttctgagcatatatctgatctccttttgcaatccatattccagaacactggctcagagatagtcaaagggcaagatggaaggaacaagatcatgggtactcccacagagtccgcattgctggagtttggcttgcttttgggaggtgattccaagttttataacgacaagtataaaatagtgaaggttgagcctttcaattcaatcaggaaaaagatgtcagtgctggtggctcttcccgatggcaccaacaagtatcgagcattctgcaaaggagcatcagaaatagttgtcaaaatgtgtgaaaaagttgttaatgcagacggcaaagtcgtccaattgaacgaacaacaaaggaatagcgtcacagaagttatcaatggttttgcttctcaggctctgagaacgctctgcattgccttcaaggatattgaaggatcttctggaagtgatagtattcctgaggataagtacacgttgatagctattattgggatcaaggatccagtgaggcctggagtcaaagaagctgttaagacttgtttagaagctggcattgtcgttcgaatggtgactggcgacaacataaatactgctaaagcaatagctagagaatgcggcatattgacagatggaatagcaatagagggaccagatttcaggaacaagagccctcaagaactgatgaacataataccaaaaatacaggtaatggcccgatccttgcctcttgacaagcacaccttagtgaaacatttgagggatgatttttatgaggttgtggcagtaactggtgatgggaccaatgatgctccagcgttgcatgaggctgatattggacttgctatgggtattgcagggacagaggtagccaaagagaacgcggatgtgattgtaatggatgataacttcgcaaccatagtgaatgttaccagatggggccgtgctgtttatattaatatacaaaagtttgtccagtttcagttaacagttaatgttgtggctctcatgctgaattttgtttcagcatgcgtgtcagcagaatccatttcaggttctgctcctcttactgctgttcaaatgctttgggtaaacatgatcatggacaccctgggcgcattggcactggctacagaacctcctcatgatgggcttatgaagatgccaccagttggaaggaacgccaaaatcatcaccagggtcatgtggaggaatataattggtcagagcatctatcaaattattgtccttttggttctcaaatttcgtggcaaacagattctcaagctcaatggacctgatgatgctaccttacttctcaataccgtcatattcaacacctttgtattttgccag

SEQ ID NO: 27605 - DNA, 1374 bp, Glycine max
  Peptide Sequence Number=SeqID_119290
atgtttggaaacggtgaagccgtgactcacagtgcatgctccaatggttctgtccaaactgtaaatggcaatttggaagagaagcttgatgaacttcgtctgctaatggggaaagtggatggtgatccactgagaatagttggtgttggagctggggcttggggtagtgtattcacagctatgttgcaggaggcttatggtggtttaagagaaaaggttctgattaggatatggagaagacccggaagaacggttgatagagccttggctaagcatttgtttgaggttatcaattcgagggaggatgtattgagaaggctgattaggcgatgtgcgtatttgaaatatgttgagggaagattgggtgatcgtgtcctttatgcagatgagattttgaaagatggattttgcttgaacatgattgacacccctctttgccctctcaaggttgtcacaaacctgcaggaggctgtgtgggacgcagatattgtgattaatggcttgccatcaacggaaacccgtgaggtatttgaagaaattagcaagtactggaaagagagaatcacagtgcctgccatcatttccttagcaaagggtgtggaggcagaattggggcctgaaccacggataataactcccacgctaatgatcaatcaagcaactggagtccccattgagaacatcctttaccttggaggtcctaacattgcctcagaaatttacaacaaggaatatgcaaacgctaggatatgtggggcagaaaagtggaggaaaccactggcaaaatttttgaggcagccccactttatagtgtgggataatggtgaccttgttactcatgaagttatgggtggattaaagaatgtatatgctattggagcaggaatggtagccgctttaacaaatgagagtgccaccagcaagtcagtgtactttgctcactgcacatctgagatgatttttataactcatctattggcagaagaaccagaaagactggcagggcctctcttggctgatacgtatgtaacgttgttgaaaggtcgcaatgcatggtatgggcaaaagttggccaaaggggagttgagccttgaaatgggtgacagcatcaagggcaaggggacaattcagggagtctctgcagttaaagcattctatgagctacttagtcagtccagcttaaatgtcctaaatcctgaagaaaacgagctcgttgccccagtggagctttgccccatcttgaagatggaatctccagtagaggcaattcttcaagcattgcgagatgagacaatgaatgatcctcgtgaccgtattgagattgcccaaagccatgtgttttacagaccatcacttcttggtcaccagccttaa

SEQ ID NO: 27606 - DNA, 687 bp, Glycine max
  Peptide Sequence Number=SeqID_119291
atgaatgactcagtagacaaactggtaatcttcctagcaaagagagatggcatagacaagctggtgaagacgttccagtacgtgtcaaagctcgtaaactggcacgtggaagccacgcaccccgacacatccaagaggttcaagcaatgggaagtggcctccggcctcagcagaaaagccttcagaaccggaaggttcctcaccggcttcaacgttcttcgcagaaacccaggctccaccctttctctgaggctactagcagtgctctctaatgctggcgagatggtgtatttcttcttcgaccactttctttggttggccagaatcggtaccatagacgcgagcttggcgaagaagatgagcttcatatccgcctttggtgagtctgttgggtatgtcttcttcataatagctgatttcattatgctgaaagaagggctcaaggcagagagaaagctgagaagaagcagctccaaggagaaatccgaggaggaagagaaagcagtgattctgaagatcagaagcgataggatcatgaggcttatggctgtggctgctaatcttgcggatttgttcatagcaatagccgagattgagccaaaccccttctgcaaccacactgttactcttggcattagtggcttggtttctgcttgggctggttggtatagaaattggccttcataa

SEQ ID NO: 27607 - DNA, 1224 bp, Glycine max
  Peptide Sequence Number=SeqID_119292
atgactagcattatgaaccttactagatccatggtcattctcagtatcctcatttcaaccttagtttgtgaagctaggcttctccgagttacacctggatttgttcaaaccaaggacacagaacttgtgctaaatggctctcctttcctgtttaatggctttaactcttactggatgatgaacgtagctgctgatccaaaccaaagatataaagtttccaatgtatttcgagaagcttcagctataggtcttacagtgtgtcgtacatgggcatttagtgatggtggcaatcaatctttacaaatatcacctggtctctacaatgaggctatgtttcaggcattggattttgtggtggcagaagcaaaaaagtatagagtgcgtttgatttttagcttggtcaacaattacaatgattttggaggaagacctcagtacgtgcagtgggccaatagtagtggggttcccgtcgccaacgatgatgacttttacacaaatcctgttgtaaaaggttactacaaaaaccatgtcaaaaggattctaacaagaatcaacacaatcactaaaacagcttatagagatgaaccgaccatcatggcttgggaactaattaacgaaccacgctgccaagttgattactctggcaagaccatcaatgcatgggttcaggagatggctccctatgtgaaatctattgacccgatgcacttattggaggttggaatggaaggattctatggagattccatcccggataggcaacaatacaaccctggtttccaagttggtacagactttgttagcaaccatctcattaaagaaattgactttgcaacaatccatgcttaccctgataattggctaacgggacaaaacgataccatgcaaatggcattcatgcaaaggtggatgacaagtcattgggaagactcaagaacaatcttgaagaagccattggtgtttacagaattcgggaaatcgaagaaagatccagggtatagtatccacgcaagagattcattcatgaatgttgtgtattcaagcatctatagttttgcacaaaatggaggaacatttgctgggggcttggtttggcaacttttggatgaaggaatggacccatatgatgatggatatgagatagttttatctcaaaacccttctacaagtagtgttatcagtcaacaatcttctaaaatggttgcacttgagcatattcattga

SEQ ID NO: 27608 - DNA, 1584 bp, Glycine max
  Peptide Sequence Number=SeqID_119293
atggctactgctgcagttattggactcagtggaggaaagaggctcttgagttcatcataccattactctgatattatagaaaagctttcttatggcagtgattttggatccacacactaccaaattgttcctacaaaatctttaatagttgccaagaagtcatccaactatactccaacttttccagcatcgaaccagcagaatcagtccattaaggctcttaaggagcatgttgatgatgcccctaccattgcggatccatggtttcagagttacaactctaatgacttagaggtggaaagctctgaaatgggttattctgtggaggctcttcttttgctgcagaagtcaatgctggaaaagcaatggaacctttcctttgaaagagaagtgcttactgaaaattcgagtaagggaaaaaaatgtaggaaagtggcggtgacttgttctggggtgtctgcaaggcaaagaagaatgaataccaagaggaagaccgctattaaaacttgtggtgctatgcagctgaagtccaaaatcagtccagagctgcttcaacaccgtttgaagggctacgtaaaaggtctagtgagtgaggaattgctctctcatgcagaagttgtaaacctatcggagaaaataaaagttgggctttccttagaggaacataaatccagctttcaacagcatatagctggtggtagaggtggaaatattgctgttaagaattgcattgggatggaaaaaagactgaaggaaaaactaggatgtgaaccctctgatgatcaaatggcaacttctttgaagatttctcgcactgaactacgagcaagaatgatagagtgctctctggcaagagaaaagttggctatgagcaatgtacgcttagttatgtctattgcccaaaagtatgataacctgggtgcagaaatgggtgaccttgttcagggtggcttgattggattactgcgtggtattgaaaagttcgattcttcaaaagggtttaagatttcaacttatgtttattggtggatacgtcagggtgtttcaagagctttagttgagaattcaagaacattaagattgcctgctcatttgcatgagagattatctctaatccgcaatgcaaagtttagactagaagagagaggcattactccaactattgataggattgcaaaataccttaacatgtctcaaaagaaagtcagaaatgctactgaggcaatcagcaaaattatctcgcttgatagagaagcattcccctctctgaatggtctacaaggagaaactcatcatagttatattgcagataatcgagtggagaacatcccatggaatggagtagacgagtgggcactaaaggatgaagtgaacagactcattaatgtgacccttgtggaacgagagagagaaattattcgactttattatggactggaaaaagaatgtcttacgtgggaagacataagcaaacggataggtttgtcaagagaaagagtaaggcaagttggacttgttgcattggagaaactaaaacatgctgcgaggaagagacaaatggaagccatgctattgaaacattaa

SEQ ID NO: 27609 - DNA, 1296 bp, Glycine max
  Peptide Sequence Number=SeqID_119294
atgtctccacaaacgccaactatcccacttttcattgtcctcgcttcattagtcttatgtaatggctattacttagaggaatcattttataaaacaaatgctaaacactaccctgtgcatgatgggagattgatcaagacaaaacacgagcattttggtctaataacaagggctaatagagctagccatcttacttctaggcctcgtggaacagttagtgttgatgactttggagccaaagcagatggaagtgatgacagcgaggcatttgggaaggcatggaatgaagcatgttctagaggggctatccttgtggtacctgaaaataggatctatcgtcttaagccaataatattttctggtccatgtcgacccaacactgcctttatgctctatggaacaatcgaggcatggtctcaaatgtcggcataccaagaagatagacaacattggattgtgtttgatagtgtttcaaatttcagagttggtggtggtggcacattcaatggcaaagggaaaaagtggtggcaaagctcctgcaaagtcaacactaaccttgccgtgactttctatcaatgcaacaatttgaaagtgacaaacctgaggtttaaagatgcaccgcaaatgcatgtggtctttgaaggatgcttcaatgttattgtttcgaatctcgtcatcagagcaccaggtgacagccccaacactgatggaattcatgtcgcagacacacaaaatattgtcataagtaacagtgacattgggacaggtgatgattgtatttcaataataagcgggtcccaaaacgtaagagccacagatattacctgcggacctggacatggaataagcattggaagcttgggagcagataactcggaagctgaagtctctaatgtggtagtgaacagagcaaccttaacaggaacgactaatggagtgagaataaagacttggcagggaggttctggttatgcaaggaacattaaatttttgaacatagcgatgcaaaatgtgacaaatcccataatcatagatcaatactactgtgatcaatcgaagccatgccaagagcaggactcagctgtgcaattaagcaatgtgttgtaccaaaacataaaaggaacaagtgcctcagaagtggctatcaaatttgactgcagccgagccgtcccttgcagacaaatttacgttcaggatgtgattttagaaccccaaggccatggtggcaccattgctacatgtgaacatgttagttatgtcaacagaggaaagttttttcctcaatgcactccatga

SEQ ID NO: 27610 - DNA, 1098 bp, Glycine max
  Peptide Sequence Number=SeqID_119295
atgggaaacagtcatcttcttggtaacagaggtcctcaactaattccttgccggttacagctgggaagatctgctgcaatcgacgtgtccagacgcgtggatgaaggaattaacgaggtatggactctgttatacaccataaaggaatcgtggtggaatttcttttataagtattcaactaattgtatgctcagcttgacaaaatatgttgacagtgacggtaatctctgcatggtaaagttgagcctggatgaaactgatgtgtattcaaactggggtgatttcagctttaccatacaaagaactggaacatccagttttcttcagatgcaccccaacatggtgtgggcggattttcaatccattatgtcgatgaagaccaacaacgccgttgatgcatgtggcgtctctacgcaaacggtactttacttgtataggagaggaaagagggggggtcttgttgttacggagtgcaagagaaatagaggggataaagaggctaatgcggtgaccatggcacactactttgctaacagtgacgatgacaaagatatcgggctttctgttgttgccaagattcgtgctgcattaaatggaaaattggatgtaactgttgaaggccctgagcaacaccctgctttttcactacttcacatgtttgatgaagttaatagaaccaggagttggaagcctgctattttctctcattgtgctgccaacattcgtggtgccagagaaccaggtaaccggcaaaatgtaagaataattgacaatggtgactgtgaaaagtacatggggggtcctattggttgtcacattgaaagatatgaggatcatagaaggcttgtgctctctgacagtgaagacatattaccacgtcgtgctcgtgcccaccggcaaaaggcaagaggaattgtcaatggtgcaaggctcatgggaaatgatcgccggtcaatgtttttgcagcccgaggacgacgacactgacgacggcgatggagttcgatttccacgatgtagtggcaacatcagtgttaacattgctcaagagcacaagttattcttccagcctgctgctaatccctttatcaacaagtaa

SEQ ID NO: 27611 - DNA, 369 bp, Glycine max
  Peptide Sequence Number=SeqID_119296
atgttgcgttacagtgggaagacttgtcttcttttccaatttgtattcaatgtagcactccactccaataacaacgtcatcttcatttgctaccgccttaggttggattccaaacccccttttctttctcagggtattgatccttcttctcatgtattccaccgtatacaaatgaagtacgtgaatgatgatcaagacattcgcaagtactttgctgccttccacctgtatgatgcattgcctgcagctgttcttattgatgatttcggagatttctttgacgacaatcaaaaagggtcttgcaagggttctcttgtcagatactcatactcaccagagagactccccaaggtttcacttcatctataa

SEQ ID NO: 27612 - DNA, 600 bp, Glycine max
  Peptide Sequence Number=SeqID_119297
atgagttggatgtcggtggatgagttcctggtgcagtgcaagaagtcaggagacgctgcctacgcctccttgcggtcgctgctggagcgcctagacaatcccgagacccgttctcaggctcggatctttctttcccaccttcagaagcgtttccccaccaaggactcctgcgagcgacatcacgggagaaacaaattgactatgatggtcattccaagcatttttctccccgaagactggtccttcacttttgacgaaggcattaatagacatccagactccattttcaaggagaggactgttgccgagttaggttgcggaaatggatggatttccattgccattgccgagaagtggttaccatacaaggtttatggccttgatatcaatcctagagcggtgaaggtttcctggataaacttatacttgaatgctttagatgaaaatggccacctaatctatgacgtggagaataaaactttgctggatagggtagagttccatgaatctgatcttctatcctattgcagggaaaaagacattcaacttgaaagaattgttggatgcttacctcagaatcaccaaaatgtttcatcctga

SEQ ID NO: 27613 - DNA, 702 bp, Glycine max
  Peptide Sequence Number=SeqID_119298
atgtcctatgagaaattcaatgtagacagcagaaactcggtatgcagaattgtccgctcctacctgctacactatggctatgaagatacattgaattcatttgatgtggctagtaaaagtactgttcctcctatatacatagctcaagaaagtggaattgatgagcaggaaataacatatgccttgaatcatagaaagactttacgacagctaatcaggaatggggacattgatgttgcatttggtaaattacgtgaatggtatccacagattgttgaggacaatacatcagctacatgttttctgcttcattgtcaaaaatttatcgaattagttcgggttggagcacttgaagaggctgtcaaatatggaaggatggaattgtcaagtttttatgacttgcctgtgtttaaggatttagttcaggactgtgttgctttgctggcatatgaacggcctctggaatcctccgtaggttatcttctaaaagactctcagcgtgaagttgtagctgacacagtaaatgccatgatattgtccacaaatcttaatatgaaagattcaaaacattgtttgcactcttatcttgagaggttacttagacagcttactgcttgctgcttagtgaggcgatccctgaatggagagcagggagaagctttccaacttcagagagtgcttagcagtagtagaagaggctag

SEQ ID NO: 27614 - DNA, 1029 bp, Glycine max
  Peptide Sequence Number=SeqID_119299
atgggtggaagttctattggtgatgactgggagctcacttcctcatctaacgagggtcggacagtggtcttagttggacgaactggcaatggcaagagtgcaacaggtaataccattcttggaaggaaggtcttcaagtcaagggctagctcctctgctgtatccacctcatgtgaattgcagacaacagaattaaacgacggacaaattgttaatgttattgacaccccaggattatttgatttgtctgtcggatctgagtttgttggtaaggaaattgtcaaatgcattgatttggccaaggatgggatccatgctgtcattgtagtgttctcggttagaacacgctttactgaggaagaagaaactgctcttcggagcttgcagacattatttggaagcaaaattgttgattacatgattgtggtcttcactggaggagatgaattggaagaaaatgctgagacacttgaggattatttaggccgtgaatgtccagagcctttaaaggatgaagggaagcgctttggacaagttcaacaacttctctcttttgtaaacacagttctatcacgtaatggtggacgaccttatacagatgagttatttacacaactgaagaagggagcaatggagctgcataaccaacaaagagaggttgattctttaaaaggatattcaaaaggagagatattgaagtttaaaaagcaaatgcagcaaacatatgatgaccaattaaagcgaattactgagatgcttgcctgtggctgtgccattattcttatgcattctactttttggtgttccaagcttgtacacttgaagaaggttgaatcaaagttgagggaggcaactatgaggcttgagcaacaattggcagaagagcaagctgcaagacttaaggcagaggagaatgcaatgttagctcaaatgagatcagatgatgaaatacgaaaactcagagaacatcttgagaaggcacatgaagaacttcgcaagcgaggtgaaggtcgttgtgccattctttga

SEQ ID NO: 27615 - DNA, 1242 bp, Glycine max
  Peptide Sequence Number=SeqID_119300
atggtttgcttgtgtactttgcagtcaccaacattaagtggagtatcttggtacaagttgtcttctgttgaaattggtcttcttactagtggatcattgtatggtgccttaattggctctgtgttggccttcaatgttgctgacttcttaggtagaagaaaggagctgattggatctgcagtagtttatcttgttggagcccttgtaacagcattagctcctaattttcctgtattggtgcttgggagacttgtatttggcacaggaattggactggcaggatatggaattggtagcttgttcgttgaaactgtagctgggtggcggtatatgtatggagttagtagtcctatggcaataatcatgggacttggaatgtggtggctcccagcttctcctagatggttacttttacgtgctatacaaggaaaaggggatgttcagaattcaaaagacatagtaattcgtagtttgtgccagcttcaaggtcaagcttttaatgattccattccttggcaagtagatgagattctggcagaactttcttatctaggtgaagaaaaagaagctacctttggagaactgttccaaggaaaatgcttgaaagccctctggattggtgcaggattggtcttgtttcagcagatcacagggcaacctagtgtgctctactatgctggatcaatctttcagagtgcaggattctctggagcatctgatgcaacccgagtctctattctccttggggtttttaagttgattatgactggagttgctgttgtcgttgttgataaacttggaagaaggcctttactacttgggggagtttcagggataggttatgccaatctgctaatcagtgctgcacggatggtgatctctttattctttctgggttcatattacattttcttggataatacaccagttgttgctgtagttggtctgctgttgtacgtaggcagttatcagatttcctttggtccaattggttggctaatgatagcagagattttccccttgcgcctaagaggtcgaggactaagtatagctgtactcgtcaattttggtgcaaatgccctggtgacatttgctttttccccactgaaggcattattgggagcaggaattttgttttacacatttggtgtaatagcggtgacatctcttgtattcatataccttgttataccagaaaccaaggggcttacactagaggagattgaggccaaatgcctctaa

SEQ ID NO: 27616 - DNA, 2214 bp, Glycine max
  Peptide Sequence Number=SeqID_119301
atgaacacggacggtgacatgaagaagaagcaccgtaggaagaggaagacgaacaagaatggtggtcgtaggaataggaacaagaagaagaaggatgcatgcgatgaccgcagaaacaagaacaacaagaagaagttcgttacaaacacaaacgccggcctcacccttccttactctccgtttctcaatctcgccgccggcggaactgcttcatctctccggggaacgcaaccgaattcttttccaatgacagagaatctgaaagcgccgaagcttcccgtcgaaggaaagcgcaacattctcatcaccagtgccttgccttacgtcaacaatgttcctcacctcggcaacatcattggatgcgtgttgagtgctgatgtgtttgctcgctactgtcggcttcgcggttataacgctatttacatctgcggtactgatgagtatggaaccgccactgagactaaagccatggaagaaaactgctctcccaaagagatttgtgacaaataccatgctattcataaggaggtctacaattggttcaatataagttttgatgaatttgggcggacgtcatcccctgagcaaactgaagtttgccaagcaattttcagaaagatattcgaaaacaagtggctatccgagaacacaatgcagcagctttactgcaacacctgtgaaaggttcttggctgataggcttgtggagggaacctgcccgactcctggctgcgagtatgattctgcccgaggagaccagtgtgagaagtgtggaaagcttctaaatccaacagaattgaaaaatcccggatgcaaggtttgtcagaaaactcctcgtattcgtgatacagatcacttgtttcttgaactccccctattgaaagatagattggaaaaatacatcagtgagatgtctgtggttggtggatggagtcaaaatgctatccaaacaacaaattcatggcttagagaagggttaaagccacgctgtattacaagggatctaaagtggggggttccggttccacatgaaaaatacagtgacaaggttttctatgtatggtttgatgcacctattggatatgtctcaatcacttcgtgctacacacgtgattgggagaaatggtggaaaaacccagagaatgtggagctgtatcagtttatgggcaaggacaatgtgccattccatactgtgatgtttccatctactctacttggaactagtgaaaattggactttaatgaagactattagtgttactgaatacttgaattatgaagcagctcacatgggttacaagttaatccaaaaagggcctaatgatgcatataaccagacggggaagttttctaagagcaaaggtatcggagtttttggtaatgatgcgaaagatactaatattccagttgaagtatggagatattacttgctcactaataggccggaggtatcagatacgttatttacgtggtcggacttgcaagctaaattaaatagtgagttattgaataatttgggcaactttatcaaccgagttttgagttttattgccaaacctgcagggcaaggatatgattccattatcccctctgttcctgatgatgtaagtggtgactcccatggtccgaccaaaaaattggctgataaagttgctgcatatatagaccaatacatagaagcaatggagaaggttaaactaaagcaagggttgaaagtcgcaatgagcatatccagcgagggaaatgcatatctgcaggaagctgaattctggcgcctctacaaggaaaacaaatctctctgctcccttgtcatgaaaactgcagctgggattgtatatcttcttgcttgtttgttagaaccttttattccatctttcactcttgaagtatttaagcagctaaatttgcctgtggatacacatgtttcactttgtgacgataaaggagacattgatagggtaaaaagaccctgggatatcataagtgctagtcataaaattggaacacccaagccattgttcagggaactgaaagatgaagaggtgaagttctacaggaagaagttcgcaggaagtcaagctgataggattgtgcgtgcagaggccgaagctcagaatgttgctgagcaactgaagaaaacgaaagtttcaggtgtttttcccggctcttccatttctaacaagtttaaagaagttggcaggaagtcaagtcgttag

SEQ ID NO: 27617 - DNA, 990 bp, Glycine max
  Peptide Sequence Number=SeqID_119302
atggagacggaatcacatgaagatttacagcacccgtcggtttcttcgaatgacacgcacagtgatgatgcgtcgaaccacagagacgctgagcaaaagcaagatgtttcgagggaagaagttgtgcagattctacaagttattgcatctacggggaggttctgtctaagacaagggtgtgtgggagggaggtacttgatgtgggttttaactttgcacactttgaggccaaagggtgttgagattgcagctgtcagcctgtcacagcagcaaatcacaactggaattgcagccatcctggctgctccagtgaacagcagccacctctctatatccactgcaccctacagtgcttcttggggttggttgtgctgcatggctttctgggattcattactatggccaaacttaatgatagttgacttgaacatggatctgtatattcaaagggctaatgtggtgaaatttttgaatgacaggcatgactgggataagttgaagagtatgctatcatttcagctgaagcaggtactgtcagaatatcctgaggcaagaatgacaagtgagcagcagtacgcgtcatttggtgaatcctacattgagttggtcaacaaattggatgaaggtatcttaatcaatagttccatagccaagatcctattggatgcaaaaggcctttatccaaatctttcaaagcttgctttagctcttgaaaagaacttgttagttacatctacattgacaatctgcactgatccatacccacaagctacagccaaagagctagatgaccaagagaagccaagtgaaaagcagcagcaacagcaacaatccgatagtgcagaaaatggcgttgagcttctggtgtctgacaaagacgaagtaatgaccgaggctgatgtaggtgatgatatgaccattggcatggaagcttttgaaggcgttaaatcatcagaaacaaattccgagctgaatgctaatagtgcataa

SEQ ID NO: 27618 - DNA, 546 bp, Glycine max
  Peptide Sequence Number=SeqID_119303
atggagaaaaaggttctgatattgtgctgtgttgtggccttcttggggctgttgtcggctgcaactagcttcggtgctgaagcgacaaggattaaggtttctcaggttcattttgttgcaccaaaccagtgcacatatcctcgaagtccggctctgcctcttggtttaaccgcagcactggctcttatgctatctcagataatcataaatgttggaactgggctcacatttgtaattggttttctcctattgctgactggcgctgcactgaatgatcaacgcggtgaagagagtgtatactttggctactactactgctatgttgtgaaacctggagtgttcacggggggtgcaattttatcccttgcaagtgctgcatttggcattttgtattacatttccttaactgaaagaaagaatggtagccaatacccatatcctaatcaaggggtcatagccatggcacaaccgcagatcccatctcagactagtcaagaacctgtatttgtgcatgaagacacatacgtcagacgacagttcacatga

SEQ ID NO: 27619 - DNA, 1257 bp, Glycine max
  Peptide Sequence Number=SeqID_119304
atgagtgacaatttgatgggaaaagtcaacgctttgggggagcgtctcaaaattggtggggctgaggtgggtcggaagatgagtgctggcatgagttctgtgagcttcaaggtcaaggaatttttccaagattcaagccatgctggtaaactcgttggggaagctacctctgaggccctacatgagcctgattgggctacaattcttcatatatgtgacttgatcaatgctgatcaacttaacactgctgaattggtacgtgcaattaagaaaagggtcgtggccaagagtcctagaggtcagtatctggctttggttttgcttgaagcgttggtcaagaactgtgacaaggctttcttggaggtggcaactgagagagtccttgatgagatggtcaagctcattgatgaccctcagactattcttaataaccggaataaggctttgataatgattgaggcatggggagagtcaaccattgagcttcgctatctgcctgtctatgcagaaacttacaagagtttgaaatcaaggggtattcgattccctggccgtgacaacgaaagcttggctcctatatttactcctcctcactctgccattactccagaggctgatgtcagttttgcagatcttattcagtatgatattcatgggcaaagcttaacctctgttactcctcctcgttctgccactactccagaggctgatgtcagtcttgcacatcttatgccgcaagatattcatatgcaaagttttaagtctgaacaaataaaggaaacatttgatgtcgcgagaaatagcattgagcttctttctactgtgttgtcttctacaatgcagcagaatgtgttgaaggatgagttgaccaccacattagtacaacagtgccgtcagtcccagactagtgtccatagaatcgttgagactgcttgggataatgaagcagtgcttgttgaggccttgaatgttaacgatgagattcagaaggttttctccaaatatgaagagctgaagaaggagcagaaggagcctaccgttgttccatttgaagctgaaccggttgttaccaaagaggaagcactgattagaaagccaggttcaagaattggagtccatggagggagccacgatgacatgttggatgatcttgatgagatgatttttgggaaaaagggtagggatgatgcatttgaaggagggcaacatccaaagaaacaacaatcatcatcaaaagatgacctcatctccttctaa

SEQ ID NO: 27620 - DNA, 667 bp, Glycine max
  Peptide Sequence Number=SeqID_119305
gaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccgtcttctcgctgatgatctcttcctcgcaaaggttgctatggaatgcggcgttggcgtcttcaccaagactgctgctgagtacgaaaaaagaagagaaaactttttcaatgagctcgaaattgtcttcgctgatgtggctatggccataattgcagatttcatgttggtttatcttcctgctcctaccgtagcgcttagaccgccacttgcactcactgcagggcctattgctaagtttttccatggctgcccggataatgcatttcaggttgcactatctggagcatcatattccttgatacagagggttggtgctattgtgcgtaatggggctaagctttttgcagttggaactgcttcatccctggttgggacagctatgacaaatgccttcattaatgcaaagaaggcagttaacaagacttctgaaggggaaattgagaatgttcccatattgtcaaccagtgctgcttatggtgtctatatggcagtttctagcaacctcaggtaa

SEQ ID NO: 27621 - DNA, 1557 bp, Glycine max
  Peptide Sequence Number=SeqID_119306
atgactcttcctccatccttatcggagccgccctcactctccgactcattctcgccgttaaacccagccctagccatggatagtcttcaagccacttacaaagacgaagaagatgaagaagacgagccgcagcctcaaccaccaccaaccaccgccgattcacctgaagcccctcccgccaccaccagcacaccctccgacaccccaaccgaacccccgaacgacgcccgatcggagcccgagccctccgaagatctctccgaggacgaggccgcctccgacggctccaagaaatcccccaaatccggccgcgaagaaggcgacgcctccgacgaggacccaccgccgaagaagcagaagcagctctcctctctgacggaggcaacgaaggaggacttggtagcgccgcaggatggcaccaacaacgcggcggcgacgccggcaacaaatggcgcggcgccgaagaaatcgaaaaagaaaaacaacaacgtgtgggcgacgaagtcgacgcggaaggggaagaagaaaacgaatcggaacaacaacaacaacaacagcaacaacaacaacaaccacaaccaccacgcgaacggcgaggacaacgtgctgataacgccggtgccgcggttcccggacaagagcgacgacacggaggacatgaagatttgcctctcgaaggtgtacaaagcggagaaggtggaattgagcgaggacagaatgagcgcggggagcaccaagggttacagaatggttagggccacgcgcggggtggtggaaggcgcgtggtactttgagattagggttgtgaagttgggagagagtgggcacacgcgcctcgggtggtcgactgagaagggtgatttgcaggcgccggttgggtacgacgggaatagctttgggtatagggatattgatgggagtaagattcataaggctcttagggagaagtatggagaggaagggtacaaggaaggggatgttattggtttctatatcaatttgcctggtggggaacagtatgcccctaaatcatctcaattggtttggtataagggccagagatatgtttatgcacaagattctaaggaagatccacccaaactagtgcctggtcagttctcaactttgctttgcttcaatggttctctgggttgtttgattgtgattgagttattgattccattttgtgtctacattctaaagtatgtgaaactgaatgttgccaagataccaatcagtattgtcaatgataagtggtgggctcatagacatgcaatggatggaagtgagatatcattctttaaaaatggcatatgccaaggtgtagctttcaaggatcttcacggtggtcgttactatcctgctgcttcaatgtttactctccccaatgaaccaaactgcacggtgaagttcaactttggtcccgactttgagtgttttcctgaggatttcaatgaacggccaattcccaggccaatgagtgaagttccttatcttggttttgacaataaagttgaaaatgaagagtctaacgagaagaaatcccagaaagagtga

SEQ ID NO: 27622 - DNA, 1200 bp, Glycine max
  Peptide Sequence Number=SeqID_119307
atggaggacattgaggatttgctgattggaagtgcaactccaccgggctttcgtttgccattagcagcggctgttggcgtggggacaaagcggaatcaactctcttcttcttcgctttcgccttcacctgcaatccctggcactcagagtgacagtgaatatatggctggtcagctttctgcttttggctattcattgagcgatgatcctgaccatgcagatctctggctcatcaacacttgcacggtcaaatccccaagtcaatctgctatggataccatcatatcgaaaggaaaatcttcaaataaaccactagttgttgctggttgtgtccctcaaggaagtcgggatttgaaagagctcgaaggaatcagcatagttggagtccagcaaatcgatcgtgttgttgaaattgtagaggagactttaaaaggtcatgaagtgcgtcttttgacccgtaagaaattgccagcacttgaccttccaaaggtaaggaagaacaagtttgttgagattcttcctattaatgttggttgtttaggtgcttgcacttattgcaagacaaagcatgctcggggtcacctaggaagttacacaattgatagccttgttgggcgtgtaaaatctgtcatatctgaaggggttaaagagatatggcttagcagtgaagacactggagcatatggtcgtgacattggtgtcaatcttccaacattattgaatgccttagtagcagaactaccagctgatgcaagcacaatgttgcgtattggaatgactaatccaccatatatacttgaacacttgaaggagattgctgagattttgcgccatccatgtgtttactcttttctgcatgtaccggttcaatctggaagtgataccattttgagtgcaatgaatcgagaatatactgtgagcgagttcaggactgttgtagatactctaactgagcttgtgccagagatgcagattgccactgatataatatgtggatttcctggtgaaactgatgaagattttttgcaaactatcaaccttattaaagagtacaagttacctcaagttcatatttcacaattttatcctcgaccaggggtgtggggggtagttgctgccttaccagttgcaaccatgcttgtaaggttctgtatttctgaccgtcccaaaccccacacttgtgacagccttgtaaactga

SEQ ID NO: 27623 - DNA, 2124 bp, Glycine max
  Peptide Sequence Number=SeqID_119308
atgtgtcttttcaaaaagttttttctgaaattcttcactgtgttttctgaagtgccgttgctggcaaagggtagactggttaaatctggagcttttacacattcttatccattctgctggagatctcagacccctcttatctacagagctgttccaagctggtttgttagagtggagtcgttgaaagagaaattgttggaaaacaacaagaagacctactgggtccctgattttgtcaagggaagaatacaataccaggacaacatcatcctaatgcgagaaactgataagcgatttcacaattggctggaaaatgcaagagattgggcaattagtcgtagtaggttttgggggactcctctccctttatggattagtgaggatgaggaggaagtagttgtcatagattctgttgcaaaacttgaagaactttcaggtgtaaaggtgtttgaccttcatcgccacaacattgatcatattacaattaagtctgacagtggccgtgtacttcgacgtgttgatgatgtgtttgactgctggtttgagagtgggtccatgccatatgcatatatccattatccttttgaaaatgttgagctttttgagaagaattttcctggccattttgttgctgaagggctggatcaaacacgtggttggttttatacccttatggtgctggctactgctttatttggcaagcctgcgtttaggaatctaatctgcaatggacttgtcctggctgaagatgggaaaaagatgagtaaaagtttgaaaaattatccttcaccgatggaagttattaatgattatggagcagatgccttgcgattgtaccttatcaactctcctgttgtgcgtgctgagccacttcgtttcaagaaagaaggagtttatggtgttgttagggatgttttcctcccttggtataatgcatatcggttccttgttcaaaatgcaaagaggcttgaagttgaaggtctagcaccttttgtcccctttgatcatgccacacttctgaactcaacgaatgttcttgatcaatggattaactcagccacccaaagccttattcattttgtccgacaagaaatggatggttatcgcctttacacggtggttccttatcttctgaagtttcttgataaccttacaaatatttatgtaaggttcaatcgtaagagacttaaaggtcgttctggggaagaagactgcaggatagcactatcaactctttacaattattaccagaaaatgatggtgcttttgttatcctgtaaagttatggctccctttacacctttcttcactgaggtgctctatcaaaatatgcgaaaagtttctaatggatcagaggaaagcatacactattgcagttttcctacagaagaaggaaggaggggagaacgaattgagcagagtgtttcaaggatgatgacaataattgatctggcgagaaacattcgtgagcggcacaacaagcctcttaagactccactaagggagatggttatagttcatcccgatgcagacttccttgatgacataaatggaaaattgaaggagtatgtgctggaggaactcaatgtacgatcccttgtaccatgtaatgatactttaaaatatgcatctttacgcgctgagcctgaatttagtgttttaggtaagagactaggaaaatcaatgggcattgttgccaaagaaatcaaagcaatgtcacaggaaaatattttggcttttgagaatgctggagaagtcgtcattgcaaatcagtgtttgaagctgactgatattaaggttctccgtgattttaaacgacctgatggtatgactgagaaggaggttgatgctgctggagatggtgatgttctggtgatattggacttacgtcctgatgagtcattgtttgaggctggtgctgctcgagagattgttaataggattcagaagttacggaagaaagttgctcttgaaccaactgacatggtggaggtttactttgaatcattagatgatgacaaatcggtctctcatagagtcttgcattcacagcattgccggacagcaactttgtttttgcaaattcctattcttattctatcagcatgcaaattgagaaagtga

SEQ ID NO: 27624 - DNA, 1368 bp, Glycine max
  Peptide Sequence Number=SeqID_119309
atggtgctaagttcgtgtgcattacttggaatctgggtcaaaattcacccagtggaatctagagatggtgctatgatgagcatccgcagtgcacttactgctatcatttcatttatgaagagaaagactgagaaaggaacatattatgcactagatcttgggggtactaattttcgggttttgcgggttcatttgcatggtcaacaatcttctgttttggaacatgaagtagagcgacagcccattcctcaaaatctaatgaccagcacaagtgaggatctctttgatttcattgcttcttcattaaaggaattcattgagaaagaaggagacggttccgagctttcaccggacagaagaagggaacttggattcacattttctttccctgtgaaacaaatgtctgtttcctctggcattttattaaaatggacaaaagggttttccattgtagatttggtaggaatagatgttcctgcatgtttgcaggaagcattgacaagaaaaggactagacgtgcgggtggctgcattggtcaatgatactgttggaacattagctcttggacattatcatgactcagatactgttgcttctgtaataattggcactggtaccaatgcttgctatttggaacgggttgatgctattatcaagtgtcaaggtcttcctacaacatcaggatacatggttgtaaatatggaatggggaaacttttggtcatctcatttaccaagaacatcttatgatattgatttagactctgaaagccctaatccaaatgatcagggttttgagaaaatgatatctggaatgtatcttggtgacatcgtgaggagagtcattctaaggatgtcgctagagtcagatatgcttggacctatttcttccaaactttcaatgccctttatgctgaggactcctatgatggctgccatgcacgaggatgattctcccgacttgagagaagtagcaagaatccttaaaggcatccttgagattcctgatgttcctttaaagttaagaaaagttgtggtgaaggtgtgtgatgtggtgactcgcagagcggcacgattggcagctgccggcattgttggtatcttgaagaagattggtagggatgggagtggtggcatcgcaggtgggcgaagaagtgatatgaaaatgaaaagaacagttgtagcaattgaaggaggtttgtattctagctatacattgtttagggactacttgcatgaagctttgaacgatatattgggggaagatattgccaggcatgtaattcttaaggtcactgaagatggatcaggcgttggagctgcactgcttgctgcctcgcattcatcatatgatgtagatacagtatag

SEQ ID NO: 27625 - DNA, 1095 bp, Glycine max
  Peptide Sequence Number=SeqID_119310
atggaggataagaaaacatccctgatgggagaaattgagcatgaggacacaactctcgaggaggacgtgagccctaacacaaatctacctgtaccaacaaggaagggcactatggcggtgttcaaattgacactagaagggtggaagatatcctcgagaattgcacaatccataggagtttgctatggagtgattggtgataatctaccatcaaggcaagaagttgtggacttatataaaacaaatggcattggtagaatgcgtatatactacccagatgaagaagcactccaagcccttagaggttcaggcattgagttgattatggacgtggctaaggaaacccttcaatcattgacagactccaatgctgctacagattgggtcaataaatatgttacaccttactcgcaagacgtcaatttcaagtacatcgctgttggaaatgaaattcatcccaataccaatgaggcacaatatattctatctgccatgaccaacattcagaatgcaatttcatcagcaaatttacaaattaaggtgtcaacagctatagactctactttgattactaactcttaccctcccaatgatggcgttttcactagcgatgcggagccatacataaaacccataatcaacttcctagtgagcaatggggccccacttcttgccaacgtgtacccttactttgcttatgcaaatgatcaaagcattcctcttgcctatgctctttttacccaacaaggaaacaacgacgttgggtaccaaaacctctttgatgctatgttggattcaatatatgctgctttggagaaagtgggagcgtccaatttgcagatagtggtttctgagagtgggtggccatctgaaggtggagctggagcctcaattgataatgcaggcacttactatgctaatttgattcgtcatgcctcgagtgggaatggaactccaaagaggcctggtgagtctatagagacttacttgttcgccatgtttgacgaaaaccagaagcaaggtgctgatactgagcgtcattttggtctcttcaatcctgataaatcacctaaataccaacttagtttcaactaa

SEQ ID NO: 27626 - DNA, 963 bp, Glycine max
  Peptide Sequence Number=SeqID_119311
atgggaggaagaatgcacacgaaatcagactcggaggtgacgagcaacagcatggagcagtcgtcgccggcgcgttctcctccgcggcggccactctactacgtccagagtccttcaaaccacgacgtggagaaaatgtcctacggctcaagccccatgggttccccacaccaccatttccactactacctctcttcccccatccatcactctcgcgaatcctccacctctcgcttctccgcttccctcaaaaaccctcgcaacttctcctcctcctcctcctggaagaagctccaccctcaccccaaccgcgacgttgaccccgacgaccatgacgacgccgaccaccacctcaagcagtcctcccgcaacctccgcttgtacttgtggttcttcctcctctttcttctccttttgaccctcttctctttcatcctctgggccgccagcaagacctacaagcctcgaatcattgtcaagagtatagtgttggagaacttgtatgttcagtcaggaaacgatggaactggggtaccaactgatatgttgtcgttgaactcaacggtcagaatattgtacagaaatcctgccactttcttcggcgttcatgtcacttctacccctcttctcattagctattaccagcttgcaattgcctctggccagttagcatcaaggccattgagagctagagtccgaatagctgcagctaccaaaagagcactgagaagcatccctacagaaccgagtgcaacgttgaagcagcaaattatacctcttggacgaggtttcttgagggataaccacatgaaacaggggtatgcatatgtgataggcacaagggtcatgcttccaagtagtgttgatagtcttggaaggaaagggaacgtgactgagataaaaaatgtcagccccccgaagaataatcttatgcatgttctcactaatggtgaacatctctga

SEQ ID NO: 27627 - DNA, 942 bp, Glycine max
  Peptide Sequence Number=SeqID_119312
atgataaattacaaggccttggccactagctgcattcagaatgagaaggcaaagttcttgtggggacagggcaaagtgttgaatgaattcacccatgggaagcaggaaaaagtgagcaagagtgagttcaaagaggttctctcagacattctattgggtatggctgctggactgaagcgtgaccctattgtgatacttcgcattgatggggaagatcttctggagtttgttaatggttcaggttatgaagctgaaatggtatccatattctctcaaattgagtcccctgacagatcacttcatgaccatataattgaagctcttggcaagctcactgttgagcaaggaattcctcctacatcagattcttgggtattgagcaacattgtggaaccggcactgctatctcaagatggctctgatttggataagcctgtttctcaagagacatttttggaggaatttaagatagtcgcaatgagtgtggctaatcatcttaaggaacaacctgtcatagttgctcacagtgagaacacctttgatggaagtggtgttaagagactattatccaacaagtttgaattggacaagactttgagctcagctatagagactttgcccaaagatcgaaatggaaagctttcaaaggagtatctaagggtgacattagacacggtggctccatctgctggtttacctcctgttggtgcaattgaagagatggacaaggttattggtgaagtctttaagatggtgaatgcagatgatgcgaaggtggtgaaagaagacgagttcaagaaactattaactgaaatactggggagcataatgttgcagttggagggaaatcccatatcagtttcttcaaattcggtagtgcacgagccactagactcatcttctacacttctgcagccatcccctagtgaaacagcagcatag

SEQ ID NO: 27628 - DNA, 753 bp, Glycine max
  Peptide Sequence Number=SeqID_119313
atggcctgcatcgacaaattttgggttttcgccctcgctcttctcctcctcgcttcccctctcctccaagttgctaggtgccagtcagactctgatgatgtagtggaggctgctgaagaatcaggtgatattggcattgttggtgatgatgtccaagactttggtgatgggactttcccttctgctccaggaattgaaacaataagtgtatttccgaaaaatagtgcaagattgataacagctggagaagagtcagagctgcttgttggtgttaaaaatgatggggattcaagcttgaatgttattgcgatcaaggctagtgttcaccttccttttgatcaccgtatgctggttcaaaatcttactgcacagggttttaacaatggtatctccactgctctaaaggccaatgcttttagtttctcatctggaacttttgaccttgtgggcactatcatatacgagatagatgaacatccattccaaagcaccttttttaatggcactgttgaagttgttgaatctggtgcttttctaagcatggaatctgtttttcttgttactcttggggttgcactccttgtcctcctggggctatggattcatggtcaaatacaacacctatctaagaaaacaaagagggcgccaaaagttgaagttgggactaggactactgatgcttcaacagatgaatggctgcagggaactgcatatactcagtctatgtcaagcaagtcaaagaagaagaagtag

SEQ ID NO: 27629 - DNA, 498 bp, Glycine max
  Peptide Sequence Number=SeqID_119314
atgggtggagccactggtggcgccgctgcgattcttggaggtcgtcatcatcgtcttgaactcctcgaagttgatgcaaccggcgtcatcgccgtcgacggacttgatcatgtcgcgacattcgtcgaggaagcacttgaggtcgaggcggttgagcgcgaggtggagcttcgcagcggagatgaggccgtttttgttgcggtcgtagagatcgaaggcgttgtggaactcgccagatccaccgtcggcagaggcgttggagcgacagaaagcggcgaactccgtgaggctgatgaagccgtcgtggtcggtgtcgaggtcttccatgacgcagtgaaggtcctccagagagacgtcgaatccgagcgatcagagcacgctgtcgagctcgtcggcggagatcttaccgtcgccgttggcgtcgaagcggttgaagactgtctcgagttcgttcatgtcttcgaagtacgaaaagaacttacttttgagaatttgtaa

SEQ ID NO: 27630 - DNA, 732 bp, Glycine max
  Peptide Sequence Number=SeqID_119315
atggcctcaactacactaacaaccctctccctccgcaacctctcttatcctacaccctcctcctcttcttaccctacgcacctctccgccaacccctcctccctccaattccccaacttctcccaccgcgccaccaccacgcgccgcgcccgcgtcgtcgtcgtctccgccgtcgaggcaccggagaaaatcaccaagctcggcgacgaaatcgcgggactcacgctcgaggaagccaagaacctcgtcgacttcctccaggacaagctcggcgtctccgcggcagcgttcgcccccgtagccgtcgccgcgggtgccgtcggcgccgtggcggacgctccggcggcggtggaggagaagacggagttcgacgtgttgatcgaggaggtgccgagcaacgcgagaatcgcggtgattaaggcggtgagggcgctgactaacctggcgctgaaagaggcgaaggagttgatagaagggttgccgaagaagttcaaggaagggatttcgaaggacgaagctgaagatgcgaagaagcaacttgaagaagccggtgccaaggtgtttgttgaaatggaggtgaagggttttaaattgctgaattggaaattggaaattggaaacatggaactagcaactaggaagctactcaatttctttgtttcactctcctcgttcattcttttccatttgcactatcgtgctttactctgtgcttcgggactttggttctga

SEQ ID NO: 27631 - DNA, 1197 bp, Glycine max
  Peptide Sequence Number=SeqID_119316
atgactcagttcctcaactccgtcctctcccagcgcggcccctccgcggtcccttattccgaggacaccaagtggctcatccgccagcacctcgtggcgctcaccaccgccttcccttccctcgagcccaaaacggcgtcgttcacccacaacgacggccgttccgtcaacctcctccaggccgacggcaccatcccgatgacgttccaaggcgtcacctacaacatccccgtcgtcatctggctcatggaatcctacccccgccacccgccctgcgtctacgtgaatcccacgcgcgacatgatcatcaagcgccctcaccctcacgttaacccctctggtttggtttccgtgccttatttgcagaattggacttaccctagttccaacctcgtcgatctcattctcaatctcagcctccacttcggccgcgaccctcctctttattcccaacgcagacctaaccctaaccccaaccccaatccccatcctcctcccaattacggaaattctccctctaatttatcatcttcatcttcatcttcatctggctatccccatgcccatgcccatgcccaccctcctccgaggacttaccctccttctccttaccctgcctcttcttctagggttcagtcctctgaggatccttctgaggttttcaagcgcaacgcgattaacaagcttgtggagatggttcatggagatgttgccgcgttgaggaagacccgggagggtgaaatggaggagctgtttagtttgcagggtgtgctgaaacaacgcgaggagagtctcaacaagggtgtgaaggagatgcaggaggagatggaggctttggagcagcagttgcagatggtgttgatgaatactgatgttttggaggggtggctgagggataatcaggggaagaagatggccggtttggagaatcccgaggacgcttttgagtgtgcggatgtgctctcgaagcagatgcttgactgtactgctgctgatttggcgattgaggatacgctttatgcgttggataaggcgcttcaggtgggtgctgtgccatttgatcagtacttgaggagtgtgagggcgctgtccagggagcagttctttcatcgtgccaccgccacgaaagttagggctgctcagttgcaggctcaggttgcgaatatggctgcccggagtccgcattatggtagctaa

SEQ ID NO: 27632 - DNA, 933 bp, Glycine max
  Peptide Sequence Number=SeqID_119317
atggagggaaccgcaacagggtgttacaagtgcggcagacctggtcactggtcacgggattgccctttctccgctcccaattccaatcctaaccctaaccctaaccctaaccctaaccccgccaccactcccaatccaaatactccaaatccttcttcctcttctttcaagcccagattcgccgccgaaaagcccaagaaactcccccgaacaaagcccaagctcacaccggagcttcttctctccgacgagggtctcggttacgtcctccgctacttccctcgcgagttcaaataccgtggtggtggccacgaggttcgcgatttgggtaacctgcttcgtctgtacaccgaatggcactctcgcttgctcccttattactctttcaatcagtttgttcacaaagtggagaaagttgctgctacaaggcgtgtaaagacttgccttagagaattgagagaaagagttgcaagtggtggagatccaacaaaactgcgtgaaccacctgttgtgcatgacattccatctgatgagcacggatatgttgtatctgcagaagatgggggagcaactcatcaagagacagatgtgtttgcagaatccgaaaatgttaatgacattcaagaagacatgcttaatgatatatatgataaagctactgaagaacatgctcagtccatgcacaatgttattggtactaacaaggcttcagaaagtagcgcagctgaaaagacatcagaggaagttcaatataatggatccagccagtctggcaaagctgagataacagaagagcagagggctcgtatggaagcaaataggttgaaggcactagaaaggcgagctgagataacagaagagcagagagctcgtatggaagccaataggttaaaggcactagaaaggcgtgctgccttatcacaagcctcctaa

SEQ ID NO: 27633 - DNA, 261 bp, Glycine max
  Peptide Sequence Number=SeqID_119318
atgtctaagaaaacagaggggactaatagcaagacgtcatccacgatgactattcatgagacttcctttccaacaatttctgtcaagttggatgggactaactatggtgtttggtctcaacttttggagatgtacattgcaagacaaaaggttgtgcgcattgagaccgatccaaactatgatgaatggggggctgaagatgcactggcaaattttgatccaaggcaaaagatcgagcaagagattataagatggtcctag

SEQ ID NO: 27634 - DNA, 241 bp, Glycine max
  Peptide Sequence Number=SeqID_119319
gcatctgaacacaacccttacctcttggagcagcaacaatattagggttaggtgttttcgttctcacaaaaaccctacccttcaccggagacgggtcagagcacaggttgggaaatgtccacgacgagcttgtggaggtcagggcagggtgaagggcgagagtgagatgtatggaggtcacggcaaggtgaagggtgaagggcgaaagggcatgcgcgtaccaagactgaagcataaataa

SEQ ID NO: 27635 - DNA, 1167 bp, Glycine max
  Peptide Sequence Number=SeqID_119320
atgtcaagatcatgcattcctgcatcacaaaagattgcagatgctggtgccgtggttcttggcggcaagtccaagattggatcgtggaataaacttgcaagtgcatgtcatattgcatcagtgcaacctttcaggcggggcttcacttcatcgtccataaaatctgttaaaagtgacacaaaggccttgtttgagttcagtgcacaaagtgcagactcaggattgtcaattgatctgaaaggtaaaagggcttttattgctggtgttgctgatgacaatggatatggatgggcaattgcaaaagctcttgctgcagcaggagctgagatccttgttggcacatgggtacctgccctgaatatttttgagtccagcctacggcgtggaaagtttgacatatcacgcatattaccagatggctcgatgatggagattaccaaagtttatccattggatgcagtttttgacaatcccgatgatgtgcctgaagatataaaaacaaacaagcgctatgccggatcatctaaatggacggttcaggaagttgctgaatctgttaaggaagactttggcagtatagatatccttgtgcactcacttgccaatggaccagaggtgaccaaaccattgttggagacatctcggaatgggtatcttgctgcaatatctgcatctagttactcatatgtttctttactcaagcattttcttccaatcttgaacccaggcatgcctcttatcttattaccgggtggatcttcaatatctctgacatacattgcttcagaaaggatcattcctggatatggtggtggtatgagttctgcaaaagctgcactggagagtgatacacgagttcttgcttttgaagcaggaagaaagcgcaaaattagagtcaatactatatccgctggtccactgagaagtcgagctgcaaaagctattggatttattgatatgatgattgattactcatcagccaatgcacctctacagaaagaagtattagcagaggaggtgggctacacagctgccttcttagcatcacctttggcatctgctatcactggtactgttctatatgttgacaatggtctgaatgctatgggtgttggagttgacagtccaatatttaaagatcttaacattcccaaggaccagcattaa

SEQ ID NO: 27636 - DNA, 1437 bp, Glycine max
  Peptide Sequence Number=SeqID_119321
atggatgctgaaacaagtagtcaatatatgctaacagggcagcctctttctctgaagcatttaactgagggaattaaaggggacaagacatcagaagatgatgaaattaacaagctcttctccaatgttttgagtatacttccacctaaggatgagaatctgctggcaacattcaagaaacaacttgaggaagataagaaaattgtgacttcacgtagtaatttgaatgcattacggaaggttctcgaagaacatcagctatcctgcatggaccttttgcttgtaaatactgatagcatcattttgacaaagcataaagctgaaaaagtggtaggctgggcaaaaaatcattacttgtcatcatgcttgcttccttctattaaaggagaaagattgtacctacctcgtgaaagtctcaagattgaagggccaggaaactatgtcacggaagccttctcaaagcctcaaggcattgtgcggaggaaccttgcaaaggatgagtttgagagcaatttcatttcagctgtagtacctcctggtgaaattggggtgaaatttgatgacataggtgctcttgaagatgtgaaaaaggcacttaatgaactcgttattcttccaatgagaaggccagagcttttctctcgtggaaatctgttgcggccctgtaaaggaattttactttttggtcctcctggcactgggaaaacccttctggccaaggcacttgcaactgaagctggtgcaaattttatcagcataactggttcgacccttacttcaaagtggttcggagatgctgaaaaactaaccaaagctcttttctcatttgccagcaagcttgctcctgtcattgtatttgtcgatgaggttgacagtttgcttggtgctcgaggtggtgcttttgagcatgaggccactagaagaatgaggaacgagtttatggcagcttgggatggattgaggtcaaaagaaaaccaaagaatccttattctaggtgcaacaaaccggccatttgaccttgatgatgctgttattcgtcgcttaccaagaaggatatatgttgatttaccggatgctgaaaaccgaatgaagattttaagaatctttcttgcacaagaaaatttgaattttgattttcagtttgacaaacttgcaaacttcactgatggatactctggcagtgatttgaagaacctctgtattgctgcggcatatagacctgttcaagaactcttagaggaagaaaagaagagagccagtaatgatacaacttcggtactaaggcctcttaatttggatgattttattcaggcaaaatccaaggtgggtccatcagttgcgtatgatgcaacaagcatgaatgagttgaggaagtggaacgaaatgtacggagaaggaggtagtagaacaaaagcgccatttggatttgggacctga

SEQ ID NO: 27637 - DNA, 612 bp, Glycine max
  Peptide Sequence Number=SeqID_119322
atgaataaaggcaaaaactgtgctaaaaccttgcttggggaatcgcaatgttctcccaaaaaatgggtgggaaaatgggaaaccatagataacagtggcaaagttttagtacctctgaatttgaaccacaaaaacattgtaaagtatcttggatcttcaaagacaaaaagtcacctgcacatagttcttgagtatgtggagaatggctcacttgcaaataatatcaagccaaataaatttggaccttttccagaatcattggttgcactatatattgcccagggtcttgtcaaacttgctgattttggtgttgctacaaaattaacagaggctgatgttaacactcattcagttgttggaacaccttactggatggccccagaggttatcgaaatggctggggtttgtgcagcttctgacatttggagtgttggctgtacggttattgaacttctgacatgtgtacctccttattatgatttgcagcctatgccagctcttttccgtattgtccagcaaaaatataatatattaattgagtaccagaggtaccaagaaaatgaattacagggtagatgccaaaagattagttccatggcaagcttaatgtag

SEQ ID NO: 27638 - DNA, 817 bp, Glycine max
  Peptide Sequence Number=SeqID_119323
caaaatcatccctgtttggtgggaatcatggtcttgggtgaatattgtagtggttttcccgcataacccaaaacaatatttcctccaacatactcttggtgtgactgatggaatacgggtcaacaggtggaaatggtggtggctagccttgacatggaccatatggcaacaaaggaacaaggttatcttttccaacgacaccttcactgctagcaaactgctggatgatgcagtcttcctgctatggacatggcttaggaatttggagaaggattttgccactcattacatcagtggtctacaagttgaagagaaagtaacactggaaaccctggattatcactctcattttcaactagaccaaaatcaacttcatcctaaaggggccatcaggacatcagctttgaagatgggtcctccaaaaatggaggcatacttgcatcaggtagaggaccacactgggtatgtgtcgcatcctagggcttcttttgccttgggtcatcacttgtctccttcttcgtacatctcgttcggttattcatctgtgccttcctcagtttacttccctatatcctctttgaaaggaaaacaattatggctgccaacgatggtagtgaaacttgcatcttctcctctccatctgcagctgcaacagcatttgcatcaggaacttcttgttgtctactctggtggtctgtttctgatctgcacctggccacttgtgtttgctcctcagcatccttgtgtcacagactaccagaccaccaacaggcaggtattatcctcttccagagcagaccagcaacgttctctatga

SEQ ID NO: 27639 - DNA, 3678 bp, Glycine max
  Peptide Sequence Number=SeqID_119324
atggcaatggaaagagaaaaagaaaactgcaactcaccaggaaatatgccggtgacccatgctggattgttccatgtcatttaccttcttcttgatggcaagtttcaatccttgactgtcgctgaattcatcactgtcacatcttacaccaccaaaaataagacagaaatgcgcatggcgctacccatttcaaggttgatcagagtgtcaacatctgcaaaagttgggttcttggggaaatcagaaagtataggatcatctagcaaggttgtcagcaatgagttcaaccttgccttcttcactctgctcttattatattcttccattgaagagcaacttcgccgaagcgtgaacggcatggcggagaaagcggcggcgccaccaccgttgaagcctcttacaactcaggagtgggaaaccctaatcgagaacttccagaatggcgtgcaccgcaaatggaactctctggatcctctcttcgatctacttctctcctctcttcaccggaaggacttccctctctccctcaagctccaactcctggtcttcctcgacgaattctccctctccttcttcacctcccaccaccacctccaccgtctcgtcgacgcgtttaaaaccgtcgtccatgcgcccatcgacgccgcggcttccgccttcaaggaccaattcatggtctccacctcctcgattctcatctgcgcatctgaaaacgtcgtcgtcgaggctcaaacggagaatatgctggtcgagttgctgctgacggtcataaaccggccgaatttcggttcggaccggcacacgcgcggcgtcgcgtgcgaatgccttagggaattggagcggtggaaaccgggattgctttcggatgtggttggacacttgtggaatctgtgccagaacgagcgaactcacgcttcgcagtgttacctcttgctcttcacttcggtgattcataacatcgtcgctcggaaactcaacgtctcgattctcaacacatcggttccgatggttccgttcaacgcgccgaattgcgtgacggattcgggttcgggttcggatataggtttgggattgaatgtgaaggagttgaggagggcgttagcgtttttgctggagtggccgcaagtgatgactccttgcggaatgatggagtttgtgtgtatgataattcccgttgctgtggcgttggaattgcaaccttccatgctgaaggtgcagttgtttggaatgattcattcctttgaccctattctgtgccatgtcgttttgagcatgtatctgcgtttcttggatgcgtttgatggtcaagagggagaggtttctcgcaggctcttgttgatttcgagagaatctcagcattatttggtgtttcgcttgttggcgctgcactggttgttgggtttcaatagaatgattttcgagaagacaaagcccacccttgaattgtgctccactttctatcctgctttgtttgatcctctggctttgaaagccttgaagcttgaccttcttgcctttttctcggtttgtgctcgtgtattgaggctgaaaggtggttcagatgagttaattgatccggtgaagctgtttgaggatggccttgtttgcgtgtcttctttcaaatggttgcctcccgggagcacagagactgccgttgcattccgcaccttccataagtttttgattgcttcgtcgtctcattccaataacgatccttccaccacaaggaatatgttggactccgcaatattttgcactttacaggggttgcttgtggacatgatgttggagagtaggagactggttcccgttgttgttgcttttgttgaccgtttactctcatgtcaaaagcattcttggttgggtgagtgcttacttcagaaatttgataagcacttgcttccaaatgtgaggatggattataagttggtttattgcttcccaatatttgatagaattgctgaaaatcaggcaatacctcctcgtgcattgttagagctgctcacaaacttcatgattttccttgtggagaaacatggcccagatacggggatgaaatcatggtcccagggaagtcgagctcttggaatttgccgaactatgttgatgcatcaccatagctctagattgttccttaggctatctcgtctatttacttttacatgtctctattttcctgatttggaggtccgtgataattcaaggatctatttgcgtatgttggtctgcattccaggaaagaagcttagagacatcctgaatctgggggacatgatccttggaatttcttcctcttcacatccaacctcatttttcaatgttcagtcacctcgaccttctcagaaattcaagacatttaaaaacatatcatcctgcattcaccttgagcgtctggtcccgttgctagtcaaacagttttggtctctgtcattatcaaatttagttgtaagtaacaccaaacctacttatctggagatcatcagagacctcaaatctcctgttgaggaaaaggaattttctgatagttccaatacacagatcattcctgaatttgcaagaataaatcagccacaagagccacttcgtgtcatggattctaaagttgcagaaattttgaacacattaaggaagtacttttcctgcattcctgacttcagacatatgccaggtctcatagtcagaatatcatgctgtttgaggtttgaatccaatactttcaatcgcatgttgggaatagataaaactgccacatctttggaagaggtagatgcacttcctgctatatatgctactgtgttaaaattctcgtcatctgcaccatatgggtcaattccatcctatcgtataccatttcttcttggtgaaccttacaataaagatccagcatctcaaaatgcctccctaagtattgttcctgttggtgttggaaatgattccagggaagaggaaaaatatagagctacggttgagattgatttggagcccagggaacccacaccaggtatagttgatgttcacattgaaacaaatgcagaaaatggtcaaatcatccaaggtcaacttcaaggaatcacagtaggcatagaagacatgtttctcaaggctattgtcccagcagacatcccagaagatgaaatacctcgatacaactttgacttgttcaatactttatgggaggcatgtggctcatcctccagcactggtcgggagacctttcagttgaaaggaggcaaagggattgctgccatcagtggaactcaatcagtaaagcttcttgatgtccctgcaacctctttgatccaggcaactgagcgccatttggcacgctttgtcgtaggtgtgagtggggagccacttattgatgccatatgggaagggggaatcattcaaaatgtcatttgggaagatgcttctcctgatgctacttctgttgctaatcatgatacgggtccactccgtcttacttacaatgatgaagagtatgagaagggggctattagcaatagtagaaaaagaaacctgggttgttttcttgttctaatatttcttccaccacggttccatctccttttccaaatggaagttggtgatctttcaactttagttcgtattcgtacagatcattggccgagcttggcctacattgatgattatttagaagctttgtatctgtcataa

SEQ ID NO: 27640 - DNA, 678 bp, Glycine max
  Peptide Sequence Number=SeqID_119325
atgaagcaatactccttcttgttgctttctgatgattgttttgctatgatagctcttgaaacactacaggatgatgttgatgcacgcataactctagcttcgcttctgcttgaagaggcaaaagaagatgaagcaatttccttgctgtctcctccaaaggattctgcaccttctgaaaagtcaaatagatggtgggctgatataagaataaaattgaagctctgcaacatttattggaatagagggacgcttgatgattttgtggatacaattttccctttggttcgtgaatcattgtatgttgcaactcttcgacagaagtttgccgtcgcgcaccagagcactgccgtcgccgtcaacgtgcgtcatgcggcggtcgcatgcgtcatgtgttggtcgtcggtctctcgcatgcgtcgtctgcttttctgctgccgtcgcgctcgagaacgtcgtctgcggttgtcgtgtgcgtcgccggtgcccgcgccgccgttcgtcgcgctggagactgatgctggtcgcgccgctgaagaggagaaactcgggtatggttggcttgggtcagtccaacccctgtcgcaaacgttttttaaaataaaaaatccgctattccgccattcatgcgattccgccatgaccgctatggctatggcagctgccatagcgccgccataa

SEQ ID NO: 27641 - DNA, 2124 bp, Glycine max
  Peptide Sequence Number=SeqID_119326
atgattctccaacacgcttctcccacctctccacccctctgcccctgtaacttgttcgccaattccgcctccctcaaattccgcagaaaatgcactgtcctactctgcgccgttccctccgacaacccaaattggaacgccgatttcgccaattccgcccgcaggaccgccacaaccttcgtcctcaaacgaatttccaaccaactcgaaccccacaccaccaccaccaccaccaccaccaacgataacggtgttattgattccgaattacaagcaacaccgccggttcaattaggttcaaacttcaccgctttcagcgaggatcctattgtggataagctgaggacccagctaggggtgatacacccgattccctcccctccaattaaccgcaacgtcgtcttcctgttcgtcttcttcttcttcgtcggcgtcgtgttcgacaaattgtggacttcgcggcggcggaacaaaaataacagtgaagataggttgcgtggcggcgtgtggccgcaggtgccgacgagcttctcgctgtttcttgagaaggatttacagaggaaggagtcggtggagtgggtgaacatggtgctggggaagctgtggaaggtctatagaggcggaattgagaactggatcatagggctgcttcagcctgtcattgataacctcaagaagcctgattacgtgcagagggttgagattaagcagttctctttgggggatgaacctttgtctgttaggaacgttgagcgcaggacttctcgcagagttaatgatttgcagtaccagataggccttaggtatacaggtggtgctcgcatgctgttaatgctttctctgaaatttggcatcattcccattgttgttcctgttggtgttcgagattttgacattgatggtgaactttgggtaaaattaagattaataccaacggaaccttgggtgggagctgcttcatgggcttttgtttccctcccaaagatcaagtttgagctgtctccattccgtctgttcaatttaatggcaattccagttctctcgatgtttttgactaaacttctaactgaagatttacctaaactatttgtacgcccaaagaaaatagttttagatttccaaaagggaaaagctgttggtccagttgctggtggtgttaaatctggagaaatgcaagaaggaaacaaggattctgttggtgaactatctgttactctggtggatgctcgaaagctttcttatattttttatggcaagacggatccttatgttattcttagccttggaaatcaagttatacgcagcaaaaagaacagtcaaactactgtaattggaccccctggaatgccaatttggaatcaggattttcacatgcttgtttccaaccctagaaagcagaagttattcatccaagtaaaggatgctctaggatttgcagatttgactattggtacaggagagtacgtggtagattccctatattttatgccacttggactgacttctccaatggcagcaatgagaactattgttgtatggttcccttctggtgacccctattcacaagtcacgacacagaaaaatatagttgatttaggatctcttaaagacactgttccaacagacagaattgtggttttacaaggaggttggggattcttaggaaagcgctcttctggggagatattacttcggctaacatataaagcatacgtggaggatgaggaagatgataaaactgaggtggatgccatttatactgacatttctgatgacgagttgtctgattcagaagcaaatggtactaatgggaaggatgaaagagattctgtgtacgaaacagataaggagtcgtttatggatgttttggcagcattaattgttagcgaagaatttcaggggatagtagcatctgaaacagggtttagcaaagttttggataatggctcaaatgttggatctagagtgtcaaattctcaagttcccaatgttgaaccaattccctctagttctgataattccgaaggctctggagggtcagctttactttggcttgctgtgattactagcatatcactactaattgctctcaatgttgggggatccagtctcttcaatccgtaa

SEQ ID NO: 27642 - DNA, 834 bp, Glycine max
  Peptide Sequence Number=SeqID_119327
atggctggaataagcataagaatcactagatatgttactaatgctttcatgttgaaggctcccaaacgaggtggaaaggctccggctcttgccgctaagaagaagcctgagaaggtttcgaatccgttgttcgagaagcgtccaaagcagttcggaatcggaggggcgttgcctccgaagagagacttgactcggttcgtgaagtggccaaagaatgttcaaattcagaggaagaagaggattctgaagcagaggttgaaggttcctccagctttgaaccagttcaccaaaactcttgacaaaaacctagcaacaagtctgttcaagttacttctgaaatacaggccagaggacaaagcagaaaagaaggagaggctcttgaaaagggctcaggcagaggctgaaggcaaaaccgttgaagctaagaagcccattgttgtgaagtatggtctcaaccatgttacctacctcattgagcagaacaaagcacagcttgttgtgattgctcacgatgtggacccaattgaattggttgtctggcttcctgcattgtgcaggaagatggaaattccgtactgcattgtgaagggaaaggcccgcttgggaacggttgtccataagaaaactgcatctgttttgtgcttgacaactgttaagaatgaagataaattggagttcagcagagttttggaggctatcaaggctaatttcaatgacaaatatgacgagtacagaaagaaatggggtggtggaatcatgggatccaaatctcaagcgaaaaccagagcaaaggagaagcttcttgccaaggaagctgctcagaggatgaattag

SEQ ID NO: 27643 - DNA, 1458 bp, Glycine max
  Peptide Sequence Number=SeqID_119328
atggtagcgatcatgcaacagcagcagcagcaacaacagcaacagcagaacccctctgcactggtgccatttcagctcaagaatccccaatcctccaccacaaccaccgccgccgccactccccttaggtcaccctccgcccagtcgcagctctcctcgccgctatccgtcgtcccgcccctccggcaatccccactctcctcgcatccggtgccggttacgtctgtggagcccgctctgacggcggtgccgacgtgcccgctggtcagagtccggctctcggacattgccccctatgaaggggcaccggcggggccctatctcagagcaatggaggcactgtgtgggtctctgttgcggcacaatgctgcgttgatcgaattggggaacgaagacactgctctgatgcgatgcggcttggaaggtgcgaggttgtttttcagaagtagggcccaccttggttctggcaagggtagccgtggggtttacatgtacagagcaggaagggctttggaggattgggattcttctcccccctgcatggctgatatttttaagtgcatgggaaaggcgtctcgatctgccttgagtgccattgcgaggcatttgcgtcttagaagcgattttatgatcatgtgtgctcatgagaaaacagttgctttgtgcagtgtttttaaccatttgcttgatgatgctccattgcctgctaatgaggtgtcttcatcagttcttgttgtgacctactcacatgcttctttgcaaaatggaagaggtgccattggaggtggtaagcctcccatgaatggtgaagttgagaagggattgttgacattgatatcttcagacactcctggtcttcaggtatgtgaccccagtggtcgctggtatctggcagacagtgggtctgtgcctggagatcttttactcataacaggcaaggcacttacccatgctactgctggcctatgtcctgctgcatcatatagagcttctcctgattattttctgagtcctaatggtggaggaaggacttctcttgcatatagactcatgccacagggcaatgctatattagattgttccccaattgcagcagctggccatgttattccccaaagttatgttcgaatatctgtaagccaatttatggatgaccttgctgccgaagaactgataggcagcagatgtgataatgctgatgctgctgctcaaaacaatgtgaataaggagccatcattaagaagtgttctatcagatcctttatctggcacattccttgaagatgccatgcttgtctcatgtggacattcttttggtggtctcatgctgaggagagtcattgaaacgctcttagagctgcagcagccgctgtcaagcatgaggacgatcggaggttatttcgtaatgccgctctccgaaagcggcggaaagaaatgggtgaccaaatggattcaatga

SEQ ID NO: 27644 - DNA, 1650 bp, Glycine max
  Peptide Sequence Number=SeqID_119329
gttcaaacagttaaacagggttatctgttaaaacgatcatcaagctcacgtggagattggaaacggaggttctttgtacttgataaccaagggaatttatattattacagagtgaagggtgtcaaacccatggctgaaaatgaagctgataggatggactgggtaaacaaaattactggagctatcacatcgctttttaattctcagtttcttcaacagcctcaatttggtagagtgcattcccagaatagaaactcagcaactggtgcttctttggcaagtcaatcagaggatagtcagaaatcattgagggatgacgtatattccaaggaagtgggtagtgtctctaagattttaaggggaattcctgggaatgataaatgtgctgagtgcagtgctcctgaaccagactgggcatctctaaaccttggcatattgctgtgtattgaatgctctggagtgcaccgaaatcttggtgttcatgtctcaaaggtgcattctttcagatataaatgcaaatcatttatttacgttattgttgcaaataataatactaaatgccccgcatcatatttaatcatagttgtcaatagttgccgtagcgaccgctattgcggcggagcggcacccatccgcgacggacatgtgtgtagcggcgcagtttcgggtcgcagctggagcggcgcgggttgcggagcggttttttgtgccgctacttcgaagcgaaccctccttttccagatgcccaccgggaaaatcaaggtacccaccacgcagcacagccacaacaaacaacaccaggttcgcagcttagatcggatcagaagcgttaaaatagcggtcatcccgctatccgctatcccacttttggagtcggccgctccgctccgctacaccggtattgacaactatgttagatctataacgttagatgttagggtttgggaaaataccgttctggagttatttgataacttaggtaatgcttattgtaattctatctgggagggcttgcttctacttgatcatgaaagggtaggtgaaccaaatgtgccaatgaaaccttgctctgcagatgccttccaacacaaggagaagtacatccaagcaaagtatgtagagaaatcactgatcatccgagaagaggatatacccgagaatccttcagtttccataagaatctggcaagcagttcaggctgtaaatgtacgagaagtgtatcgccttattgccacatcaacatcaaatctgataaacacaaaatattatgatgaggctcaccatgctgctgatgccaaagggcatcagcatggtcctgaagcctgtctgaaagttgaagagactactgagacagagaggtgtttccgtggatggtcattattacatctggcatgtcattctggcagtgcactcatggttgagttgttgctccaatttggtgctgatgtaaacatgtgtgactatcatgaaagaactcccttgcaccattgcattacaagtgggaaaaatcaactggcaaagtttctattaagaaggggtgcaaggccgtcagttaaagatgctggaggactcactgtacttgaaagagcaatggagaggggtgcgataactgacgaagagctatttatcttgcttgctgaatgccagtga

SEQ ID NO: 27645 - DNA, 504 bp, Glycine max
  Peptide Sequence Number=SeqID_119330
atggttgttgtggctgcaattgccactgcagatcacaatttagaaccctatttaaagagaaagcggaggaaatcagaagaacacaatctgggaaaaaaggtcaataatagaaagaaccagtattctaaagtcatgcttcttcaggataagccagtggaattagcttcaaagacaaatttacattcagctctgccctcaagcatggctacgtattctcgcatttcacaccatatggaccaaaggcaacggatacaatatgatggtatatgtagccctttgaagcaactcatggagcagaatgctcaagcttttaatcaaatcactgccaatttgtctacttacaagttgcaggataacatcgacctcttttgccacacaaggcacaatattaataccattcttaataatatgagtgagatgcctggcattatgagccaaatgccgccactgcaagttaacattaacgaagatcttgcaagtagtattttgcttaatagaacatag

SEQ ID NO: 27646 - DNA, 393 bp, Glycine max
  Peptide Sequence Number=SeqID_119331
atggcagcacagtcaaacgctggatttcacaatgaagatatagattctattttgaacaggcatgcaatatcatttcaacctggtggtgctattaaccgtttgtctgagatggttccaatgggaaattattttgggctaagtagttcgtctgggatgatatattctgggaattcaagcatcattaacagtaatcctgtcatgagtcaagctggtaatccatccagttcttcgcttcttctcgattcggtcccggggctgaagcacgacacagggttggctgttgagtggtctgttgatgaacagtacagattggaggaggaccttgccagttggcccttttgtatccgtgaactaatcatgccgtctgtctgtaagccattttatgaaacataa

SEQ ID NO: 27647 - DNA, 711 bp, Glycine max
  Peptide Sequence Number=SeqID_119332
atgcattatcctatgattactctgccagcattgaaatgttttcaatctcagtgtttggcacatccacagaagcctcaatacaatggaggaattatccaaaaaccagaactgaataatggacttcaagggtggactgcatttggggaggcaagaatagaatatagagaatcattaggcaacaaatatgtggtagcccatagcagaaatcaagcacatgattgtgtctcccagaagatttaccttgaaaaggataagcattatattttatccgcttggatacaagtgagtgagggaaacgacgttcctgtaacagcacctgtgaaaacaactacaagattaaaatttgttggtgccatttttgctgagtctaattgttggtctatgcttaaggatggtctcacagcggatgaatcaggacccgctgagctctattttgaggtactacctattgttcttcataattctttatgtacaaaatttgattctctcttatatgctgtggacaggctcctttctgaaaggaggttatgcaaattatcaggaaccacagatcaaaatggattctttgaggccaatctttttcatggagactatgaaatggaaatcagtcaccctgctatgaagaattacaccttcacacaacgcttgcaagtgattccaacagaggacttcaaggaaacaaaacaatttgtacaacttcctattaagtag

SEQ ID NO: 27648 - DNA, 1203 bp, Glycine max
  Peptide Sequence Number=SeqID_119333
atgaatctgatgcaggcggttcgctacgacgcctacgggggaggtcctgccggcctcaagcacgttgaagttgccgttcccagtccaaaggcaaatgaggttttaatcaaactggaagcagttagcattaaccctattgattggaagattcagaagggtcttctccgtcctttatttctccccagaacctttccccacataccttgcactgatgtggctggagaaatagttgagatcggaactcaagtcaaagatttcaaagttggcgaccaagtccttgctaaactcactcatcaaaggaaaacccctgcccgagctataagccatggctgtgctagaaccaagaagaggaatcccgtctgtctcaaggctgaaggaagggaattggctgcggataatgaactcatcctcccaaaggctaagatatcttcaggctctgccaaatcagttactccacttccaagtcctttggcagtattggctcaacagaatagtcccccacagccttctttatatggaggtgggtttgccgagtttgctgtggctagtgagagcttaacagcagccagaccatctgaggtctcagccgctgaagctgcagcattgccaatcgccgggcttacagctcgtgatgccctcactcaaattgcaggagtcaagcttgatgggactggccagctcaagaacattttagtaactgctgcttcaggtggtgtaggtcactatgctgttcaactagcaaaactaggcaacacccatgtcacagccacttgtggggctcgcaacattgactttgttaagggcttaggtgccgatgaggttcttgactacaggactccagagggggctgcactgaagagtccatctggtaggaaatacgatgcagtgataaattgtacaactggaatatcttggtcaacttttgatcctaatttgactgaaaaagcggtggtagttgatttaacacctaatgcaagttcattgtggactgctgccatgaagaaaattactttttccaagaagcagctggtgccattttttgtaaatgtccagcgtgagggcctggaatatctacttcaattagtgaaggacgggaaactgaagtctgttattgactccaagtttcctttgagcaaagctgaagatgcttgggctaagagcattgatggccatgctaccggaaaaatcattgtggagccatag

SEQ ID NO: 27649 - DNA, 489 bp, Glycine max
  Peptide Sequence Number=SeqID_119334
atgaaggatgaaactaacagaaacatcaagcctaaggagtggataatcattatgataacttataaaattgggcccactgtagtggttgttaagtatgattgtatgaaggacaagacatttgaacatccatatctgcaagccagtggaggtcatatagtcatatgtgaggcacagaacatcatagaatcaaacgccactgaaactgtctggctcctaaaaataccagatgattccaattggtcagttggatctaccgaggacaactcagaatatgagagtacctctgttggttggtatgaacagaaagacacggttgaggaagaagatcttacgttgacattctcagacaaggttatggtcagaagcttctcgagcaaagctaagaaggttctgcagaagcacactgcgtctaatttccatgcatttggcgttgctgttattgcctctacacgatgtaatcaagagattgtgcaatttacggaagaatga

SEQ ID NO: 27650 - DNA, 327 bp, Glycine max
  Peptide Sequence Number=SeqID_119335
atggcttccctctatgacgtgcttggaatttcagtgggtgcaagctgcatcgaaataaaggctgcttacagaaagctggcaagaacacaccatcctgatgttgtggccatggatcagaaggaaagctcagcgaaccaattcatgatgatccattcagcttactcaactttgtctgacccagagaagcgagcacaatatgatagagaaatctatagatacagaagatcagcaaatatagcaggaagaaatcagacattttcctatgctggaagtggaaggaaatgggaaacagaccaatgttgctatccacgatggtttgtacaatag

SEQ ID NO: 27651 - DNA, 165 bp, Glycine max
  Peptide Sequence Number=SeqID_119336
atggtgctttcagcaacattaagagttaagacaaacggaacaattcgaaatagtttggcgaaagataaggaaaaccttccatttggagaatgcgaccatgcaatggtgtcatccacattgtgttgtcttggagggacagttgccatgatcctgaaaaagatatga

SEQ ID NO: 27652 - DNA, 1095 bp, Glycine max
  Peptide Sequence Number=SeqID_119337
atgggtctcttagcatcctcatgcttcattctcattgctctcctactcctcactcccaaaggtgttatgggtgccaccttcacattctttaacaaatgcgactacacagtgtggcctgggattctcgcaaatgccggtagcccaccactcgacagcaccggttttgagctccccaaggacacttctcgcgccttccaagctcccaccggctggtccggtcgtttctggggccgaaccggttgcaccttcgacggatccggcgccggctcatgcctcaccggcgactgcggctccggccaagtcgaatgcaacggcgccggagccgccccgccggcaaccctggcggagttcacgctcggcaccggaggtcaagacttctacgacgtgagcctcgttgatggctacaatcttcccatgatcgtggaaggcactggtgggtcgggtctttgcgcctccacgggttgtacctcggatctgaaccagcaatgtcctgcggagctgagagcctcggagggaagcgcgtgcaagagcgcgtgtgaggcttttggtagccctgagtactgctgcagcggcgcgtatggctcacccgccacttgcaggccgtccatttactcggagatgttcaaggctgcttgccctaggtcttatagctacgcatacgatgatgctacgagtacgtttacgtgttccggcgccgattataccgttaccttctgtccatcctctccaagtcagaaatcttcacgagataccactaccaaccccatgacctcaacaacaacatcaccagggtcagggacagtgacaggaaccggaaccggaacaggatccgaaggggcagtggtatacacgggtgcggacaacggcgttgcgtataatacagttacggattccgggtcaagttcaggatccggaggagaaacaatgctcgcagatgggtcatatttagctggtttagccatgggagactcccctgaaagaacagtttccatcgcaattttggctttgccagtaaagctggcagattctctccctcattgtaaaccaccttccaaaagattcgccagaaaaagtattccgtgtttcattcgttaa

SEQ ID NO: 27653 - DNA, 336 bp, Glycine max
  Peptide Sequence Number=SeqID_119338
atggcggtagagagctcatcgtcattaggaatggaaatacgtaagatgggtggcagcttccatttggtatctgagcgcgcattggtgcgctatccaatcgttgattcatcctatggtggaggacttcttctggcacgaaatgatgtggtgtttcaatggtggccagttctgcaggatgaagatattggagcacttgtgcggactgtcaagcttaatcagttgggaattgaaggatcaatcgaatttgttgatgcatacggaagtaacatgcatggacctgtatggaagtggtctagaagggatggttctgatttaggtgttggttcgggtggttag

SEQ ID NO: 27654 - DNA, 1651 bp, Glycine max
  Peptide Sequence Number=SeqID_119339
atgggttctagcgaggatccgaacaacaaagtcgattttccgtacgagtccccggcatcgcaaccctttctatcgaaaccctcgtacccttcatcgtcttcttcggctgtggaagaagaatcggagtcaaaccagcaattccatcacatcacttacaattcaggtcctcgctccttcaaggaccttcctttcctcatcctcttccttctcttcgtactttcctccttcgcctttggcatcttcgccatcatccaccgaaacaacagctacccctctctctcctccttcacctacgaccccaccaccacctcctgcgtcctaaacccttctaattcctcctcctcctcctccgtctccacgctctccctcgtcgacacaacatcatccgtttctccgaaattggtgaagggtctcatatggactctcgtcatcaccttcgttctcagcgtccccttgtgctgggctctgcttctcttactcaagcattacaccaaacagattgtctacgctgctattccactctttatcgccatccccgttttcctcaacgtgtattggttcgtggcctgcaccctcggcgcgtcttgcagcaacgctttccccctcgcgtaccgggttctgattttggtgttcttgtttttggtgattgggatcattgtgtggatcttggtggtgaattggcatcgcgtggagctcacggtgagcataatcggggtcgcttcccacgcactttcgaggaacatggctttgttcggggtgctgccttgtttgtctgttgggctggtgctgtattttgttccaatcgtggttttcatggtgtttgcgaggtttaatgggaagattgttgtgaagaatttgaagagtggatatgactgtgaatggaaggaggattcttgggtgccagcttattatgctttggctgttctcaccatgttgtggtctgcggcagctatggttgaagctcaagtttatgtcatcagtgggactattgctaattggtatttctccaaggaacatcaaactcctaagcggagtattcgaactcctctcagaaatgtttttggtccttcttctggcacgatatgtttgtcaggattgcttgtctgtgttgttcgaatggtgcgttctgcggttgatagtgcaagacaagaggatactcctgggatagtgaaccttgtgttgcggtgctgtgtaaatgcattgctgacagcagttgattttcttaacaagtttaccataaactttgctgcaataactggtgaagcctactgctcttctgcaaggatgacatatgaacttctaagacgcaatcttctctctgctgtttttgtggagaccatctcatctcgcatcctggctggaattgtctttgttttttctgcatcatacacaatagtggcctgtgttatcttaaaagctggtaccaatcttgggtctgactcatattttgtggctgcgatggcatgggtgctactgatggtagtgctgggttacctcgtgcatgtgctagacaacgtaattgacacaatttacgtctgctatgcgatagaccgggatagaggagaggtttgtaaacaagacgtccatgaggtttacattcaactacccattagtagaagtctcagacagtctgttactacaagaactctag

SEQ ID NO: 27655 - DNA, 2025 bp, Glycine max
  Peptide Sequence Number=SeqID_119340
atgtccggttacgctgctggaatcgcgaaaggcgttgctccgaaagccagattggctgcttacaaagtttgctggaaaaattccggttgcttcgactctgacatcctcgccgcctttgacgccgccgtgaacgacggggtggatgtgatttcgatctccatcggtggcggcgacggtattgcctccccatattatctggaccccatcgcaatcggatcctacggcgcagtttccagaggagtgttcgtgtcctcttccgccggcaacgatggtcccagcggaatgtcagtgacgaaccttgctccatggttaacaacagtaggcgcaggcaccattgatcgtgacttcccctcacaggtgattctgggcgacggtcggagactctccggcgtgtcgctatacgccggagcagctttgaaggggaaaatgtatcaacttgtttacccagggaaatcagggattcttggagactcactctgcatggagaattctctagatccgaacatggtgaagggtaagatagtaatatgcgacagaggaagtagcccgagggtagcaaaggggttagtggtgaagaaagcagggggagtgggaatgattctggccaacggaatatccaacggcgaaggactcgtgggagacgctcatcttctcccagcttgtgctgttggtgccaacgaaggagacgtaatcaagaaatacatttcctcttcaacaaaccccacagccactcttgatttcaaaggtactatcttaggaatcaaaccggcaccggttatagcttctttctcagcgagaggacccaacggtttaaaccctcagatacttaaaccggatttcattgctcccggtgtcaacatcctcgccgcctggacccaagctgtcggcccgaccggtttggactccgataccaggagaaccgagttcaacatcttgtctggcacttccatggcttgccctcacgtcagtggcgccgcggctttgctcaaatcggctcaccctgattggagccccgccgccctaaggtccgccatgatgaccaccgccaccgtcctcgacaaccgcaaccagatcatgaccgacgaagccaccgggaacagctcaactccttacgatttcggtgctggccatcttaacctaggacgagccatggatcctggcttggtgtacgatatcaccaacaatgattatgttaatttcctttgcggtattggttacgggcctaaggtgattcaggtgatcactcgcgcgccggcgagttgtccggtgaggaggccggcgccggagaatctgaattacccttcctttgttgctatgtttcctgcttcgtccaaggggcgtgacggtgaagccgtcgaggctcgtgttctcggaggcggtgaagaagcggagctatgtggtgacggtggcgggggacacccggaagctgaagatgggtccgtccggggcggtgttcgggtcgctgacgtggacggatgggaagcacgtgatgtgactgtggaaaggttgaagtgggggaatgatttcttgaagaagaggttggagtctggttcacactcccaggttagtcctcaggcattggagagcatgaaaagggttaagaaattgactatgatgtctgagaaagttgccactggtgtgctctctggggttgtcaaggtgtccggattcttcacaagttctgtggtcaactccaaagctggaaagaagttctttagccttcttccaggggaaatcgtccttgctaccatggatggattcaataaggttttggatgctgcagaagtagctggaaggaatgtcatgtccacttcatcagttgtgaccaccggcctagtttcagataaatatggagaggaagcagcacaggttacaaatgaaggccttgatgcagcagggcatgcgattgggacagcttgggccgtgttcaaacttaggaaggcactcaaccccaagagcgcaatcaaaccaacaacactagctaaagctgcagctgaagcaacttctactaaacttaagaaataa

SEQ ID NO: 27656 - DNA, 5685 bp, Glycine max
  Peptide Sequence Number=SeqID_119341
atggaaactcggagccggaagcgggcggaggcttcctcagctgccccttcatccccttcctctggtcccaccactcgttccagcaagcgtgcacgcctctcttcttcttcctccgcttccgccgccgctgccgccgcatccgtttcttccgtgaacactcgctcccgttcatcccggactaaggaacccttgccccctaagaatcctcctcccatggactctgccaatgaatcctctggctcccgccgcgatcgccgcaacaaagacaactccgacaaggggaaggagaaagagcatgatgttaggattagggacagggatgctgacagagggctggcattgaacatggatggtggcggagacgatgatgacaatgacagcgaaggcggtgtggggattttgcatcaaaacttgacctctgcgagtagtgcacttcaggggcttcttcggaaacttggtgctggtttggatgatctgcttccatcatcggctatgggttctgcgtcttcctctcaccagagtgggaggctgaaaaagatcctcttcggattgcgggcggatggcgaagaagggcggcaggttgaagcattgacacagctctgtgagatgctttcgattgggactgaagagtcacttagtacattctctgttgattcgtttgttcccgtgcttgtggggttgttgaatcacgagagcaaccctgacatcatgcttcttgctgccagagcattgacccatctctgtgatgtgctcccttcatcttgtgctgctgttgtgcattatggtgccgtgtcaatcttttgtgcgaggttgctcaccatagaatacatggacctggctgagcagtcccttcaagctctgaagaagatatctcaggagcatcccactgcctgcctacgagcaggtgctcttatggccgtgctttcctatttggacttcttttcaacaggagttcagcgggttgcattgtctactgctgcaaatatgtgcaaaaagcttccttcagatgcagctgattttgtgatggaagctgttcctcttctgacaaaccttcttcagtaccatgattccaaggttctggagcacgcctctgtttgtttgactcgaatagctgaagcttttgcgtcatctccagacaaattagatgaattgtgcaaccatggacttgtaacacaagctgcctccctcatttctaacagcagttctgggggtggtcaggcttctctcagcacgccgacatatactggtttaatccgacttctttcaacttgtgcgagtggatctcctcttggagctaaaaccttactacttcttggaattagtggtattcttaaagatattctatctggttctggagtttcttctaaggcctctgtttctcctgcattaagtaggccgccagaacagatatttgagattgtaaacctcacgaatgagcttctgcctccattgccacatggaacaatttctctccctatcatctccaacatgtttttgaaagggcccattgtaaagaagtctcctgctggtagctctggaaaacaagaagacacaaatggaaatgttcctgagatatcggctcgtgagaaactattaaatgatcagcctgaactacttaagcaatttgcgatggatctccttccagttttaatacagatatatggttctagtgtcaatggtcctgttcggcacaaatgcctttctgtcattggaaaattgatgtatttcagcacagcagagatgatccagtctttgttgagtgtgacaaatatatcaagtttcttagctggcgtcttagcatggaaagatccacatgttttgcttcctgccttgaaaattgctgaaattcttatggaaaagcttcctgggacattctccaagatgttcattagagaaggtgttgtgcatgcagtggaccaacttattttaactggaaattcgaccaatatctctacacaggcatcttctgccgagaaggataatgattctatatctggagcatcatctcgctctaggcgttatcggcgacgcagtgggaattccaatcctgatggaaatcctttggacgatttgaaaactccagtttcagtaaatgttggttcacctcctaattctgtggatatgccaacagtaaattccagtattcggttatctgttagtacagctgccaaagcttttaaagataagtattttccttcagatcctggggctgctgaagtgggtattactgatgatcttttgcatctgaaaaatctttgcatgaagttaaatgctggtgctgatgaacaaaggaccaatggaaaggggaaatctaaaacttctggatttggtctggaagagtatttaattgggatcatagctgacatgctaaaggaacttggcaaaggagatggggtatctacttttgaattcattggtagtggtgttgttgcagctctgttgaattatttttcttgtgggtatttctctaaagatcgaccattagaaacccaccttcccaagcttcgccaacaagcacttacaaggtttaagttatttatagctgttgcactaccttctactactgaagatgggactgtggctcctatgactgtcttggtccagaagcttcaaaatgccttgtcctccttggagcgtttccctgttgtgctgagtcattcatctaggtcatctagtgggagtgcacgcctctcctctggactaagtgcattatctcagcccttcaagttgcggctttgtcgagcccagggtgaaaggtcacttagggattattcatccaatgttgtactggttgatccattagcaagtttagcagcaattgaggaatttgtttggcctcgtatccaacgaagtgaattgggtcagaagtccactgtacctgctgggaattctgaatctgggacaactcctacaggagctggtgtatcctctccaactacccatcgccattctactagatccagatcatctgttaatataggtgatacatctagaaaggaaataagtcaagataaaagcacaagctcttccaagggtaagggaaaagctgtattaaagcctgcacaagaggaggcaagaggacctcagaccagaaatgctactcgcagaagagaagctcttgataaagatgctcaaataaagcctgtaaacggtgactctacttctgaggtaaatgctagggctctggttgaggaagtaaaaagagggatgcgtaaaaatgatgaagatttggatatatcccctgttgagattgatgaggcattggtgattgaagatgatgatatttctgatgatgaagatgatgaccatgatgatgtactgagggatgattctcttcctgtttgttcacctgacaaagtacatgatgtgaaattgggcgacatagtggaggagagtaatgttgctcctgcaactagtgatggtggccagactaatgctgcctcaggttctagtagcaaagctggtacagtcaggggatcagactctgctgattttaggagtggctatacctcaagctcaagaggtgcaatgtcatttgctgctgctgctatggctggacttggatctgccaatagcagaggtatcaggggtggaagagatcgactagggcgtccattgtttggtagttctaatgatcctccaaagttgatatttactgctggtgggaagcagcttaataggcatttgactatttatcaggcaattcaaaggcagcttgtgctagatgaagatgatgaggagagatttgctggcagtagtgactatgtatccagtgatggaagcaggttgtggggtgatatttatactataacttatcagagggcagagaaccagacagataggactccccctggaggttcaacctctaatgcttcaaaatctggcaaatctgggtctgtattgaattctagttctgaagacaagctaaatcagacatctgtattagatagtattttgcagggagaattgccctgtgaactggagaaatctaatcctacatacaatatattggcattattgcgggtgcttgagggtttgaaccaacttgcatctcgtttgagggcccaagtggttactgatagctttgcagagggaaaaattttggatttagttgagctaagttttaccagtggtgctagggttcctacagaggaatttataagcagcaaacttactccaaaattagctaggcaaatacaagatgcccttgccttatgtagtgggagtcttccctcatggtgttaccagttatctaaagcgtgcccttttttgtttccttttgagacccggcgacagtatttttattcaactgcctttgggttatctcgtgcattgtatcgccttcagcagcagcagggtgctgatggtcatggatcaacaaatgaaagagaggtcagggttgggagattgcagcgtcaaaaggttcgtgtctctcgaaatcgcattttggattctgctgctaaggtgatggagttgtattctagtcaaaaggctgtacttgaagtagaatattttggtgaagttggcaccggtctgggtcccactctggagttctacacacttctcagtcatgacttacaaaaagttgtacttcaaatgtggagatcaggttcttcagagaaatatcaaatggaaattgatggagatgaaaagaaaatgaaaaatagtgaaggctcttttgttggagatggagaactcgttcaagctcctcttgggctgtttcctcgaccttggcctgcaaatgctgatgcatcagagggtacccaaattttcaaagtgattgaatatttccgattattaggccgtgtaatggctaaagctcttcaagatggacgcttattggatttaccattgtcagtggcattttataagcttgttcttggtcaagagcttgatttgcatgacattcttttcattgatgctgaacttgggaaaactttgcaagagttaaatgcccttgtttgccggaaatgttttatagaatctattggtggtagctacactgatacctttgctaatttgcattttcgtggggccccaatagaagatctctgcttggacttcacacttcctggttatccagagtacatcttgaaacctggagatgaaattgttgacatcaataatctagaggagtacatatccatggtggttgaggcaacggttaagactggaatcatgcgtcaaatggaagcttttagagcagggtttaatcaggtttttgacatctcatctttacaaattttttctccccaagaactggattacttgctttgcggccggagagaattgtggaagactgagacactagctgatcatataaaatttgaccatggttatactgccaagagccctgccatagttaatttactcgaaattatgggagaattcacaccagagcagcagcgtgccttctgtcaatttgttactggtgcacctaggctgcctcctggtggactggcagttctaaatccaaaattaacgattgtgaggaagctttcgtcaagtgcagctaatgcttcatctaacgggaatgggccttcagaattagcagatgatgacttgccaagtgtgatgacgtgtgcaaattacctgaagcttcctccttattctaccaaggaaattatgtacaagaagctactctatgcaatcagtgaaggccagggatcctttgatttatcatga

SEQ ID NO: 27657 - DNA, 210 bp, Glycine max
  Peptide Sequence Number=SeqID_119342
atgtgggaagactttaacccttggtctcatttgcacaagtaccgcccaagatggttcatgtgggtggccaacacggatgcgaaagctattgacagtgctgagatctatagttcacaagtactacacgcagagaagaggactccaggaaagatgatcgaggaaataaaaggtgagaagggatctagtgtggatgatgcacgtttagtctga

SEQ ID NO: 27658 - DNA, 222 bp, Glycine max
  Peptide Sequence Number=SeqID_119343
atgggacccaggtgcggtggtgcaacgaatttacggtgcggtggcgatgatgaacgtgaagatgaagagaaggaatttgatcgagtcatcttgagccacatgtatgaacggtccaataacaaaatcgatccaatcatgccactgagttctggttggaccggtccgacgggtcgaaccgaaccgaattttacaattatggtggggagattactagaggaatga

SEQ ID NO: 27659 - DNA, 279 bp, Glycine max
  Peptide Sequence Number=SeqID_119344
atgggtttccgtttaccttctattcgcagggcctcattcaaggctagccaagcagcttcaaaatctgcagaagtcccaaagggctatcttgcagtatatgttggagagaaacagaagcgatttgtgattcccgtatcatacctgaaccaaccttcattccaaaatttattgagtcaagctgaggaagagtttggatatgatcatcccatgggtggcctcacaattctttgcagtgaagatatcttccaacatataactgctcacttgaatggacaataa

SEQ ID NO: 27660 - DNA, 147 bp, Glycine max
  Peptide Sequence Number=SeqID_119345
atgaaaaggcaacaaagcgatagccatgaaattacagaaaagaaacaaaagaaaaagatggccgagtggtctaaggcgccagactcaagttctggtcctcgtgagagggcgtgggttcaaatcccacttctgacaactttacattaa

SEQ ID NO: 27661 - DNA, 168 bp, Glycine max
  Peptide Sequence Number=SeqID_119346
atgtccttggcgattgagaccttatcgcaagcggcgagtttgaagaggctgaaaagtggttgtggcgccggagcggtggcagatacaggtggtttatgcacatggcgcggcgaagtggttggcgttgttgtacattgcttcgcctcccctgtgttctacaaaccctag

SEQ ID NO: 27662 - DNA, 1776 bp, Glycine max
  Peptide Sequence Number=SeqID_119347
atggccgcagcagcagcagcaaccactctctcctcttccctttccaaaccctcctctcttactttccaaacccactctttccccataaccctacccactccccctcgcgccgccgccaaaccccctcttctcgtcttctccaaaaacccaatttccgacatcgtctcctccaccttctcacgcgccgaagaaggcgcgtgggacgacgagaagccgcgcgaggagtgcggcgtggtcggcatatacggcgaccctgaggcctcgcgcctctgctaccttgccctccacgcgctccagcatcgcggccaagaaggcgccggaatcgtcaccgtcaacaacaacgtcctccaatccatcaccggcgttggcctcgtctccgaagtcttcaaccaatcaaaactcgaccagctccccggcagcctctccatcggccacgtccgctactccaccgccggccaatccatgctcaaaaacgtccagccctttgtcgccggttaccgcttcggctccgtcggcgtggcccacaacggcaacctcgtcaactataagaccctccgaaccaacctcgaagacaacggctccatcttcaacaccacctctgacaccgaggttgtcctccacctcatcgccacctccaaacacagacccttcattcttcgaatcgttgacgcctgtgaaaagctcgaaggggcttattctattgttttcgtcaccgaggacaagcttgtcgccgttcgagaccctttcgggtttaggcctttggttatggggagaaggagcaacggtgctgttgttttcgcttctgaaacctgcgcgcttgacctaattgaagcgacttatgaaagggaggtttaccctggtgaggttcttgtggtggataaaaacggtattcagagtctctgcctcatgtctcatcctcaaccaaaacaatgcatttttgaacatatttactttgcacttcccaattcggttgtttttgggaggtctgtgtatgagtctcgtagacaatttggggagattttggctactgaaagtcctgtggagtgtgatgttgtgattgctgtgcctgactctggtgttgtggctgcgcttggttatgctgcgaaagctggggttccgtttcagcagggtttgattaggtcgcactatgtggggaggactttcattgagccctctcagaagattagggactttggtgtgaagctgaagctatcacctgttcgtgctgtgcttgaaggtaaacgtgttgtggttgtggatgattccattgtgagaggaaccacctcgtccaagattgttaggctgttgaaggaggctggtgctaaggaggttcacatgaggattgcgagtcctccgattattggttcttgttactatggtgtggatactcctagctctgaggagttgatttcgaataggatgagtgtggaggagataagggactttattgggtcggattcacttgcctttttgccttttgatagcttgaagaggttgttgggaagtgaaagtccaaatttttgttatgcttgtttctctgggaattaccctgtggagccaagagagcttaaagtgaagagggttggggactttgttgatgatggcttgaatggaagcttggagtctattgatggtggttgggttcaggcaaaccgaaatcaaatcaagcataaggcatccctcagtggacaaaaatcagatgcagttcttcagttttaccttgatgatacggataataatgtttacattataggtcaatataagttctctaagtaa

SEQ ID NO: 27663 - DNA, 630 bp, Glycine max
  Peptide Sequence Number=SeqID_119348
atggtgctacctagaaatgctctcatgcatgttatatactctctcatcatctttggctatgaagaaagctcttgttgcaccgccatagcagacaaatttgcgacgtattcgcctgaaattttggctagcaaatcattcagcaaacttctgctagctggcattcttttggatactgcgaatctaagggaccctcgttgctcctctaaagataagtacatggcttcattattgatcaatggtgctggtcgttatggatgcaatggtctttaccaattattgaggtacaaaatgcatgacctttcctccctccaagtagcagatatcttgcgaaaggattttaaaaagtggacaggacaagtatctgagaaacttcgagcacttattgtcgtttcggggtattataacgatgaaaagaacttcaagagagaagttttaatatctacggaatctgcaaagctattggagagtttgctcttcttcttcgatttcaatgcttcccggctgccactcaagagcttacactttccaggtctgaaaaatgggatgaaagcgtatgagatcgataagattacatcaaggaaaatagtagagcatctcatagaagagttcgttgggataccaaaagcctaa

SEQ ID NO: 27664 - DNA, 1068 bp, Glycine max
  Peptide Sequence Number=SeqID_119349
atgaggtctgctggagcaaataccccaactcagaaggaaccatacattcgtactagagagaatccatacttcgatggccttctaagatctgatggtcagattcccttgaagtctcaattagaatttacgtatattggtgaaaccagacccaaaaactttgtctcagatatctctgaagaggttatggagttgtcaccggagaattcagcagtctcaggattgaactctaaatcttctgaacattcttcgtctgagaagtggttaaaaaccagcaaaattgctccatttatacaactggatattctatccgagctgattgaaccggataatccaaaacatcatcatcttggatatggccaaagcccccggactcctgaacaatcacctgcaatacacaatacagaaaagacatatactgtcattagaagaaaagaaaagctatcaagtattctacttccactatctgcagcttcatactatattggagtatcaccagaaatggaaattgttgaatcatgtgaaagcattgacaagctaaatgcatttttgaaagcaagaaaggatgatgtcaatgctggtgtacctgggaaattcttacatgctgttatgggttcagatggtgctgacgtgggaactgtggcttcaaccatcatgtattccttctacctacatgtaacttcagaaagcaatcaattctgcacagttccaattattaacattaaccgggcaaatcttggctcacatgttgaactcaagtggctgcttgattcgtgtcatattgatcagtcatccttaatttttgcagatgagattgatctctcatactatgatatatttggaagtcttaagatcgtactgttgaagggaagcaggatttccagtaagcaagagaaattaaagcaggctgtggttgaaatttttcactgcagaaagggagagacaatatatccatgggttaaaactgtcacaacaacagaagaggttttggtccctctagtataccatacactggttcaaatggttacacacttacaccttgcaagtcacggtgttctgacatattactag

SEQ ID NO: 27665 - DNA, 1209 bp, Glycine max
  Peptide Sequence Number=SeqID_119350
atgggtgaaagaatgaaccagagtgagcaacagttagttgaagactcccaccttgacatactatcacgtattctcagaagcaaaggtgctgctaggaggtccatccagtatagctataagcatggcttctctggattcgttgcagttttaagtcagtctcacgctaagctcattgcagggaaagatctgagcaagttttatcgtattgtgtttggagaagacatagcagcttcagatgctgatgaaaaaagtgcaaggagctgcaattcagggagcctgaatgccaccttagcaaaaggaaaagcaattctttgtttccagtctcggtcacagaggtcagccacagttgctataagaataagaactgtaacggaagttggaggcgctggtctcatatttgctcagtttcctactaaagatgtcgatacctcgtggagtaaaccctgtgtccaagttgactttattacaggaacaactattctgtcatacatggaagcaactaggaatcctgtaattaagtttagcaaaacaaaaacagttgtggggcaacagttatcaccagaagtggcattcttcttttcgcgaggaccaagttctctgtctccttcagtgttgaagcctgatattgctgctcctggggttaatattctggcggcttggtcacccgcttcttctgcccgtttggtatctgatgctgcaaatgaagatgagtcagatttacatccccttaacttcaacattgaccccgctgcactagccttttatctcacaaaggcttctctgaaaaatgaatacaagcaatatatttgggcagagggagcaccacataaacaagctgacccatttgactatggaggtggtcatgttgatcctaacaaagtcacagatcttggtctcgtctatgacatgaaaaactcagaatacgttcgattcctctgttctatgggctacaacagcactgccataagcttattagcagggtttcctaccaaatgccagaaatcacacaagttccttttaaacatgaacctgccttctattatcattccagagctgaagcaacccctcacgatatcaagaacagtcaccaacgttggcccaattaaatctatctacactgctcgtgttgtagctccaattggaatatcaattaatgttgagccatcaaccttaacatttagctctaaacgaaagaaaatcaaaatcaat

SEQ ID NO: 27666 - DNA, 204 bp, Glycine max
  Peptide Sequence Number=SeqID_119351
atgttgaagttaaggggatgtaaatctgactcatcttcatttgcagcatcagataccaaacgggcagaagaagcgggtgaccaagccgccagaatattaaccccaggagcagcaatatcaggctgcaccacattcatcaatcataaacataaagcattttacattttcgttaagataaaaactattgccttgatgaaggaatga

SEQ ID NO: 27667 - DNA, 585 bp, Glycine max
  Peptide Sequence Number=SeqID_119352
atggcggcaatagcagcagcagcatcttctcatctaatgtttgttcttcgttcacaaccattatcttcttctttcatttcttttctcaaacctcttcttctttctatcccccaacgctgtttctacgccccttcgacatatccatgttccaccgcttcgaaaacctgtcttcgctacttcctcttgcggtttctcaagatggcgaagaaacagagattgcggatgatgaattggaaactcaaagaaattaaaatacgtaggagctgtccaggtgagttagatgatgtggtgaagcagttggaagcagcaactggttcagtggctgttggtcagattggtcgaactctcattatatacaggcccagtctctccaaaatgaaagcagaagaaaagaagaaacaaaatcgtaaccttattcttaaaaaacaagtaaagccaagactggtaaacaagaagggtaaggaacaagtacccaaattatcttggcccggttcatcatggaaaggaagaaaaaaaaaagtaggtcataaaacacattctgattatgtcgacctttgtccgggtgcttggcctgaacaagcttga

SEQ ID NO: 27668 - DNA, 114 bp, Glycine max
  Peptide Sequence Number=SeqID_119353
atgaaagcagggagaaggagtggccgagaaaagaggactgaggactcactctcatctgacgcccatgccgaatgtttccctcttctcctctgcaagtgccggctaatgcaataa

SEQ ID NO: 27669 - DNA, 1637 bp, Glycine max
  Peptide Sequence Number=SeqID_119354
atggcctcatcctcacgtgcaaggagtagctcgccattctcgcaccgcaaaccctcaactcctctctcctcagcttcctcttccacttcttccttcacgaacggacgcgtaatgcctcgctcctgttcctcttccacgtcgtcgttttacaactccggtggcggtggacgatccatgactccgagtcgcggtcacagcgagtctgtctactacggctacggtaatccttcgccggtggagttcgggatggacgaggaggtgatcacggagcccgtggattcgtccagagctcgggatagcatttcggtcacgattcggttcagaccgttgagtgaaagagagtaccatagaggagacgagatcgcgtggtatgcggacggtgataagattgtgcgcaatgagtataatccagctactgcttatgcgtttgatagagtgtttggaccgcatacgaattccgacgaggtgtatgaagtagctgccaaacctgtggtgaaggctgccatggaaggtgtaaatggaactgtgtttgcatacggtgtgacgagtagtggtaagacacatactatgcatctttgttatttggagtatatacgatggaagtcaagctgttatattttacctcatcatcatattgcaacattttctgatacatcatattgcaacggagaccaatattctcctggtatcataccactggctatcaaagatgttttcagcattatccaagatgtgagctttcctgcaaacttagcaaatgttgttgaagtctttgttatttgtgggactccaggaagagagttcttactccgtgtgtcatatctagaaatatacaatgaggtgataaatgacttgcttgacccaactggccaaaacttacgtgttagagaagatgcacagggaacttatgtggagggtatgaaggaagaagttgttttgtctcctggacatgccctttcctttattgctgccggggaagagcatcgtcatgttggatcgaacaattttaacctctttagcagccgaagtcacacaatttttacacttatgattgaaagcagtgcccatggtgaagattatgatggagtcatcttctctcagcttaacttgatcgatcttgctggatctgagagctcgaaaactgaaaccactggattaagaagaaaagaaggatcttacataaacaaaagtcttctgacacttggaacagttattggaaaattgagtgaggggaaagcatctcatgttccatatcgcgactcaaagcttactcgcctcctgcagtcttcacttagtgggcatggccatgtttctatgcacgtgaacaaacttatttgcactgtaactccagcatccagtaatatggaagaaactcataataccttgaagtttgctagcagggccaagcgagtagaaatatatgcctcacgtaataagattattgacgaaaaatctctaattaagaaataccagagagaaatttcagtcctcaaacatgaacttgatcatctgaagaaggggatgcaacttggtgtcaaccacgaggagattatgaccttaaagcaaaaggtttttgtgattgtgacaagatctgggttttcattttgtactactgacatatgggtagttggaagaag

SEQ ID NO: 27670 - DNA, 381 bp, Glycine max
  Peptide Sequence Number=SeqID_119355
atggaagatcttctagatgcttcattcgcatccaatagtttatctaaggattatgagcaccaatcagcgtttcagaaccaagatgttcaagtcagcatgcgttcgttcccactgcaaacttgggtaccacaatctcaaggtggatcccctcaacgtagctttacttcgaatctttatccccagattgattctttagttggagtgatggaaatgcctaaagccaaagctggtgaaggatactccaattggatatataattatgactacgcagcttacaaacttccttcaatttgtcctccattgatcaaaaaaatgcaaacgctctcgttaatcaattatgcagttcagctaacaccttttaaaggccatccttatgtataa

SEQ ID NO: 27671 - DNA, 231 bp, Glycine max
  Peptide Sequence Number=SeqID_119356
atgttttccagtagagtagaaatcaacattctaacaaagtacatttgcattgtggattacccaatccaaaacattgttgactaccttgtggaatcaaaattctgccgtggcaacgactcaatgtccatggccaactatggtgcaactagtcatggcaacacgaggtctgggtcacagtggtgcaaggataagagggagagtgaggggagaagggcaagtttgggatattaa

SEQ ID NO: 27672 - DNA, 831 bp, Glycine max
  Peptide Sequence Number=SeqID_119357
atgaaggacgcagatgtgtcaaggcagatccagcagatgatcaggttcatccgtcaagaggctgaagagaaagctaatgaaatatctgttgctgctgaagaggaattcaatattgagaaactgcaattgcttgaagctgaaaaaagaaagatcaggcaagagtacgaacgaaaagccaaacaaattgacgttcgaagaaagattgaatactcaacacaactgaatgcagcccgaataaaagtgcttcaagcacaagatgatgcggtgggtgctatgaaggacgctgctaaaaaggggcttttacgtatctcaaatgataagaaagtatacaggaaactcgtcaaagacatgattgttcagggtttactacgcctgagggaaccatcagtgctattaagatgcagagagagtgaccgtaagcttgttgagtcattgatagaggaagccaaaaaagaatactcggagaaagccaatatgcaagcccctaagattgcccttgatgatcgtgtttacctcccaccgtcgccaaagaacagtgccgtggattcccatgaaccttattgcaccggaggaatagtattggcctcagaggatgggaagattgtgttggaaaatacccttgatgcacggcttgatgtcattttccggcagaaactacctgaggcatgtaaggaagcgcctgttaggttgaacaacatactgcaatttgaattctcgctttatgtcagcaaatggaagagcaaggatgttgccacttcttttccgctgagcctgatcaaagcaaatgcaccaccccttttgttttttcttttctctaagaccaagttttaa

SEQ ID NO: 27673 - DNA, 1644 bp, Glycine max
  Peptide Sequence Number=SeqID_119358
atggttgtccttgctgcttccattgtgagcaaatctggcaaagaaaagcttaatcttgaatcgcttaatgttgaatttggtgttctagtttctagacagtttgtggacatgtctcgtatcagaattgagggacttctagcagcatttcccaagttaataggcactggaaagcaacacacatatgttgagatggagaatgtgcgctatgtttaccagccaatggaagctctatacctgcttcttgtaacaaacaaacatagcaacatactggaagacttggcaactctgagacttctctccaaacttgttcccgaatattcttactcccttgatgaagaggatatttgccaaaatgcatttgagttgatttttgcatttgatgaagtcatctctcttgggcacacggaaaatgtgactgttgcacaagttaagcaatactgtgagatggaaagtcatgaagagaaactgcacaagctggttatgcagagcaaaatcaatgatactaaggatgttatgaagcggaaagctagtgagattgataaaagcaagattgaaaagaacagaggtgataaagggggatttggtcctttacagtcactaggctctggaaaaattgaaaatagctttagtgatttgagcatatctagcagcggaactggttttgcaagtggctctggttttggattgaattctgatgttgattccttttctaccaagtctaaaggtcgtccaacttcatctgccactgctccaccaaaaggtattggaatgaagcttggtaaatctcaaaggacaaatcagtttttggaatcattgaaagcagaaggtgaggtcattcttgaacatgttcagccaaaacttggcctgcctcaggcagctgccctaccatcaacagatcccatttctttaactgttgaagagaaactaaatgtgacactaaaacgagatggtggagtcagtaattttgatgttcaaggcacattgtctctccaaattcttgacaaagaggatggacatattcaagttcaggtccagacaggggagaatcaagccatcattttcaagacacaccctaacatgaataaagatttatttgccaatgaaaatatactaggcctaaaggatcccaataggcctttccccacgggtcaagctggtggttctgaaggtgttggtcttttaaagtggcgaatgcaaagcactgacgagtcaatggtgcctctgacaagtgggtctataatcaactgctggccctcttcttctggaaatgaaacttacgtcagcattgagtatgaggctttgtcattgtttgatttgcagaatgttgtgatctccgtacctcttcctgctcttcgagatgcaccatctgttaagcagattgatggggaatggaggtatgactcaaggaattcctttttggagtggtctgtccttctgattgataattcaaaccgcagtgggtcaatggaatttgttgttccacaagccgaaccatcagcattcttccccatttcagttcgttttatagcaactgaaacatttagtgacctgaaggtcaccaatgtcataccgctaaatggtggtaatcctcccaagtattctcagagaacacagttgatcacagaaaactaccaaattgtgtga

SEQ ID NO: 27674 - DNA, 675 bp, Glycine max
  Peptide Sequence Number=SeqID_119359
atggcactcgctgcaaacaaagtttcaagcagtcctattgtgactaatagaacagctctttgtagatcaggtgaaaaacactatttttcctcgtcaacaagggtcaatagaatacagttgtcaagacatagactggaacatggacatctgaactatagatgtctccacagagagagatcaaccttattcaatgactggttttggttcattaacggaaaacctgttggtttgatctccaagaagaaatcttctatctcatgtaaatcaacaggagcaaataatactgaagagaaagaatgtattacaacttatgatgatgtttccgatttaactagggtacataccaaagatgagaaaaatgatcacactcttgttgttcatggcttggctgatgcttgtagattcgtttgtaatgatgcaaagtttctctcacgtggcataatgaggatggatgctcgtgcacgccaagatgttgcttttcttgggactgaatttctcaaacttgatgctcgggcaagagaggatactgagaaaattgaccgtgatgtcaaggaaaaagctagccgacttagtcatattgctactatattgaaagataaagctcagtccagattgaaaaatgctgctgatgagcattggaatgatggggccttagaggtaaatctgttcatataa

SEQ ID NO: 27675 - DNA, 78 bp, Glycine max
  Peptide Sequence Number=SeqID_119360
atggacatccgtctccgtgtgattgaagctgcaaacactgcaatattcttgctaaatagattcccaccaaagcagtaa

SEQ ID NO: 27676 - DNA, 1800 bp, Glycine max
  Peptide Sequence Number=SeqID_119361
atggatgctccggttaagaaaaaggcattgtctcgtcctagcttgagtcctcagaagaaagacaagtgcatagtttttccccttgtgaggtataatgaattccggcagcctgtttgccaggcttgtaatgtagttatgttggagtctatacgtgcacacctagcttctcctgagcatcacgaggtaatggaaaaactgaaagctaatgctgctggatcaactgaagataaggatgcaaagccagttactgttaccaacaactctcccaaggctaatccagaacaacctcaagacacagcaagccaactgcctgaattttcacaagatgtgccaaaacagcagtcaccatctgctcttccacgagatttttgtgatgacagtggtaaaataaggacaagatctgtaaccgaaatgacggatcctcctaaagaacaagaacaccaggaatccatagtttcaccttccacagatgaagctttgacatcttcgaaacgtggaaggtcacgaaaaacaaagcctaccaagttcataattaaccagaaatccaataccccatcaacaccccgaagatctaaaagaataaagcatgtggcagataaaactgccaacaatgttcccgaagtatcttcatccgaggaattattgaagggacgtacagctgaaaattcacaagtagatggcaaagaagtctcttcagatatcgatgccttagtaatctacaaaagaaaaagactacctcgaaggaggtcttctggtcaaataggcaagtccccaaagaaaactgttcctacagagcctccaactgctgcaatttcaagctctactactgcatcacctcctcatcaagatcctcctgcagctgctccagccaatgctgatgcttctcatattgaaaatacaaacactgctgagccagtattgagtaaaagccttgtcgaagaggtcgggaaagtgaaccctgctccagccaatgctcaagaacaaattgcttccagcaagggtcaagaatctccagatcaagttgactcaaaggctgatgaagtctctactgggaacaccccactcgatctagaagccattaacaaaatgattgaagatgaccctttgagtgctattgaaaatattctgacagggaaggtttccatttcttccaagactccacaatctatcactcaggcagaacaaccaaaagttcaaggctcccctgcagatgttctgtctaaagagctaaaagacttaatgcagacctttagcttaggtgattttgttactgactatgaacaaatgtcaaaggtcctacttattcttgaagagttgcagaagaatgagaagtttctttctcatgaacagcaaacattcataaaggccttcagactcttcttcaacaatgctgttactcaccgcaaagaatgtgatatggctagaataaagaaagtcgacttgaaccgagctaaagaagatatccttcgcaaactgcaagaagttaaacatacacaggaacaaatcacaatgtccatttcaaatgccgacaacagggtcaatgaaatatcttcttgtattgaacaacttgaagaacagttatacaaactgaaggaagagagggagacctttcagttggctattaaggaacgggagaaacaaagggagacattgaagaatgatagcatcttatgggctcatcagactaaggacctggtttttgatcttgcagagattgaggccaaagaaaaaatccttggacagcaacttgaagccgacaatgatgcatatgaccaatttaaagcgtcctttcctttttaa

SEQ ID NO: 27677 - DNA, 597 bp, Glycine max
  Peptide Sequence Number=SeqID_119362
atggggaacaccatgggaaggagtaaaaaggccaaggtgatgaaggtggatggagagacgttgaagctgaaaacaccagcgagagcaaacgacgtcgtaaaggactacccgggccacgtgcttctggactccgaagcggtgaaacatttcgggcttcgggccaaacctcttgagccgtaccaggaactgaagcccacaaagatttactttctcgttgagttacccaagattcagcccgaagaggaaaaaacggcgctaccgaggagggtgcgatccagtgggatacgcggcatgaacgcctccgataggctccagcttctcatgctctccaaacgctccgtttcggacctcccgctctccaggcagagccccaatctgggctctgatgggcccatcagggttaagatgaggctccccaaggcccatctggataagttgatggaggagagcaccgacggctcccaggtggcccagaaaatcataagtttgtatatgggaaccaatgccggcgagggtgctgccggagtttctgcgccggaggacggtggccggaagactgtgcacaatcacaaaccacgtgaggtaaagagacactga

SEQ ID NO: 27678 - DNA, 671 bp, Glycine max
  Peptide Sequence Number=SeqID_119363
ccgcgaacgacaacaacctcccaaccgggtcgttctacctcggaaacaacccaaactccgcgcgcttccgctacgtcagcatgttgaccttccctcaaagtcaacgcatgccgaacctggacccattagcctacaccgtccccatgcaaggaataagaatcggtggcaaaaaactcaacatcccaccttctgtttttcgacccaacgctggcgggtcgggtcaaaccatggtcgactccggatccgaattcaccttccttgtcgacgcggcttatgatgcggtgcgggaagaggttattagagtggtggggcctagggttaagaaggggtacgtgtacggtggtgtggctgacatgtgtttcgacgggagcgtgatggagatcggacggctgataggggacgtggcgttcgagttcgagaaaggcgtggagatcgtggttccgaaggagagggtgctcgctgacgtgggcggtggggtccactgcctgggaatcgggaggtcagaaagattaggtgcggccagcaacatcataggcaacttccaccagcaaaatctatgggtggagtttgatctcgcgaaccgcagaatcggattcggcattaaggctcagaagtcgttgttgggatatgaaagcgttgcatctttactgtataaattaggcgatgagtga

SEQ ID NO: 27679 - DNA, 1908 bp, Glycine max
  Peptide Sequence Number=SeqID_119364
atggctgtggagtatagtatagggactagggttatcattgatactgataatgataccaatatgcggctttgtttggttaaaagttggagtggacattttgtatcaaagagaaggtatcattttataatccccatggacaatgggtggcataaacccttagatgaagattcaatagacaatgagaagcatctgctgcatggagtgattcattgcaatgggtatggtcatttgctttgtgtcaatggcattgaagaaggctccaaggttcttagtggcagagagatcatggatctttgggataggatatgcacaaacctccgagtgaggaagattgcagtggaagatgtttcttgtaagaggtctatggatcttcgcttacttcatggagttgcttatggacactcctggtttggtaggtggggttataggttttgccgtggaagctttggagtgacagagcgagaatacaatgaagcaatgacaacgcttggttccttggggcttgacgtgattgtaaaagatttgagcaagacaaagacaaagtacaaggcagaaatcaagcaaattattcggtgctatagagatatgagtgagactcatattatctcactcagggatcttctaaggtttatgctcactgtcaagtcttctcgtgctcctgtgcctaagataacagacacttattctgctgctgctgattctacttcttcagcattaacctcaagaaattcaaccaaacacacacttccaaacagatcaaattccatgaaggataaatctgtgaggtacaagaagttcagcaatgcagtgactagcatagatagcaggtggcccacaaggagactagagtttgcagctcaagtgattgtggatgcactgaaagagaacaaggctgtgaaaccaggctcaggtgggatgacaaggcaagatgtgagagatgcagctaggatacacattggtgacacaggcttactcgattatgtgcttaaatcactcaacaatgtgattgttggaaactatgttgttcgtcgcatggtgaatccaacaactagaatcttagagtacactattcatgatcttggcaaggggttaaaagcccctgaagtggagactgaagtgatggctcatgtagatcaacaagtagaagagtcatcttggaagcctggtaatgatgtatactgtgatgcattgtttttgtacaagaatgtgctattgagttaccctgattcagaagcagtggacacagcagttcagacaattctagacagcagatactttgtgaaggagtggccagtaagggatgaaataaaggagcaggtattgacattcatttgccgcttgcaaccaaattttgtggacaaaaaacatgagctgaaaggtgtagcatgtggtgagattgtagtggttccactgcatgcaacagttggtgacttgaagagagcttcagaggctgctctgagggacacttactgcattgcagagagtcttatagtgacagacatcaaagaactcatggatgtgagtgatgaggaagtattgtttggattaatccagtctggtgtggaactttgtgtgaggggaattgcaattgatttgttgacccctttgaagtatgagggtggatctgaatctgacaactggaaggtgaggtgtgagtgtggagctcaagatgatgatggggagagaatggtggcttgtgacatttgtgaagtatggcagcacactcggtgctgtggcattgatgattctgagacagtgccaccactgtttgtgtgcactggttgctgtgactcagtactagtaccttcttcaaggactgaatcaacagtctttggtgtggattctgccgattcttttctcatttcagaagactctacccttttactaggatacgagtatggatactaa

SEQ ID NO: 27680 - DNA, 135 bp, Glycine max
  Peptide Sequence Number=SeqID_119365
atgctcatgctcatgctcatgaagagattgtggaagaatgtggtgagagttagtgtcccagtgccaccaactccaatgttaccaaaggaaaacactaattcagaggcactgtttgcgggattcattaaatgctaa

SEQ ID NO: 27681 - DNA, 618 bp, Glycine max
  Peptide Sequence Number=SeqID_119366
atgccctactacatctccgtcctccaaatcagcgccgccgactccgaggcacccaccgccgccccctccgccatcgacccgatctccattatgtccaaacaaggctgcaaggccttcacggaccttctaagaggctccaaggcccttccatctttcaaggaaaacgttgacggcggcttaacggttttctgccccacccacagcaccgtcagcggtttcgcggcaaagtacaagaacctgaccgaagctcagaaggtttcacttctgttataccacacgactcccgtatacgagtcactgcatatgctcaagtccagcaacgaaatcatgaacattctggccatagagggagcgaacaagtacgacttcacggtgcagagtgaaggggaagacgtgaacctcaagaccaaattacatggattccctcccactcccaattataagttcaagtcaatatcttctcagacacaatctgtgaattccgatgctactgccactcagaatctttaccctttttgtccaaacaattatcacattgtccacttctattttgaattcaattcacaccacttcttggattctagattcagggacaacttccattatatgccatcttag

SEQ ID NO: 27682 - DNA, 633 bp, Glycine max
  Peptide Sequence Number=SeqID_119367
atgtcacactcacacctcaacagcttgtcttctaactgctccagttccatggaattggagattggagctactcatacagatcagacacttgagccttggtttccgtctgatacatctactgggtaccttcaagatgccattgcaggcaggggcatttggtgcaaggagcaaaatttactatcctgctctaaggatcaaaaggtagatgaatttccaatgttttccacaacaacggcccaatccttccatgattgtggctttacacaccaaaaaaggttcgtcacttcaaacctatcatcatcaccacaaggtgacacacatgaagctgcaatcaaacatgatcctgcttggagtagctatgcatatggtcaaaggaagaaaattgcttacccctttaagttggtgaagtctggaggaattgaaggggaaacaaccctcaaagatatcaataaccaaattctcaccaccccatcagcatcaaagccaattcctcatcctgtgaaagattctgtgacaaatccatgcaaattggtccgagaaagtattggtttgtctgggaaagaagtggcatcccttactaggattcacactcggggtagaggttccattaccattattaggaccaaggattaa

SEQ ID NO: 27683 - DNA, 792 bp, Glycine max
  Peptide Sequence Number=SeqID_119368
atgtcgcttctctgcttcacctttgtcccctcaatgctactttctattttctgtttcttcaattctgtaaccgccgccaccgagttcgacttcggaacgttaaccttgggaagcctcaagctcctcggcgacgcccacttgaacaacaacaccgtcagtctcacgcgcgacctcgccgttcccacctccagtgccggcagagccctttactcccgtccggtcagattccggcaacctggaaaccgtttttcggcgagcttcaccaccttcttttccttctccgtcaccaacctcaacccctcctcaatcggtggcggcctcgccttcgtcctctcgccggatgacgacaccatcggcgacgccggcgggtttctcggcctcggcggcggcggcggcttcattgccgtggagtttgatacacttatggacgtggagtttaaggacattaatggaaaccacgttggtgtggacctaaacagcgtcgtttcgagtgaggttggtgatttggcgaacgttggcgtcgatctgaagagcggtgacctaatcaacgcgtggatcgagttcgatggatcgagcaaagggttaagcgtgtgggtttcgtattccaatctcaaaccgaaagatcccgttttgacgatgaatctcgacgtggacaagtatttgaatgattttatgtatgtggggttctctgcttcaacgcaaggtagcacagagattcacagaatagagtggtggagtttcggttcgtcttttgcggcggcagaggcggcggcgcctcctcctccgccggcg

SEQ ID NO: 27684 - DNA, 585 bp, Glycine max
  Peptide Sequence Number=SeqID_119369
atgactcctaaacctttcaactttcccgccaaacgcacaaccgcacttttcctcctaaccgccactgccgtctccgccgcacaaacttccagctccgccgtgccctctcctctccccgcactctcccctgaaaaaatcggaggcgaaatccacggtctcatccgcaccgcacgtgccgtctccacggttgcatccacggttgttgactacgaattctcgttgcgcggccttccaaaggactccgatcagtaccgtcaaacgatttctcaggttcatctacgctctgccaagaggtttctcaagctatgcgaagccaacaaaggattttatgtgaaggctggacagttcgtttcggcgcagaaagtgcttccgaaagaatactcgtccactttgtcttccttacaggatcaggttgctcctcttccttttaaagttattggggaagtgttaaaggataatctcggacctgatttctctgagatgtttctgtcaattgatgaacaacctgtagctgctgcatctattgctcaagttcatcgtgcagtgctgaaaagtggtcatgaagtagcaatcaagaggatataa

SEQ ID NO: 27685 - DNA, 1311 bp, Glycine max
  Peptide Sequence Number=SeqID_119370
atggcgatacaaagccaaaatgcatttactagatcacggggtggtcttccaattggagatggaatatctttgaattctggtgtgcatcctgttgcagatattccactacatgatcagttttcttgtggaaatgactatgccttgaaggtaaggaaaccatatactatcacaaagcaaagagagaggtggacagatgaagaacataagaagttccttgaagccttaaagttatatggcagggcctggcgacggattgaagaacatgttggtacaaagactgctgttcagattcgaagtcatgctcagaagtttttttctaagattcttcgagagtctagtagaaacagtacaaccttggaggagtcaattgaaatcccccctccacgaccgaaacggaagccaattcatccttaccctcgtaaactagttgagattccaaagacagaaatttccaactcagaactcccactgaggtcgaattctcttaagccatcagactttggtcaagaaaacaattctcccaagtcagtgttatctacagttgtttcagaaacccttggttcctccgattcagatacacctactagatgtttgtcaccaacctcatccattagtgatgtccccacaaacagatttccactcgctgagcccaaaacatcatttgaggaagaagggtctccaccaagttcagctcatgataagcaacctcctgtgaaactggagttttttcacaaagaaagtgtttctaccaaggacgatgcaacagaagaatcatctggtcgtactctcaaactttttgggaccactctactgataacagatacatgcaaaccttcttcaccaacaatggagccatggaaaccaacacctgcggctgcaatgtatcttatgcaacttcagaatggatgttcagatattacagaaggtcctgcttctattgttccttggtggagtcttccccacaatacaccattcatgccactgcacaaggagccaaaagggaatcatatatactccaaccttggagagtttgtacataaagaagttcaaaaggaaggatcatggactggttcaaacactagttcaattaatgatggagataacattgaaaaatcagatgatcaagccaagagtcatgtgcattgctttagcaaaagtgaaatatcaagtatatctgagctaagggtaaggcctaaaacatgtggaaaagggtttgtaccatgtaaaaggcgcatggcagagagagaaagcaagtactcatcaatatgttacgaggagagggaagagcaaggtattaagctttccttgtag

SEQ ID NO: 27686 - DNA, 1524 bp, Glycine max
  Peptide Sequence Number=SeqID_119371
atgtatggcactgttacctcacacatcaagaggcaatgcaattctcctcatacagttattgttattggtgctggaatatcaggaattgctgctgcacgtagtcttcatgaagcatcttttaaggtgattgtactggagtcaagggataggataggtggcaggatttatactgattactcatttggctgtccagtagatatgggagcctcgtggctacatggtgtttgcaatgagaatcccttggcaccattgatacgtggattaggacttacactatatcataccggtggtgataactctgtcatatatgatcatgacttggaaagctgtatgctatttaacattgatggtcatcaagtccctcaacatattatgatcgaagttggagacacttacaagagaattctggcagagatagtgaaagtgaggaatgagcatcctgatgatatgcctattctccaagccatttcaattgtgttaaataaacatccagaactaaggctacaaggacttgctcatgaagtgctgcaatggtatatatgcagaatggaagcttggtttgcttctgatgcagatataataccactgaaaacctgggatcaggcaagtgccattatattagttgaaggatacaagatcttctttcccgaaaacttctacacatgtcctttttctgagcatgtcctcactggtggtcatggactcatggtaaaaggatatgatcctgttgtaaaagctcttgcaaatgatctcgatatacgcttaaatcacagggtaacaaaaatatccaatggttacaacatggtaatggtcacagttgaggatggcagaaactttgttgctgatgctgttattgtaactgtccctattggaatccttaaggccaatttaattgaatttacaccaaaactgcctgattggaaagcttcagcaattaatgatattggtatgggaaatgaaaataagattgccctaagatttgatagagtgttttggcctaatgtagaagttctgggcatagttgcacccacctcttatgcctgtggttattttctgaatctccacaaggcaacaggccatccaattcttgtgtatatggcagctggcaggtttgcctacgaccttgaaaagctatctgatgaatcagctgcaaattttgtgatgcaacaactcaagaagatgtttcctgatgcttctaagcctgttcaatatcttgtgtcacgttggggaacagatccaaactctcttggctgttatgcatgtgatttagttgggatgccagatgatgtgtatgagaggcttcgtgcaccattaggtaatctattctttggtggggaagctgttagtatggatgaccaccagggatatgtgcatggagcttactcttcggggttgatggctgctgaaaattgtcagagacatcttctacaaaaacagggtcacatggaaaatctccctctagttccttctgttagacatgaaatgtttgaaactactatacctcttcaaatctctagaatttga

SEQ ID NO: 27687 - DNA, 1164 bp, Glycine max
  Peptide Sequence Number=SeqID_119372
atgtcaagcaaattacagccctctcagtcctgtaactttcttgacgaggtatcatccatgaaggaactcgcttcacatggcctcctctatacactctctcaatcttgcaaggaatataatgatgttgtatctgtgttggcccctaacattccagcaatgtacgaaatgcattttgcagtgcctatggcaggtgcagtgctaaacaccattaacacccgtttggatgcaaataacatagccaccattttacgtcactctgaagccaaagtcttgtttgtggactatgagtatgtccccaaggcaaaggaagccttagaattgctcattgccaaaaagtatcattcatctcctccactactcattctcattgatgacataaactcacccactagcatacaatttgttgagttagaatatgagcaattggtctataatgatgattcaaacttttttccagagaaaatccatgatgagtgggccccaattgctttgaactacacatcaggaacaacctcagcatctaaaggagtagtttatagccatagagaagccaagccaagtgaacgttttgaaatcaaatccattgtggaaatactcacgggtggagcaccatcaccaccttctttgattgagaagattgagtctcttggatttcatgtcatgcatgcatatgggttaacagaagcaactggatcagtgttggtgtgtgagtggcaacaacattggaatcaactcccaaaagatgaacaagctcaattgaaagctcgtctaggagttattatattgacacttgaagatgttgatgtaaagaaagttgacacaatggaaagtgtgtcaagagatgggaagacaatgggagagattgtgttaaggggaagtagcataatgaaagggtatttcaaagatctagattcaaccttaaaagcctttagtgatgggtggtttcacacgggggatgctggtgttatacacaaagatggttatttggaaataaaggatagatccaaatatgtgattatttcaggaggggaaaatattagtagtgtggatttggaatatgtgctttataagcacccaagggtgttggaggctgcagtggtggcaatgccacatccaagatggggggagagtccatgtgcatttgttgtgttgaagaaattttaa

SEQ ID NO: 27688 - DNA, 336 bp, Glycine max
  Peptide Sequence Number=SeqID_119373
atgctgatagggaccattgattcatacacaagaatcaatcacaacacggtggatgggtcaaagtgtattcgtgatacaccatttataaatggagccttcgtccgcctcgtctaccacctcgccaactccatcgagatcaagttcacttgcaccatcaccagcgccggcgccagcgagtaccacatcgacgaatccctcgtcaattgggtgacctacaacaacagactcaagtccctaggcattctcgttaaagctcgcaatttctttgtctttcaggtttccttggagaagcactgttttacttttatatccctgaaaaatgctaaagtgggatag

SEQ ID NO: 27689 - DNA, 549 bp, Glycine max
  Peptide Sequence Number=SeqID_119374
atgcctaaaccaacagctgtggctttgttatatggacagcaacaacagcagacttctcatgagaatatgggcagtggaactgagaaaattgctctcattttcaatatgggtgctggttattgtgatgttgttgtcactgctacaacgggtggagcatcacagattaaagccttggcaggaagtaccattggtggtgaagacttgcttcagaatatgatgcatcatctgctaccaaattctgaaaatctatttaagaaccatggggtcaaagaaattaaacagatgggcgctgtcagcagtttcgcgccaaagtacaagaacctgaccgaagctcagaatgtttcacttctgttataccacgcgactcccgtatacgagtcactgcatatgctcaagtccagcaacgaaatcatgagcactctggccacagagggagcggcgaacaagtacaacttcacggtacaaagtgaagggaaagacgtgaacctcaagaccaaagtcaacactaaaattgtcaataatatatattacaataagattattttgtaa

SEQ ID NO: 27690 - DNA, 462 bp, Glycine max
  Peptide Sequence Number=SeqID_119375
atggatgcatgccttgaaggtaaagggtcggcggctagtactcatgatgcttcacatattaatactcccaaggatttttgtagtgtggataatactaatgtgaagggaataaagactaaagaaagggtccaaggattgtctgctaggcaaaaacgtggcattgagaagagaaggaaaaaacaaaaagttacacaagaagatgaaccttctttgcaaaactttaattatggattgccttcatttcattctggtcaggtttttacttttatcatttatctgatgtatccacggatgtttcgagcaatatccataaagacacaagctagtcacaacaagagcatgatggaattgttgcaagaacaattatcaactactacacatgagcaaatgatgtcatcgatttacatagccaagatcaagaacgcaatccataaagcaacttatcatactgttgttatataa

SEQ ID NO: 27691 - DNA, 789 bp, Glycine max
  Peptide Sequence Number=SeqID_119376
atggagcttggagatagcagcaagaagagcaggttttcctcttatgagaaagtagcagccataagcttggtggttctagctgtggcttctcctctctatatagaccatagaccagagagtggggtggggtttgagaatcaaatgtcagatggtaaggttggaggtcgcagctgcttgtcgttgtccacggttggactcccccaacttacgaatgatgaaatcaacctgaccgatggaaccctcccgacgctgggaaggttgaagtcgtcagagggaacgaagaggctgtggaacagaatcaagcagggggcgaaaaggcaagaggtgcttcaaccaacaggacgtgctgacactagggttagaagctacaaccaaggtttaagcgcgaaaggggaaagaggttgtgatgtaataatcactaaagataaaggggtttctagggttcacgcagaaatagttgttaatacaatgaacccgaatgatggggccaagaaaaaagttcatgagctaccaaacaaagatacagcattagaggatggtgaccttgtttcttttggcactggtactgctacctacaaggacatgcaatctcattacatttgtctgtttcctacttatgtctgcttaaatgcttgcaaatttaatctgacaggtgctggtattactcataccttaggtgaagggtgcacacatgtgctggtggatcaactcatgccattgaagaaggatcttgttgatgctgttgtgaccaaaaaatcttgtgttctcaaaaattggcttgaggtatag

SEQ ID NO: 27692 - DNA, 141 bp, Glycine max
  Peptide Sequence Number=SeqID_119377
atggttgaggttgggccattgaagaaactgtgtggtgaatggataaatttgaggtgggaaatggcaattgaaggtgatggtgagggtagggtttatatagagattgaggatgaggatgaggaagaggaagagaaaagatga

SEQ ID NO: 27693 - DNA, 855 bp, Glycine max
  Peptide Sequence Number=SeqID_119378
atggtagacaaccagaaagataacgggacagcaaagaaagaaaagaggaaacgaaacggtggaagtagcagtacttcaagagcaaacgtgttatctccgaacattgtgccagaaagcaatgacaatcaaaatgtctctgatctccctcaaagggaccacccgaatgagccacatgccgagccagataatcctgaagaacaaccagcagcagcagctaaaaccacagaagcaaggaaccaatatcaaagcttaagggaactttttaatggagaaagttcaacgccatgccttgcaagtgatgtacatgatcagaccaatgacaagggaaaggaagtgcataaaaaattcccaacaataatagtcttagaagaagaatgccaaaatgctgaacatggctgggctgatgatgctcctgttgctgctgccgaaaccggttttcaccaaaaaaatggtgaaattgatcaaaagggaaaaggcaaagtgcatcagactaatccaccaaaactgctagcagatgccatgaagagcagcatcatcaacccattctctttaagttcaagtccatcatcttttttgcacttagaaggtgcaagcttctcaagttggtctaaaccaaacaactctttgtctgtactctcttttagttactctgacttgcaaaggggtgttggaatgcaaaaccctatgggtccatttccaaagcagcagccattactactctctgctgagttgttggtgccttctgggatggaggggaggtggatgagaaatctcgatcttaaccagccaccaccacaagatgaggaactggaagaggcacaaaatgaagtggataatcattatctaagagattaa

SEQ ID NO: 27694 - DNA, 201 bp, Glycine max
  Peptide Sequence Number=SeqID_119379
atggcgaatgctagaggaaaaacaccaccatttccatcttgtgatgtggccatcaacagggtcccacgcctttttacattaactgaaaatccaaaatactctatcaaactgacggtgttcacgactcaccgtgttgccaataatatcgtcatgcagtatttgaaaataggatccaggagagtgattttgcatgtgttttag

SEQ ID NO: 27695 - DNA, 897 bp, Glycine max
  Peptide Sequence Number=SeqID_119380
atgggactcagttacattgcgaggcctctagatgaaatcaaagaagcaacaaaagaggaaagactttgtgctctggaggctgcagaggcaatccaaatcaatttgaactcatcaaatccatcatttatcaagtcaatgggtcttccttctaaattttgtgaggaacatctgccaaaaactttacatgacatggttttagaagatgaaaatggctcagaatatgaggctgtttacattggcaacagagctgggcttagtggtggttggagagcatttgcattggatcataaactcgatgatggtgatgcccttgtttttgaattgattgaagcttcaagatttaagatttatattgtaagagcatttccagattcagttgaagaaaagggaaataatattttagaggaagaaggaaatgtgcgtgcaaccaaagcaccaaaagctgcctgtaatcttgaatcggaatgtaagacaaaaaagccaaaacaggctgcagtttatgaaactaaggaatcagagagttctcaggaatatcttctagatagcagcattgacaacgaagtgaaaccacagggagtaaatccaactaataaggaaactaaattttctcagaaaaatacgccaaagaaatctaaatatcctgctactgctgattcaaaagggaaagtgcaaattaaaactgagaaaccaaaggcatctataaagctgtcaaacaatacaaggaagtcgaaagaaggtataaatgaaattggtggttcagacaagttagagaagaatgagtttgttcaggatgctgatagcaagttagagaaagttgaactagttgaagaagcaagaaaatgtgtcacaaaaaagctagaaaaaaccagctccaaatttttcagaaagaaagcataa

SEQ ID NO: 27696 - DNA, 957 bp, Glycine max
  Peptide Sequence Number=SeqID_119381
atgagggtcagagccagtttctttgtgctgttctcattgtcatgccttctttgtgtgttactttcaagtgctcaacaacttccacctgatgctgttgtttcggctcgtttgttagattcccatcttcaagattcggcctttagggcccttttcagtccaataaccggtgtgccctatgatgctcaagtgcccaccaacctttcagggatcaaagtttcagcaatgaggcttaggagtggtagtttgaggacaaggggtgttcttagctacaaagaatttgagatcccaattggggttgttgagaagccctatgtggagaggcttgtgttggtgtaccaaaacttaggtaattggtctgatcaattttaccctttacctggtttttcatatttggctcctgttttgggcctcttggcctatagtggaattaatttgtcagcctcagagttacctgagttggatataagggcttctgagaagccagttttggtcaattttcctcatgtgaggccagcaccattgggggcattggccaaatgtgtgtattttgatttgcatggttctgtgcaatttgacactctattacctgggaatgtgtgttcaacaatgcaacaagggcacttctctatagttgtggaatccaatgcaccatcaccagcgcctagtagtggtggggaatttcaagatgctagtgggaagaacaataagaaaaataacaagttcatgttgaggatattggctccatgtgtggttggtggaattgtgttgttgattattattttgggtctattggttgttttagtgagaagacacacgaaagggacaaggatgcagcaattggaatgtgtagcttatagcaatgaaatcatggatatgacatccattggtgacatcaaagtaccattagcatttgggactcgtacaagaccaatgatagaacatgattactttccttag

SEQ ID NO: 27697 - DNA, 264 bp, Glycine max
  Peptide Sequence Number=SeqID_119382
atggcaaagggttgctccaacaacacttatgaagaggctagaaaacaaagacttgaagaaaacaaaaagaggtttgaggatttgggaatttcgaggatttcaaaaaacttgactgaaatcgcaagttctgcaaagaagaagctgcgtcatgttcctaaacagaaaacaaagaagacaaatgttgaagtggaacctaggcgatcttctcgtgtgcgaaacccagttcgttcataccgtgaagatgagcagacaacaagcatgtga

SEQ ID NO: 27698 - DNA, 519 bp, Glycine max
  Peptide Sequence Number=SeqID_119383
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttgcttttcggactaaggtgttccacccaaacatcaacagcaatggcagtatatgtcttgacattctcaaggaacaatggagcccagctctaaccatttccaaggttgcatttaggactaaggtccttttgtcaatttgctcattgttgacggatcccaaccctgatgatccacttgtacctgagattgcacacatgtacaagaccgacagggccaagtatgaggctacagcccgcagctggacccagaagtatgccatgggatga

SEQ ID NO: 27699 - DNA, 1998 bp, Glycine max
  Peptide Sequence Number=SeqID_119384
atggcagcttctggggttcattctagcaagcaaatgaggaggttggaatcgaggaagtcacattcttggtggtgggatagtcacatcagccccaagaattctaagtggctttcagaaaaccttgaagagatggaccggagtgtgaagcgaatgttgaagctgatagaagaggatgcagattcatttgccaaaaaagctgaaatgtattatcagaagaggccagaattggttgctctggttgaggagttttaccgtgtttaccgggctctggctgaacgttatgatcatgtgacaggagaattacggaagaatataccctctgatctccaatcccaaggttcaggtatttcagatgctggctctgaaccatcctccacttggccctctccaactccaaagagggggggtcgtcttaaatctagtacccgagctgctgggtttgaatactttcttggctctagtggaaatggtactgatgtataccaaaaagatggggatgagtcttctactttgacagattctgaggaggaatctgatgattcatcagttaacaattattcaggtttctcacggaatggtagtgatctagggataaacagaagaataatggagttggaaactgagctccgtgaggtaaaagaaaagctatggatgcaggaagaggaacatgcagatggttcaactaggggatcaagaaatgagaatactgaagatctttataccaaaattaatgcatatgaacaagaactaatgactgtgaatgagaagttaagactttcagaagaagaaattactaaacagaagattgagcttcaaaaatacagactcttcaatacagaaaatttggaggctggttttgagtcatcactaacgaaaaaacacatcaatgaaggaggggaagcacacaagatgatagaggttgagggaagcattgatggtgtggataaggaattgtttgaccaaaatggtgagatcgagacgcttgcgagggagctaagaattaccaaagaaaatctcaaagcttcggaaatgcaaattacttcactgaaatttgaggccaataaatcatctgaaagaattcagcaattacatgatcagcttgagttggctcgtaaagacatttctacttggaaaaccaaattcaatagtgagaaaagagagagcaccaaactccatgaaagacttgcgaggttaaggactagtctatcagatcgtgaccatgagatcagggatttgaaaacagaagtatctgatgccgagcagaaaatcttcccagagaaagctcagttgaaatctgaaatgtcaaaggtgctggaggaacggactcatttagaggaacagatcagagaatgggaaagtcgaggccgttgttttgaagacgatatcagaaggatccagtctgaaaaaatggagatggaggaggcactcaagggtgagattcagctgttaaaggcaggaattgagcagagagagaacaacataaaagaactcaacacaagcattgatactttaaaactagagaaagataatctccacgtagaagttggttcactcaaggaagaggtgaactccagagatggtaggattgaacacctgaacagccatttgaacgagcttcacgtggaacatgtacaactgattgctggaatggaggaggcacacaaacatgtggaagaactaaaatcaaaagccaagcaacttgaggaagaggtcgagaggcaaagaaccgtgatcttagaaggagcagaagagaaacgcgaggccataaggcagctatgtttctcactcgagcactatagagatggctataatatgcttcggcagcatgttatggggcacagacgagttccagttttggctgcctatcaaggtcatgtgtactactacggagaagtgatgaccatgtttgcatggtgtaagttatactctggcttgttagctatacgcctaataccacaatatgctgctgatgccattgctaagataacccttccttaa

SEQ ID NO: 27700 - DNA, 309 bp, Glycine max
  Peptide Sequence Number=SeqID_119385
atggcttttgcaaaaaggaaaattgcggtgattctgttcttgttcatggtaacagcagcaatagcaagtaacgctgctagcaagcgtaacactgtttatgaatttggtccaacggtgcaaggggaatatggtaattcatcagcgaccatggagatcagccgagcctcagcaaatggttttcctctgccattattgcttcccactgtcattttctgtgttcttgtgttcttcggttccaaatttttagtttttggggttcctatattgtttgttcttgccttagttgttgcctttttgggacttaggtag

SEQ ID NO: 27701 - DNA, 192 bp, Glycine max
  Peptide Sequence Number=SeqID_119386
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggataacaacagataaagatgatgcacaaatggagaataattaa

SEQ ID NO: 27702 - DNA, 150 bp, Glycine max
  Peptide Sequence Number=SeqID_119387
atgttgcctccatggagaattgttgttgtgccctggttatcaagatccagatctggatccactaaagtcaagatccagatccacactacaactgaggcagccatggttatcaaactcgcaattgaacttgctcatcatttgagcttatga

SEQ ID NO: 27703 - DNA, 903 bp, Glycine max
  Peptide Sequence Number=SeqID_119388
atggaaagagatatgataactatgatagtggacacactgtcagtgttctactatgagaagatggtgggttacatgccctctagcttcacagatttggtatttgcgggcgagaggatcgaggtaggcttgagaaggggaaagttcgataatgccactcttggcagcacgagcaataggagattcagagcaagtggggccaagaagaaggaaggagatacccacgctatgacttcagctcctacttggcctaaatcccaacaaacccctcacaacacttaccaatattccccacaccaaccaagattttccgcccatgtcaaaaacccttccaatccggtgcccgtccagcaaagagtgcccactcaacgcaaaggcctcccacacaatctcacccctggaggaatgtggacctcggggccgaagcagatggaagatgtgttaacctctaggaggttcatattagaggtgttgcacgaagcgggcatgatttgccttgtcgggggcatgctcagtggcagaggacctgctacagggtttgatggacaaaggcctgattggggtttatggcacgagaaaggagggaaaggatgcttccaacctatcccagtcaagaaacctgcactgttcccctacaaaagtgacaaggcggtaccatggaggtacaccacacaaggacccgatgaaaggaaggacgcgtccgttatacacgctaaagatgatctatccttcgctaaggtcactaacatctttggcacaagtagcatgacccgtagcgggcagatcttcgtggcacccgaactattggtgccatccaaggacccaagggggaaggcaaaggcgggcatggaagagagcgataaggcagacttgttcgacggccggcaagtgcaccagatcgagcaa

SEQ ID NO: 27704 - DNA, 561 bp, Glycine max
  Peptide Sequence Number=SeqID_119389
atgcatgctttgttagggtcattcaacagtggaaactggtctgattctgatgaccttgataggatagggctaagttgtcatactatcacgaggaatggggacaatttagttcctctagacttagaaattaaagctacattgagaaggaacagggccgagagaagaaggaaacttctgcaagacataatagttgcatccattcttgaggaagaaactattttttctgattcattatcacctgattcaccatcatcaagggaattcgctactcaattgcctgaaacaactagcatggaagacgagcaacaccagaagatcacccttgaggattattcaagcagctcggggaatttattccaaggattacctaatgaagacccttatgaacatttggcaacattcattgaaatatgcaacactgttaagattgccgaaaaagttgttgaaaagttcctaaagaaatacttcccagagtccatgattgcggaagggaaagctgcaatctcttcatttcatcagtttcctgatgaatctttgagtgaagcattgaagaggttatga

SEQ ID NO: 27705 - DNA, 210 bp, Glycine max
  Peptide Sequence Number=SeqID_119390
atggctgaagagccaagaagagtaaccctggaagattattcaagttctactgtgccacaaatttttcactatctacccaatgaagacccttatgctcacttggccacctacatagagatatgcaatactattaggctggcgggtgtgcctgcagattcaatcaggttgagtctgttctcattttctttagctggagaagctaagagatga

SEQ ID NO: 27706 - DNA, 621 bp, Glycine max
  Peptide Sequence Number=SeqID_119391
atggtggggtacgtgccttcaagctttgcggatttggtcttcgccgatgaaaggattgaaatgggtctaaaaagaggcaaatttaatcatcctgcttggacgaatgagaaaactggggcaaatgaagaggatgagaaggagggagaaacccatgctgtgactgcccattcatatacggccaagttccccacaagctcaacaccatcattactcagcctatatcagccattctcattacccaccacccatttatctataaaggccatccctaaatcaacaacaaaacccacctaccacacaaccaatgctaaacaccacctttatcacaaaccaaaacaccaaccaagaaatgaattttgcagcgaaaagcctgtaggattcaccccaaattccgattcatatgctaactttctccattatctactttatactacaatggtagccataacctctgctaggtttcctcaacctccatttttccgaggatacaactcgaacgcaatgtgtgcttatcatggaggagccccagggcattccactgagcattgtagggccctgaagcgtaaggtgcaaagtctaattgatgcgggctggctgaaatttgaggagaatcgcgtatga

SEQ ID NO: 27707 - DNA, 474 bp, Glycine max
  Peptide Sequence Number=SeqID_119392
atggaggtccctactgctcataaggacctgatttgggaggatattcaggcggaatttgatatcccagaggcttctgacagtaggacgaaaaggaagttactacagaccgtgggggagagatggaggcagtttaaatctaacctcacaaggaaatgggcccttgcagccgatcaggatggtgtcgaggacactgatgtgcgcaagaaggcacagaccatccagaagcagaatactgccccccacgttttgtctcgtgggggttatgattatttggagcagaagctcctggctgagaagacgaagaagaagctggaggaagctgcacagtctggaagcattgatggcgtcatcgaccctccatccccggtcagacgccacgtgaagtggaagatggcccgcacgaagaagataggggagatgacgactgaggccgcaaaggaaatcactgagaagattgattcgtttgaggagtag

SEQ ID NO: 27708 - DNA, 588 bp, Glycine max
  Peptide Sequence Number=SeqID_119393
atgagtagttcggtccaggactccaccccctcgagagcaggatgccggccgagatggagctgggagccaacctatactttcctggggcttgccttgccccaacatctaaatcaaatgcgggcgccgaaaaggaaccagcccagcctcttccagaaagctttgcttggtaggcgctgcctattcacttcactcggacaatgctctaaacacgaaagtgtgacgcccccttctcccatgctgagtcacaggcagcgcctcggaaagcgcggacgagccacatgcagggaaacttgcacgtgtggttctggccggggaccccggtatactgtactaatatgtgtaggtccccgtaattcgagtgagattgtcatggcgcaaaagcagatatggtccggtattcccttgttccctgtattggttatgttcttcatttctcgtctagcagaaactaatcgagctccgtttgatctcccagaagcggaagctgaatcagttgcaggctataatgtagaatatgcgcgggatgcgatccttaatagtccactgttggcggaagccaatgtccggggtcccggggactcattctga

SEQ ID NO: 27709 - DNA, 549 bp, Glycine max
  Peptide Sequence Number=SeqID_119394
atggccacaatgatggaggccatgatgagcatgaagaagataatggaagccaatgcggttatagttgccgctactagcgctgtcgctaagcaaatgaatcatccaacctcaaatatggtaggcaaagatttgggaagtacggatgaccccatgatgtgcaaattcaaaacaagcacgccttcccgccatatggtttgcctcccaaactatacaccacccaatgtggtgtacattcccaatgaggatgtcaataactccactcccatactcattaagagccaacaacctcaatctgatcatgcacatgtctctcgacccatggaggagacacatgaaattccccaccacgatctagccaacttcgagccttgcctcggatatgctgctgaagggcaagcagttggtggtatacccctacaaaacactttggagggccctcaatatcatccacaaccacaaccctcacgttccacagcggttaaaaaccctcatgactatggcaggaatgggaaagttggatcatctagaggaaaggctcagggccattga

SEQ ID NO: 27710 - DNA, 475 bp, Glycine max
  Peptide Sequence Number=SeqID_119395
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctgttcctgcctttcggtttaccggtgtcattccgctgtatgggcgcgtttgtctcattccacgcctgacactcagttcccgggtaagcagttcgctccaaagctggactt

SEQ ID NO: 27711 - DNA, 219 bp, Glycine max
  Peptide Sequence Number=SeqID_119396
ggggagtaaactatatgcaaatagatattttctttgctgttgctcctaacctacaggtggttgtcatcatcaaaaagggggagaatgtaaatcatgaagattttgatgatatcaagaagaatttgcttgagaaagggggagatgtaaatcatgcaagctttgatggtgtcgagaagaaatcacatgtttgtcatcatcaaaaagggggagaatgtgaat

SEQ ID NO: 27712 - DNA, 298 bp, Glycine max
  Peptide Sequence Number=SeqID_119397
ggctttccactcgcgctacccgaaaggaactagaagtaaccttttctctaagctaagccgcaaagaaactggaacaaagaacaaggatttcatccaagaaaacggatctcaggcatttctttcttatgcggtaaagacagagtcactgaaggtatctaaagaagggagagcggtaactagtggtcgtgattcaaggcgtgccggtggcgaccaaaggaggccattcaacttgaggggagggactgaaaagtctaaagctaaagcagcaggagatggatggagcgatcaactactataa

SEQ ID NO: 27713 - DNA, 138 bp, Glycine max
  Peptide Sequence Number=SeqID_119398
atgaggggtagaaccctgagaagagactttgatggctatggacttgaacttctcttcgaaatctaccataggctctttcaagctctgcctttaaggttgacctcatcactttcttccgaagctttaacctcatcgtga

SEQ ID NO: 27714 - DNA, 783 bp, Glycine max
  Peptide Sequence Number=SeqID_119399
atgggatcaagtcaaaagccttcgcttaaaaagaggttctatcaagtcaaaatcaagagcttagaggtcactagtttaggagagttggggcaattaatgggtcaacttcaacgggtagaagtctccatggaaccgattgcatccctttcccagtattatgaccagcccctaaggtgcttcacatttgaggacttccagctagtgccgactgtgaaagagttggaagaaatcctgggatgccaactaggaggaaggaagccatatcttttctttgggttctatccctccacgacaagagttgccaaggcaaatgggctttcttttattgacatcttggcgcttttgatctttggagttgtcctctttccgaatatggaagggttagtggacctagcagtgattgacgctttcctcgcctttcatcatggcaaggaaagcccggtcgtcgccattttggccatgtatgacacgttcgaccggggatgtgaaaagagtggcgcaagaattgtttgttgtgcacttgctctctatgtgtggctggtttcacacctttttctccaagaaggtaggcccgtctatccgctacaaggtcaccgctcgtgcgtcgaaaaaggaaaggcgaattgggaccaactcttggctagcatggaggggcgtctgggttgtattaattataatcccatcctcgccataagacagcttggctaccccatgagaggagtgccgtcagacgaaagcatcacgcctttcatcgcacggggtttcagtgaccccaatgcgagg

SEQ ID NO: 27715 - DNA, 543 bp, Glycine max
  Peptide Sequence Number=SeqID_119400
atgacgttgttacttagcaacattctgcccagtgatcgtaatgccgatctccccctgcggaagtatcagttgggatcgcacccacaagacacccagtggacccggaaaagtccaacagggccctggggtttccagctctggttacgggcctctatcagtcctacaaggtgcccgtacccccccggcaagggatcgcgcctgcaagacacccagtggacccgaagaagtccaacagggtcttggagggttcaagctctaattacgggtctctgtcagttctacggagtacctgtcacctccagcaagggcatcaggccccctactaatcgagctttcatcaagaagtactgcgtctccaggcaggcgcagggcgaaacaccacagcagcctggggatggccggcagcgggcaacagacgcaccgccatcacctctagagttcacctctgctcatccacaaaaaggtttgagtattgcctacaccacatggccgaccaataggcgaccaagtccaaagccaaaggacgcacctagttgctcatga

SEQ ID NO: 27716 - DNA, 348 bp, Glycine max
  Peptide Sequence Number=SeqID_119401
atgtgggcatgggaacaatgtccaaccttggctccaaagaggactccttcccaagtagaaaataaaccactggggcacaggtggctacgacgtggaaaccaacatatcggcaatgatgatgtgagagtttttcgtcgcaagttggatattatgaaacgtcatgagtttgtgtgggagccttacacagcaaccgttatatcattgttgcctcccatttgtgtactcagaagtgtcgcgtggtacgcggtggtgccactaatttgtttccaagttattgagtggcaccaaccggacaaagtattgagacaatttgggatgcagcaaccaattccagagtctccttcgtaa

SEQ ID NO: 27717 - DNA, 420 bp, Glycine max
  Peptide Sequence Number=SeqID_119402
atggatctttgtattagagatgaatggggaacttttgtaattgccaaaactactaccatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 27718 - DNA, 156 bp, Glycine max
  Peptide Sequence Number=SeqID_119403
atggcagaaatcaaccaaggtacggatgcaagtggggatggggtcacgaccgaccaatcgttgccccttcccggcgctaaacaagcagagaacgtcgctgcaaggcaacccagtatcctttatggttgcagtttcttttactattgtttgttttaa

SEQ ID NO: 27719 - DNA, 732 bp, Glycine max
  Peptide Sequence Number=SeqID_119404
gccattacgtcactcacccaatactacgaccagcctttgagatgcttcacgttcggagacttccaattggtaccgaccattgaagaatttgaagagattctaggatgtcctctcgggggaagaaaaccatatcttttctccgggtgtctcccctctttgagcaggattgcaactgtggtcaaagattcagcaaggggtttggaccgcgtaaaacaaactcgaaacggcatagcgggcctaccacggaagtacctagaagacaaggcgagggatatggcaaatcaagaagattgggtcccgtttatggatgtgttagcattactaatctttggggtcgtcctctttcctaacgtagatggtttggtggacctagccgccatcgacgcttttctcgcataccaccatagcaaggaaagcccggtggtagctgtcttggcagatttatttgacacatttgaccaaagcgcgatcaattggtttcctcgttggaaggaaggcaaggaaggagttcttttctcatgtggggactaccctaatattccattgatagggactaggggtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 27720 - DNA, 159 bp, Glycine max
  Peptide Sequence Number=SeqID_119405
atggacgaagatcaggggatgtatgatagtgtaatgtccgaaaaagtttatatgaatgaccaaaatgaagacgaaggtggtgtgaatgaagaacatgttgattgttctgatgcgttcaatacttttcaggtgtttgctacccgtgatgatgttctgtaa

SEQ ID NO: 27721 - DNA, 355 bp, Glycine max
  Peptide Sequence Number=SeqID_119406
atgattgcgcacggtctgtccgcagccggtctcttcatcctgtgcggccagctgtatgaacgtctgcacactcgcgacatgcgtatgatgggcggtctgtggagcaaaattaagtggctgccagcgctctccatgttcttcgcggtggcgactctggggatgccgggcaccggtaacttcgtcggcgaatttatgattctgttcggcagcttcaaagtggtaccggtgattaccgtgatctccacctttggtctggtgttcgcttccgtctactcgctggcgatgctgcaccgcgcttacttcggtaaagcgaagagcgaaattgctgcacaagaactgccggggatgtcgctgc

SEQ ID NO: 27722 - DNA, 231 bp, Glycine max
  Peptide Sequence Number=SeqID_119407
atgatgataacaaaagatgatgacaaaggagatgacaaaaagctcaaagatcaatcaaagaacaactcaagtgaatcaaagatcaatcaaagaacaactcaagtgaatcaagaacaattcaagagttcaagatctcaagaatcaagatcaatattcgagactcaagattcaggaatcaagagaaggcttaatcaagataagtatgaaaagtttttctcaaaaattgagtag

SEQ ID NO: 27723 - DNA, 747 bp, Glycine max
  Peptide Sequence Number=SeqID_119408
atcctaggatgtcctctagggggaaggaaaccatacctcttctcagggttctacccctcattggccagaatttctaaaaaagtccaaatctcggcgcaggaattagaccgccaaaggcaagtcgaaaatggggtggtcggaataccgagaaaatatttggagggagtcctctttccaaatgtggatgggttggtggacctggcagcgatcgacgtttttctcgcctatcataaccacaaggaaagtccggttgtcgctatgctagccgacctatatgacaccttcgaccgaagatgtgaagaaagcaatgcaatgattgtttgctgtactacagctctctatgtggggctggtttcacacctttttctccaagaaggtaggcccgtctatccgctacaaggttaccgctcgtgcgtcgaaaaaggaaaggcgaattgggaccaactcttggctagcatgggggggcgtctgttaattggttccctcgctagaaggaaggaagaatcaagattctatcttcatgcgaaggatgacaaagagcttaggggaagcagtaatgggagcatcggcggctatcataagtggctgagagtccggacacaaggattggattggctcccaaatctaaagattgtgagagacgatgaggttaaagcttcggaagaaagtgatgaggtacaagccctaaaggcagatcttgaaagagcctgggtagtcgaagagaagttcaagtccatagccatcaaa

SEQ ID NO: 27724 - DNA, 228 bp, Glycine max
  Peptide Sequence Number=SeqID_119409
atgacattaaccatcccagagcttttcttgaggccttatcaggttacatgggataccaccgtgtttggggtctttaatccagacttttcgttctacatagagcacgaagaccgagaattatatgcaaatgggcttgaatccagaattgggcttgggcttgaatccataattgggcttggacttgaagagagcagactattttattccaccaaatcctatcttatctag

SEQ ID NO: 27725 - DNA, 327 bp, Glycine max
  Peptide Sequence Number=SeqID_119410
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccggggtagggcagttcgctccaagctgggactgtatgcacgaacccccccgttcagtccgaccgctgcgccttatccggtaactatcgtcttgagtccaacccggaaagacatgcaaaagcaccactggcagcagccactggtaattgattag

SEQ ID NO: 27726 - DNA, 729 bp, Glycine max
  Peptide Sequence Number=SeqID_119411
tttaaggagcaggcgtcacagggatctttcatcccccatggacgtcaggatattctcactgctactattggacgtccagaacaccctggacatgtccgtgctgctagagccgatgccacaatcaagcaatactttggatcgactccacggacgtcctgcagctcttcctcactacctcctgaagaattgcagcagctgacccagcaaatcagggaccagctagaggagtcgatcacagaaaaattgactcggcaactcatggcatcgttcagccagatacagtcccagtttcagttccagatgcaatctcagggacttacactgcctccggagcctctggttggtccctcaggtcctcgagtaagcacaaaggagagttgtgttgatccctcaggaaacgatcctaggacaagtgactcagacaggtgcagcttgtacatcgaagcaaatcctgtctgcctggttgccctgggaagagtttatgagggatccactgttgttcataacactcctttgttgcctggacaagtaaaggtgggtgtggaggaggttaaagatccagatgctcccattcctgtacccactgatgaggtttccttagtggggctggcaattcacatcttccttgcttggccgacacatctggtcaagcctttatcacaccagttgtgtctccaacaaaaccacctcaaaagccggatccggaggtcgatgatcctctttatctga

SEQ ID NO: 27727 - DNA, 684 bp, Glycine max
  Peptide Sequence Number=SeqID_119412
atggattgggaccagctcttggccgggataggaggggttgtattaattacaatccccacgctcgctataagacaactagggtaccccatgaggggagcaccgacggaagaaagcatgtctcctttccttgtgagggatctcgggcgcacaaaattcccaagactatacaaagaatccataaggcatgggaaaccccggttaaggaaagatcaagagcttagaggcattcgtaatggcatcattggtggcgaagagaattttgaagcaccagaagaggacgaagaagtccaagctctcaaaagcgagttaggaaaggcaaaactcgccaaggagaagttcaagttggctgctacacacgttcggaaggagtgcgccgggttatgggaagagaatgcaattaccgcaagagcccttgaacaagagaccaagagggctcgcaaggaagagtatggccggaacaaatttcgcggagctctatggggtagcaataatgaaatcaagttgcgaagggaagaaagggaccagtcgcgagcacatagcatggttctgaaagaggagttgattgcttgttcaaggtccaaaagaagcttgtctcagcgtctatgcgagacagagaccaacatgttagctatcatcgccaagtaccaagaagagttgggtctaggccacggcccacgagcatag

SEQ ID NO: 27728 - DNA, 294 bp, Glycine max
  Peptide Sequence Number=SeqID_119413
atgtttgaatttgatgctgagagtgaatctgaatttgatattgattacatgtctggtgatgttttacctcttgagattgattttctagggtcagatagaactaaccatgcttcaggaagttcatatacctctgactttctttatgaggtacaggctgagaaaccatctctttctaccactatccagccgcccacaccagaattgaagcctctgccatcaaatttaaaatatgcttacatggatgatagcaaaaattttccagtaattatatttgtctcccttgctgatgagtaa

SEQ ID NO: 27729 - DNA, 884 bp, Glycine max
  Peptide Sequence Number=SeqID_119414
atgattcctggtccaggccctgttcctgagaaactggtccctaaaagacaacagagagtgaagatttctgaaaaccctagctttgcaacaagccctagggaagaagacactgagatggataagaagatccgcagtcttgtgaatagcattttgaaaaatgcttctgtccctgatgctgataaagatgttccaacatcttccaccccaaatgctgaatggagaggaatcaacagaggaagaagatcaagccacagaagagaccctgcaccaagggcaccagaacctgctccaggtgacctcattgacctagaagaagtagaatctgatgaggaacccattgccaacaagttggcacctggcattgcagcaagattacaaggcagaaagggaaaagcccccattactaggtctggacgaatcaaaactatggcacagaagaagagcacaccaatcactcctaccacatccagatggagcaaagttgcaatcccttccaagaagaggaaagaaatttcctcatctgattctgattatgatgtcgaactagatgttcccgacatcaagcgggccaagaaatcagggaaaaaggtgcctgaaaatgtccctgatgcaccattggacaacatctcatttcactccattggcaatgttgaaaggtggaaatttgtatatcaacgaaggcttgctttagaaagagaactgggaagaaatgccttggattgcaaggagatcatggacctcatcaaggctgctggactactgaagacagtcaccaagttgggagactgctatgaaagcctagtcagggaattcattgtcaacattccctctgacataacaaacagaaaaagtgatgattatcagaaagtgttcgtcagaggaaa

SEQ ID NO: 27730 - DNA, 474 bp, Glycine max
  Peptide Sequence Number=SeqID_119415
atggattctgtaggaataagatcggctaacccttatttggcgactcctggagcaacggttcatggccattatggggaaatactttctgaaggagatatattagttacatttatctatgaaaaatcgagatcgggtgatataacacaaggtcttccaaaagtagaacaggtattagaagttcgttcgattgattcaatatcgatgaacctagaaaagagagttgatacttggaatgggcgtataacaaaaattcttggcattccttggggattcttgattggtgctgagctaacgatagcgcaaagtcgtatttctttgttttcaagaactgctagagttttatcaaaagccgctctccgggggcgcatagattggttgaaaggtctgaaagagaacgttgttttagggggaatgatacctgttggtaccgggattcaaaagaataatgaaccgttcaaagcaaaggcaatataa

SEQ ID NO: 27731 - DNA, 458 bp, Glycine max
  Peptide Sequence Number=SeqID_119416
atgtgtagatcctctgcaggtgaattggttccattggatttagaaattgaagccacctttagaagaaacaacgtagaaagaaaaagaaagcttttgcacgacagaataatagcaccaatcctggaagaggcttacttttctgagtcatcatcttctaattcacctacattcggggaatctcaaacagcagaatttgaatccgaagtcatggttgaagagcaacctcgacgagtgaacttggaagattactcaagaacttcgaaaccgcaatatttctcaagtgttgcgtggccagaggttcaggcacaaaacttaacttacccaccttcattgatacagctaatacaatgcaatttgtttcatggtttaccaaatgaagatccatactcacacttggcaacgtatattgaaatttgtaatactgtcaagcttgccagtgcacctgaagatgctattag

SEQ ID NO: 27732 - DNA, 516 bp, Glycine max
  Peptide Sequence Number=SeqID_119417
atggaggtgcgtgttatgctcaggaacggatttgagcccggaatgggtctaggcaaggactgcctcgggaatgccgacgtggtcgatatcaagggaaattcatacaagtatggattagggtatgagcccgagatgccggggaggaggaacgtgccgtcaagatttcaggcggatagggtatggcccggccgtattagccagtgtttcaccagcgctggaatggtgtccgaggaggaggtggccgcaatagaagaggagttccctcaagacccaccaagttttttgcaaccatgtcaccccgattcccaagtggggaactggcgcgtgataagccagtcagaagtctataccgctgattcaatatgtgagggtcgattctttgaggatcctaacaacgagtgtttgacaatcgatttcgatcgagatataagccaaatgataaacgaggaaagaggaagaggacgtccttgtcacctgagttggagaggttggtcgctcaggaagaacgtgaaatga

SEQ ID NO: 27733 - DNA, 324 bp, Glycine max
  Peptide Sequence Number=SeqID_119418
atgctatgtactcggcttccgtggttgagagagcaactctattttgaagtttatgtagaagcaaagcttcatgatgaatcaagattgattcaaatatgttttgatgataaccaaggtgatgacaaaaagctcaaaggtcaatcaaagaatgagttcaagatgttcaagataaaatcaagaaagaatgagttcaagatagaatcaagaacacttcaagattcaaggatcaagcttccaagaatcaagatcaagattcaagaatcaagagaagacttaatcaagataagtatgaaaaggttttttcaaaaactgagtagcacatga

SEQ ID NO: 27734 - DNA, 103 bp, Glycine max
  Peptide Sequence Number=SeqID_119419
ctcgcctgggcgagctgaggcagtcatgtcggcatctgaggcagactctacggaggatagtggcccgggggagatggcgatcagtggagactcttcatcatag

SEQ ID NO: 27735 - DNA, 714 bp, Glycine max
  Peptide Sequence Number=SeqID_119420
atggagagaagtatgatagatgctaccagtggtggagcccttggagacatgacccctgctgaagccagaaatttaattgagaagatggcttcaaactcccagcaatttagtgccataagtgatgctattgtcattagaggagtgcataaagtagccacgaattcatcttcatcagctgagattaagaagcttgaagactctggtttatgctcctctgccgactaccacatggacctttgcccttctgtgcaacaatttgaagcaattgaacagcctgaagcttatgctgcaaacatctacatcagacctcctcaacctcagcagcaaaatcagccacaacagaacaattatgacctctccagtaacagaccatacgttcctcaaccaatccaacagcaaacagttgaggctcctccgcaaccttcccttgacgagcttgtgaggcaaatgactatgcaaaacatgcagtttcaacaagagaccagagcctccattcagagcttaactaatcagataggacaattggctacacatttaaatcaacaacagtcccagaattctgacagattaccttctcaatctgtccaaaatcccaaaaatgtgagtaccattgcattgaggtcgggaaagcagtgccaaggacctcaaccagcaacatcatcctcatccgcaaatgaacctgcccaacttcactctactccaaaaaaaagatga

SEQ ID NO: 27736 - DNA, 345 bp, Glycine max
  Peptide Sequence Number=SeqID_119421
atggttacacaaaacaatgagagtgacaaatttttgctctgggaccgtgaatgtgctgaattgattggccaaatagctgatgatgtgaatagggtcaagattgaagatggtgatcttgatttgaatgcttcccctcaagcacttgacaaattgttgggtcatgtgcttgcttttaaggcatgttccaaaatagatccttccaatgttgattgcgatgatgctacgcatgctgaatgtcaatctctatctgtcacagcttaccatgatccggttgtggggttgcctttaacacccaaaaagcggatgtcatctgatgaagccgatgatgagttagggagctcttaa

SEQ ID NO: 27737 - DNA, 207 bp, Glycine max
  Peptide Sequence Number=SeqID_119422
atgactcttcatttagcacttgtaaagccagctgataaaatcatactagatcaaatgaacgggacgcgggcaacacgaaattcggagagaaaagacaaatcatgggatattccagaaaccggtgggatggcggaagaaaccaaaaagcaatccttttttaggagtgtgccctacattacatctgaatttgatgataataaagagtaa

SEQ ID NO: 27738 - DNA, 612 bp, Glycine max
  Peptide Sequence Number=SeqID_119423
atgcctgtcaagaagcgggcagcccaagggaaatgcaatcccgtgccaatggttgggtcgggacgggcggcgcggcaaaatatcgggtttcatgcgcggcgatatgtgccaaaacactgcgcgaaagacggattctggaaaggaacgacaatggctggccagaaaaaagtggacgcgccgcgcaataacgatgtggtgattgcgggcggcggctatgtcgggcttgtcacggcggttgcgatcaaatcggcggcgccgcacctcgtcctcaccgtgatcgacggcgcaccggctggtgcctggaagaacgacccgcgcgcttcctccatcgccgccgctgcctcacgcatgctggaccagctcggctgctggcaggaaatccttcccgaggcacagcccataacggaaatggtcatcaccgattcgcgcacttccgatcccgtgcgcccggtgttcctgacttttgaaggcgaagtcgagcccggcgaaccctttgcccatatggtggaaaaccgcgttctcaacaccgcccttcacaacaaggccgaaacgctcggcatcaccttcctcgaagccaccagcgtggatagtttcaatacgctcccggaagga

SEQ ID NO: 27739 - DNA, 108 bp, Glycine max
  Peptide Sequence Number=SeqID_119424
atgttgatgcacaatccgcccatttgggccctccagaagattcctccagaaggcggttgcttctggaggaagcaaccctgctcgcctgggcgagctgagctcgcctag

SEQ ID NO: 27740 - DNA, 294 bp, Glycine max
  Peptide Sequence Number=SeqID_119425
atggcggttcatggcggaaacttcgtcttctccgcgagaacttctcgctgcaggccgccgttcgtgacaggtgcgtcgttgccggagctcgtcaccgccgtttgtgccggtgtgtcgctgccggaggtcgtcgcagctgcgtgcgcgtgcggctgcgggtgtcgcggctcgttgcgcgtgtggggtgcgggagggacgcggctggtgcaggggaggctcgcggttgggttctctcttagatggaaggttgttctgaatcacagagctgtgctggagggtcttttagctgaatga

SEQ ID NO: 27741 - DNA, 237 bp, Glycine max
  Peptide Sequence Number=SeqID_119426
atggaacacatctccaaactcgaaaacggaggacatatgaatgacaacccaattcattcatggctccggaaaaagatgagaatggaggattgccttgagggtcatctcttaggcaatcatggaacacagctccaaactcgaaaagcaatcatggaacacagctctaaactcgaaagtggaggacacatgaacagccctaagacaataattcattcatgtggctccggaaaaggatga

SEQ ID NO: 27742 - DNA, 168 bp, Glycine max
  Peptide Sequence Number=SeqID_119427
atggacgaagatcaatggaggtatgactttgcgatgtcacaagaagttcatatggattatgattatgataatcaagaagaatgtggagtgaatgaaccacatgtcgattgttcaaatgcttttaatacatctcagggttgcgttgtaggtattcgctactcgagatga

SEQ ID NO: 27743 - DNA, 603 bp, Glycine max
  Peptide Sequence Number=SeqID_119428
atggttatgaagcacacgaggggaaaccctaacatccccaccaccactcgttctcgctcccccaaaagcagaatggggaaggatcatggtgactggaatgggttttccgtccaaagaggatacagaaggaagaggactcactatcaaaagccccatggcgagtcttctatgaggaggagccgtcgattagatgacctctcagtctaccaggggttgctgaatcgaacctctagagttgctaccgcccatacctatggtggagtcagagatgaaagacattatggaaatgagtgtaccttgagagcgaggaagacaatcacaagagaaagggaaatcacagataccgctaggaggcttgacaagcttcacaaatctgcaactctcgcacctgtcgaggttaccaccctcaacattggacaacacttgtccaagctttgggggcttgagaaactcgtgaccctcttacttgtcaaggctactgcccttgacaccagacaatctccctcgacgccagacaatctctttcactcacaagctggctcaaagcttggggggcttatgtactgtccaggatccacaaaatggatgtggcaactaacatag

SEQ ID NO: 27744 - DNA, 589 bp, Glycine max
  Peptide Sequence Number=SeqID_119429
gactacacgtcctcgccttgataggactacacgtcctcaccatcagagggctgcacgccctcacctccagaggactacatgtcctcgccttgagagggctgcacgccctcaccttgggactacacgtcctcaccaccagagggctgcacgccctcacctccagaggactacatgtcctcgccttgagagggctacacgccctcaccttgggtactagttaccctcactgttcagaggactacatgtcctcgccttcaaagggctacacgtcctcagccttcgagagggctacacgccctcaccttaagggtctagtcacccttcaccttgagggactacacgcctcgccttcagaggactacacaggactacacgtcctcgccttgagaggactacacgtcctcaccatcagagggctgcacgcccttacctccagaggactacatgtcctcgccttgagagggctacacgccctcaccttgggtactagttaccctcaccgtcagaggactacacgtcctcgccttgagaggactacacgtcctcaccaccagagggctgcacggccctcacctccagaggactataa

SEQ ID NO: 27745 - DNA, 150 bp, Glycine max
  Peptide Sequence Number=SeqID_119430
atggaggacacattaacagccctaagcaataacattcatgtggctccgaaaaggggggtgagaatggaggattgccttgagggtcctcacttaggcaatcatgaaacccagctccaaactcgaaagtggaggacacatgaacagccctaa

SEQ ID NO: 27746 - DNA, 248 bp, Glycine max
  Peptide Sequence Number=SeqID_119431
acacttgttagcactgccacacctcttgggcttgaggttattccccaagtaaaggagttgttggatgagggggttcccacagaccccaagagaataaaggtcattcctgagtggcccactccaccaacaccactcattgagttggtgagaaaccatgttccttcatgggaagatgcccaggaaatgggtgttgagggaaggagcccagagtatgaagaacctcggattgaggtcaaatcctttccaag

SEQ ID NO: 27747 - DNA, 50 bp, Glycine max
  Peptide Sequence Number=SeqID_119432
atggggatgaaagtcgttactgagacaacggatcgacaaaagaaagaccg

SEQ ID NO: 27748 - DNA, 486 bp, Glycine max
  Peptide Sequence Number=SeqID_119433
atgatcttaatcattgttatcaaaagaaaaggacacgctttacggcgcccttaccgaactcgtgctagagctagagtaatgggtgaagcagaggaggtgcaagagaagatgaaggccgacatggaggccatgaaagagaaaatggccacaatgatagaggccatgatgagcgtgaagaagataatggaagccaatgcggttgcaattgccgctaccagcgttgttgctaaggtgaacctgatgtccctatccggcatcaaccaaatgaatcatccaacctcagatatggtaggcaaagatttgggaagtacgggcagcccccataatgtacaaattcaaaacgagcacgccttcccgccatatggcttgcctctcaactatacgccacccaaagtggcgtacactcccaataagaatgtcaataactccactcctatacccattgagagccaacaaccccaaactgatcatgcacatgtctcttaa

SEQ ID NO: 27749 - DNA, 510 bp, Glycine max
  Peptide Sequence Number=SeqID_119434
atggccaagtttgatccagacatagtcctcgaattttatgccaatgcttgtcctacggaggaaggcgtgcgagatatgaggtcttgggtaaggggtcagtggatcccgtttgatgcagatgctatcgaccagctcctgggatatcctttagtgctggaggagggtcaggagtgcgagtatggccagaggaggaaccggagacgggtgcggatcatgcgcaccaacatgaccaccctgactcagatctggatgactttgctgctcagcaacatccagcccagcgaccataattctgacctccccctgccgaagtgtcagctggtgtacgccatcctgacacggatgagcattcacgtggctcagctaatcgctgatgccatctatatatttgaaggtatggcgcctaccaggcaccctctggacccggataagtccaacagggccctgggattttccgccttgatcacaggactctgccagtcgttcggagtccctgtcgcacctagcaag

SEQ ID NO: 27750 - DNA, 306 bp, Glycine max
  Peptide Sequence Number=SeqID_119435
atgaaagaaagcctcaagaggctaacattaaactcccatacttccatgggaaggacaatccaagatgaggctgctacttcaccttcctctagtgaaagtgaagaagcaaaaagggaagaatctagtgaagaaatctacccccaagaagaaggaaaacctttaatggttaaggaggagtgtaaggagacacttgttagcattgccacaccttttgggcttgagtttattcctcaagtaaaggagttgttggatgagggtttggttcgcaagagctttaaatccttgtgctttgtggtgcccaaatag

SEQ ID NO: 27751 - DNA, 810 bp, Glycine max
  Peptide Sequence Number=SeqID_119436
atggagagatctcgcagcccaagtcgtaccgcccatgacggaaagggagatgatcacaattgtggctacatgccaactaactttgcggacctcgtcttcgccggagaaaggattgaatccgggctacgaaaaggcaagttcgaatatgctgccaatatggcccccaacaacaacagaagagccccagcaatgggcgcgaggaaaaaggaaggagacgcccacgcggtcaccaccgccccaacatggatgaaagcaccccaaaatatccaaagctcataccagcccaatcccccaaattttttaatccgagccgggaattccctcccgactcaagtaaaaggaccacccgcagcagaaagagcgccggcccaacgcacagctccagccgcaccccggccagttaataatacagcccccggcgcgacctataaatatgcacagcacccgaaagacaacttccctcctattcccatggcatattccgagttatggccttcattattggagaatcacttggtggtggccatacccgggaaggttctccagccaccctaccccagtggtatgatccggtgccaagaaggcccttatgttaaaaccaacccgctatctagtcatggaggggctagcgtgaacgtcatccaaaatgacgggccatcacggacaataaggttaggagatgtggctacttctagacgcttcatttatcaatcactgcgagcggcggggatggtctcccgaggtggaggcgaagaggacgaatgtttatttctcctcgaggagtcgcacgacatggaaacctgtcccacg

SEQ ID NO: 27752 - DNA, 315 bp, Glycine max
  Peptide Sequence Number=SeqID_119437
atgaccagaacacgaggtttaggtcgtgtcatagatagagttgtaggcagagatagagctactgacgaggatgctgacgatgttcccgagaggcgtaggcctactgcctcagcccgtaggctacgcgttcatcagatgactacggagggacgtgatatggctgaggacgtcgctgacatgactgatgatgtccctgagcagcctacggaggcacttgagatgcgtgcggacgcacagggtgctgatagtggtgaggggtcagatggtgatgatgttgcagagggatcgaattcctgcagcccgggggatccacta

SEQ ID NO: 27753 - DNA, 201 bp, Glycine max
  Peptide Sequence Number=SeqID_119438
atgtgctgcaaggcgattaagttgggtagacgccagggttttcccagtcacgacgttgtaaaacgacggccagtgaattgtaatacgactcactatagggcgaataggagctccaccgcggtggcggccgctctagaactagtggatcccccgggctgcaggaattcgattcgaaggtggaggatacatgaacagcgctag

SEQ ID NO: 27754 - DNA, 459 bp, Glycine max
  Peptide Sequence Number=SeqID_119439
atgactacacgtcctcgccttcagagggctacacgtcctcgccttcagagggctgcacatcctccccttcagagggctacacgtcattgccttcagagggttgcatgccctcgccttcaaagggctacacacctttgccttcagaggactacacgtcctcaccttcagaggagtacacgtcctccccttcagagggctacaggtcctcgccttcaaaggactacaggtcccttgcctttagaggactacatgtcctcaccttcagaggactacacgtcctcacctttagaggactacatgtcctcgccttcagaggactacacatcctcaccttcagaggactacacgtcctccccttcagagggctacatgccctcaccttcagaggactacaacttttcgccttcaaagggctataggtcctcgccttcagaggactacacgtcctcgccttcatag

SEQ ID NO: 27755 - DNA, 420 bp, Glycine max
  Peptide Sequence Number=SeqID_119440
gatgtgcggaaaaaggcacaggccatccagaagcaaaacaccgccccccacgtgttgtctcatgggggttatgactatttagaacagaagctcatggctgagaagacaaagaaaagactggaggaagctgctcagtctggaagcactgaaggcgtcattgaccctctatctcccatcagacgacacgtgaagtggaagatggcccgcaccgagaaaactgggcagatgacgtctgagatagtaaaggaaatcgctaagaagattgattctttggaggagcaggcgtcacagggtttgtttgtcccccatggacgtccggatctcctgactgctgccattgggcgaccagaacaccctggtcgtgtgtgtgctgctggatctgatgtcaccatcaagcaatacttcggatccgctccatga

SEQ ID NO: 27756 - DNA, 519 bp, Glycine max
  Peptide Sequence Number=SeqID_119441
atgcaaaaagtttatacggataaccactcgggtatttccggccgtcagcgtgaagcaaaagtcagtatgacagatcttgtgagcgtggaagataacctaaatctccacgtgtcaacaagggcttgtcggccgcgattgacgaaggcgcagaagacgacggtagtctctgcgtgctatcatggcttttcgtcttacagacagcaaaaagtttatacggataaccactcgggtatttccggccgtcagcgtgactcaaaagtcagtatgacagatcttgtgagcgcggaagataacgtaaatctccacgtgtcaacgggcttgtcggccgcgattgacgaagggcgcagaagacgacacagcaaaacgtttatacggataaccactcgggtatttccggctcgtcagcgtgactcaaaagtcagtatgacagatcttgtgagcgcggaagatgacgtaaatctccgcgtgccaacgggcttgtcgatcgcgattgacgaagggcgcagaacacgacgttag

SEQ ID NO: 27757 - DNA, 300 bp, Glycine max
  Peptide Sequence Number=SeqID_119442
atggccgaccagcaggcgaccaagtccaaagccaaatacaggctaaaggcccaagtggagaagaacgaaggcccaagtggagaaggacaaagcccccgaatttaccaaggtaatccttgtggcgtctaccgtgacttatcttccttcactggaagtggcgtctacccggacttatcttccttcaccggaagtggcgtctaccctgacttatcttccttcactggaagtggcatcatccaaaacctccgtagcctgtatcaaacgatccgctcctactcaggttcacatcaatgcgcctga

SEQ ID NO: 27758 - DNA, 1011 bp, Glycine max
  Peptide Sequence Number=SeqID_119443
atgtctggaagaggacacattacttctcaatgccccaccaagaaaaccatgattatgaggggccaagacatttatagtagcctagatgaggctactacttcaccttcctctagtaaaagtgaagaagcaaaaggggaagaatctagtgaagagatctacccccaagaagaaggacaacctttaatggttaaggaggagtgtaaggaggtaagtgtctcctccaagaggttagctaagaaggaaagacattttgaaataaagacaaatattaaagaaatttcccttcttagacaacctccacattttctcctttgtaaaaagacacttgttagcattgccacatctcttaggcttgagtttattcctcaagtaaaggagttgttggatgagggtttgcttcgcaagagattaaatccttgtgctttgttggtgcccaaaatagggttccctactcctaaggaccccttgtataagatattagatgagttgagatcccttaagttgtggaaagaaaaacaagagagaaaagaaaaaggaaaaaaaagagtggaagaaataagtcaagatgaaaaagagaaaataaaggaagatgaaagaaggaaaatactaaaagagttaagaaaagaaaaacatgcctcctatagtagtcataactcttacaagagcctaagtgatgaacttcgtgactattatgaaggaaggcatagggcacatcttagacctcactcccataggagagaaaaggaaagaaagcctcaagaggctaacattaacctcccatgcttccatgggaaggacaatgtagtggctaacttagattgggaaataagggtagagcaacaacttaaaaagaagtctacttcaaaatcttatggctctcactcttatccaaagaaagaccgaggccaaggcatcctaggggtgacaccttctaagaccaaagatgataaggggaagacaatagaaaagcaaccccttaaggctagtatgcaagagagactagctccatga

SEQ ID NO: 27759 - DNA, 123 bp, Glycine max
  Peptide Sequence Number=SeqID_119444
atggagagttggcgaacagcgctacgcaataacttcgcggggctctcgcggggctccagactcgaaggtggaggatgcatgaacagcgctaggcaagtgttttatcctattccaaaaccataa

SEQ ID NO: 27760 - DNA, 702 bp, Glycine max
  Peptide Sequence Number=SeqID_119445
ggaagttcagtaaagcaacaggaagaattgctcagattcctgacgtggccaacgaggaattaattattggagacagacaaacgggtaaaacagcagtagccacagatactattctcaatcaacagggacaaaatgtaatatgtgtttatgtagctattggtcaaaaagcatcttctgtggctcaagtggtgaataccttacaagaaagaggagcaatggaatacactattgtagtagctgaaacagcggattctccagctacattacaatacctcgccccttatacaggagcagctctggctgaatattttatgtaccgtgaacgtcacactttaatcatttatgacgatctctccaaacaagcacaggcttatcgccaaatgtctcttctattacgaagaccacctggtcgcgaagcttatccaggggatgttttttatttacattcacgtcttttggaaagagccgctaaattaagttctcagttaggcgaaggaagtatgactgctttaccaatagttgaaactcaatcgggagatgtttcagcttatattcctactaatgtaatttccattacagatggccaaatattcttatctgccgatctattcaatgctggaatcagacccgctattaatgtaggtatttccgtttccagagttggatcggcggctcaaattaaagccatgaaacaagtagctg

SEQ ID NO: 27761 - DNA, 345 bp, Glycine max
  Peptide Sequence Number=SeqID_119446
atggatgggattctcatttctagtgtggcggtgttgtccttgctgaggtgttggtggctgattcacgattcactcgaccggatatgggttttcacccaacaaactcaattcgtgcctagcgatgcggatgaggcgcactcgatgtttccattggcctgcatgcctttggtattgtggggtgtggttcgtttagtggtgtcaagtcttgcgaacgtgagggtgctgacgattggttcctgtgttgcctacctaccaaacggtattcgtgtggctagtcagacccattccatccaggcctctttgttggggacgctggaggatttcaaagtcccacacgtgaaccac

SEQ ID NO: 27762 - DNA, 240 bp, Glycine max
  Peptide Sequence Number=SeqID_119447
atgaatgaagcacaacggttaccttctcgagagctctctcttgtggagatacgaactaaatgcataggtggtctagcgatcctgttgtctccggtatacaactggggaactcctactactaataataagaaggggagcagcacacttgcatcagtctatatggatggcaccactagcttacgactcaacaaccagctcttcttacttcgtgctcggaacaaagaaacgggtctatggtag

SEQ ID NO: 27763 - DNA, 366 bp, Glycine max
  Peptide Sequence Number=SeqID_119448
atggaactccaacgtcttaatcaaaatgaagaaatcaacaaaaagaaaagaagtatagcacttaaagcctcttcatcaatgaaaaaagaaaatgaagaagaagaattagaacataaagaagacttctcactctttgtgaagaagtttcaaaaacttgtcaagaaaagaagaattgagaagcgtcagaacttcaacaatggaagaagatctcaagaagactctcaaattcctagatgttacaaatgcaaccaacttggaacatcaaagaaaattgtccttcaaatgaggaatggcctgagaaaagtgataagaaaaggtatgaagaaagaaggaccaagaaggcctacattgcatgggatgacatga

SEQ ID NO: 27764 - DNA, 388 bp, Glycine max
  Peptide Sequence Number=SeqID_119449
gaattcgatgaaggcgagactcgccaaggagaagttcaaatcagctgctacacacatccagaaagagtgtgccgagttacaagaggaaaacgcggccactgtaagagcccttgaacaagaaaccaaaagggcccgcaaggaggaatatggccgagagaaattccgaggagcattgtggggtagcaacaatgagctcaagctccgaagagaggagagagatcggtccaaaaggagtttggctcaacacttggaagccacggagcaaaacatgctagctatcatagggcaatacaaggaagaattaaaccagtccatggcccatgaacaaaagctagtggaggtttttgcacaaatgtatgccgaaaaagaagcaaggggggaggggtga

SEQ ID NO: 27765 - DNA, 85 bp, Glycine max
  Peptide Sequence Number=SeqID_119450
atggctgataaatgcattcttgatgagtggaagagagagagcttggaagaaccaaacaagaaactcttcatagcaatggctggag

SEQ ID NO: 27766 - DNA, 281 bp, Glycine max
  Peptide Sequence Number=SeqID_119451
atggcacatcccaggccgccaccggcagcgcatccacgcgctggcagtcgtgcgcaatacccagcggtaaaaagccatgctgctgccagtgctgtagggtgcgatcgtaaaaacccccgcccatgcctaagcgttgtccctgcgcgtcaaatgccaccagcggtcgcagcggggtttctggcgtgtaacgcaaaaaaagcaggtgaccgggcgcaaacgggtgcagcaccggcagaaagacctgcttcttttgctgccacagtttggcaatcagcggtcgg

SEQ ID NO: 27767 - DNA, 698 bp, Glycine max
  Peptide Sequence Number=SeqID_119452
atgtcggggcgcactctcggtgtcaacagccagcacccgagttttttcgcctcggcgtcgtcgcaggccgcccaagatcaggcatcagtgcacgtcgccacacacttgccgaacgccccgtcaccccgtgctccgcgcgcgcacgagccgacggggcacctctcgcgaccccgggaggcgactggtactgtgtgcctccacagtgtggggaaccggttactcgtgcgtttcccgcagcgctgcggcggcggttccacgagcctcgtgcccgcaggaccgtcggccgcctcggacccgtcgacccggccgcagcgcgccccgccgtggggcctctcggtccgcacccgccggacctcacccgttggaggagagaagttggagcaccgttcgaaccccgtcctcgacgccgattggcccgatccggatgtcctccgggtgggcgatgactactggatgatcgcctccagcttccaccgcgccccgggcctgcccgtgctgcgctcgcaggacctcgtgacctgggagcacgtgagcaatgcgctgcccgctctggtccccgaggagcactacgccctcccccggcgcggcagcggcgtgtgggccccgagcatccgcgagcacgccgggacgttccacatcgtctacccggatccggaccatcaagcttatcgataccgtcgacctcgagggggggcccg

SEQ ID NO: 27768 - DNA, 180 bp, Glycine max
  Peptide Sequence Number=SeqID_119453
atgatgcactccatgagaggttggatcaaatggagaatagagatcataatgaagaagaaaggaggagaagagggaatgatggtgttcctagacaaaactgaattgatgggaaagaatgatccagaggcctacttggagtgggagatgaaaatagagcatgttttctcatgcaacaactat

SEQ ID NO: 27769 - DNA, 258 bp, Glycine max
  Peptide Sequence Number=SeqID_119454
atgtgtgacacatatcctaccttgttcaataccgagctcaagaatcctaacagagcaaccagaggagttctagagagcacaagaaacgccaccattgctaacgaagaatgcttgagtgactatatcgagaaaatacactttcaacatcggttatttagaacattctacatcgattttaaaaccgatgttgaaagtgacgatgttgaatgtatgaatgttaacatcggttttggagaaccgatgttaacatacatatga

SEQ ID NO: 27770 - DNA, 207 bp, Glycine max
  Peptide Sequence Number=SeqID_119455
atgaagatgctcttgataccacatgatgtagctccatgtggagcttgtaggccttggatcttcttcatcaatggattcctttgcttcttgaaaatgaatggcagcggaatggagaaggaagagagagattatcggagatgccacttcaaggagaagatgagtcaagaagaagctcaccactataggaagccatggataagagcttga

SEQ ID NO: 27771 - DNA, 367 bp, Glycine max
  Peptide Sequence Number=SeqID_119456
atgttgctttgcaaatttgtgatgacgaagatgttgaaaccatgctcgaatgttttcaacaacaaaaatcaaatttcagttttggaattgtacatagaaaaggatgtggttggtggttctatgtttcattttgcaaattctcttacatcatgcagaaataatttatctaataatgaggcgcaaccgccaacaaatgtgagcaacttacatggtgatgaagatgatgatgatgatgatgattatcttgtgtctaactcatacgttgaagagtctttagacgaagatgatagtgttgacggtatatctgatactgacaatgaagtcactgacatgattcaaccagtaagaattgttcacccaacagaag

SEQ ID NO: 27772 - DNA, 331 bp, Glycine max
  Peptide Sequence Number=SeqID_119457
ctcactgccacctgtgagcctttcttcaagctgtggcataagaaccaatctgtccaatgggacgacgactgccaagtggcatttggccgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgagatctacgaactttttagtgaaaggttcgggagttgtatttatgcacggggaagggtgtttccctttgctcctacgtattcctcaatttgggatgagaaaatcagacctacgtag

SEQ ID NO: 27773 - DNA, 743 bp, Glycine max
  Peptide Sequence Number=SeqID_119458
atgggcatggatctcgactggtcgattccctatctggatacgatccagcgcggcagcgagcaattctccgcagtgacggggtatcagtcacgcgaaatgggccgcgcggatagcgctggcaacgtcgtagccactgtccaggcagtccttgcggagcctcagctgttcctgatgctgggcgcgcgggcggaagcggggcgtctgttttcggatgatgacgcgcgacccggagccgaaccggttgcgctggtcagcgcggcgttgtggaaatccgagttcggtggcaaccctgctaccctcaaccagaaactgtggctgggtggtattggctaccgcatcgtaggggtgctgccgccctcgttctcattcccgcagcgtgacgtccgcatctggttgccgctgggcttcaccgaggaacagaccgccatgtccaacgcggggtccttcggaaaccttgcggcgatggcccgactgacccgtacgaccgactcgaacgcagcccgcaccggaatcaaggcactggtgggcgcgcagccgacgctggcagcgatcagcgagcagatcggcttgaagatcggcgtagagcctctgcgcagcatctggctggaagatcgcagcacgacattgatttcaatgatgggcgcaggattgctggtgttcgccgtcacgcttgccaatgtctacaacctatcgaattcctgcagcccgggggatccactagttctagagcggccgccaccgcg

SEQ ID NO: 27774 - DNA, 1182 bp, Glycine max
  Peptide Sequence Number=SeqID_119459
atgggcatagatgcagcagtgttaatgtgtctaagagatattaggcataataaatttgaagactccttaattggaacagtcgaaaccagcctaggacaaggtctagtatattttaattgttatccaaataaaacagtgagtctgatggacagaaacattctcgactctatgttcttaaacatccactttcatgaccttgacatgaaagaaggatcaatcccagcggctttgatctataggatccaatataaggtcatgaacacttgtgcctctagagtcctgttgcaaccacaaaagggagaaacaaccttatttattacagatatgacaaaagccaacgtctctttaaaaagaataataaaatgggatgaagtaactctccccgaaaaatgggtcatggagaaggccacaccgtctgatccccgacccgctccaattattgaagatattaaacaggataactccggaaaggtagaaataaccttcaataggagaaattccttctcatcaaggatagaagcctctaggtctgaatatgagttagccagaaggtctttttcgttccctactgtaaacctccaaggactagataccacttcaagcataccaagtacgacctacaaccaagatcaggaggacgaccaaaagtcgatccaatccccaacatactcttctatggaccttatgatattatctgacaactttagcattgataaggaaacccttaggaaagatttttattctccggagaatgaaccccaaaggagatggtttttccaacattacaagggtacaaacagaaaacaaatccaagacaagttctacgaatttgtcgaaagagtcaaaattaatgtccttttctttgattggtttcatgcttatgccatcagaaagaatatagattacccttggaaacaagacatcataggtgatccaacaacaaatgtcataacaaattggcaagtgaaggatggtgagttaatccaatcggaattacctcccgcaacacaatatcaactaccaaacatcaaagacagtaacaataaacctgtcatggcaattccattcaagacaaaagatgtcaatgaggaagtaacctctagagacattaagagcctaatggaacaggcaaattataccaacaaatacttacaagctataggagaaaccataaaaactaag

SEQ ID NO: 27775 - DNA, 297 bp, Glycine max
  Peptide Sequence Number=SeqID_119460
atgaaggccgacatggaggccatgaaagagcaaatggccacaatgatggtggcaatgatgagcatgaagaagataatggaagccaatgcggttgcagttgctgctaccagcgttgttgctaaggtgaacccaacgcccccatttggcctcaaccaaatgaatcatccaacctcagatatggtaggcaaagatttgggaggtacgggcgaccctcatttagtgcgaaaaacaaccatgccttcccaccatatggcttgcctcccaactatacaccacccaatgtggcatacactccca

SEQ ID NO: 27776 - DNA, 411 bp, Glycine max
  Peptide Sequence Number=SeqID_119461
atgactgagagggagatgatcacaattatggtagatacgttgcctacgttctactatgagaagctgataggatacatgccagctaactttgtagacctcgtcttcgccggagaaagaatcaaaagagccccagtagtgggcacacagaaaaaagaaggagatacccacgcggtcaccactgccccaacatggatgaaagcgccccaaaatgcccaaaagtcataccagcacaaccccccgaacttttcgatccgagtcgggagttccctcccaactcaagtggaaggacctcccgcaatagaaaaaacgcctgcccaacacacagctccagccacaccccggccagccaataatacaactcctggcgcgagctataataatgcgtggcgctccccccccccccccggatag

SEQ ID NO: 27777 - DNA, 390 bp, Glycine max
  Peptide Sequence Number=SeqID_119462
atgacccaaagagctggtagcccgcggagacaccttttgccatttagacacagtcgtgtccgatggcacgcagagataaattatggtcattctgcacccttatgtcatctagaggcggcgggcccgatgacatgcggagacaaattatggtcattccgcacaccttttgccattcagacacagtcatgtccgatggcacgcagagacaaattatggtcattctgcacccttttgtcatccagaggcggcgggaccgatgacatgcggagacaaattatggtcattccgcacaccttttgccattcagacacagtcgtgtccgatggcacacagagacaaattatggtcattctgcacccttttgtcatccagaggcggcgggcccgatga

SEQ ID NO: 27778 - DNA, 494 bp, Glycine max
  Peptide Sequence Number=SeqID_119463
gtagaaacgaatgggccccgttcatagacgttctcgcactgttgatctttggaggagtcctcttttcgaatgtggatgggttggtggacctggcagcgattgacgcttttctcgcctatcataaccacaaggaaagcccggttgtcgctatgctagccgacctatatgacacgttcgaccggggatgtgaaaagagcagcgcaagaattgtttgttgtgcactggctctctatgtgttgttagtttcacacctttttctccaagaaggtaggcccgtctatccgctacaaggtcaccgctcgtgcgtcgaaaaaggaaaggcgaattgggaccaactcttggctagcatggagggacgtctgttaattggttccctcgctagaaggaaggaagaatcaggattgtatcttcatgcgaaggatgtccaaatgttccctggatgggaacatggggttgtattaattatgttagtgcttagctctactgagctttaa

SEQ ID NO: 27779 - DNA, 195 bp, Glycine max
  Peptide Sequence Number=SeqID_119464
atggggcatgccacattgcccccattctcttgctattcatgcctaaacatgtgcccaccaagtgctcggtatagggacaacatccatcgtttcaggagcactgagcaccagcaacgtttcgagaccatcaaaggatggtcgttccacaaagaaagacgcgtccagctcagggacaatgagtacacagatttttag

SEQ ID NO: 27780 - DNA, 437 bp, Glycine max
  Peptide Sequence Number=SeqID_119465
gcagtcgtcccttgtggtgggcgtgtggggtgctaataccttccccatgtgtaaacaatgtagaagaaaagcttcatgatgaatcaagattgattcaaagatgttttgatgataacaaagatgatgacaaaggtgatgacaaaaagctcaaaggtcaatcaaagaatgagttcaagatgttcaagatagaatcaagaacacttcaagattcaagaggaaagttgaattcaagaatcaagaatcaagattcaaggatcaagcttccaagaatcaagatcaagattcaagaatcaagagaagacttaatcaagataagtatgaaaaagtttttttttcaaaaactgagtagcacatggatttttctcaaaacatgtttaccaaagagtttttactctctggtaatcgattaccagattgttgtaatcgattaccagtag

SEQ ID NO: 27781 - DNA, 198 bp, Glycine max
  Peptide Sequence Number=SeqID_119466
atgacattaggtgctgaattcaatgtggaaagcttaacatgtagagattggaacacatcatcgaaagcatcccaaaaggtatgtgttcagttctgtgcaagaaagaaaaggactacctatataagcatgaagtttagccgcttcaagaagctgggacttggctttgatatgcttatgaaggatagggacacaggctag

SEQ ID NO: 27782 - DNA, 222 bp, Glycine max
  Peptide Sequence Number=SeqID_119467
atggcacgcagcgtgtccgcttcgtgcccctattcaagggagctaaaaaggcttttagtgataatccccaaggtggtcatatctctcttgatggtctctagagtccccagtgagtcgccaactgttgcaacctacccttcggcgggagggcgacgcgtgactcgcgagatgcgtgttcccacgaaagcaatacgcgcggagtcgccaccaacgtttatttga

SEQ ID NO: 27783 - DNA, 390 bp, Glycine max
  Peptide Sequence Number=SeqID_119468
atggtgaaaagttggaacctcttacgtgccgatcaacgtctcattttcgccaaaagttggcccagggcttcccggtatcaacagggacaccaggatttatttattctgcgaagtgatccttccgtcacagcaccgccggacatcagcgctggcaagtgtagcggtcccgctgcgcgtaacccacccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 27784 - DNA, 351 bp, Glycine max
  Peptide Sequence Number=SeqID_119469
atgggatcaagtcaaatgccttcacttaaaaggaggttctatcaagtcaaggtcaagagcctagggaccactagtctaaaggagttagggcagttaatgggtcagctccagcggcaagcttttcgcaaagcttacggtaaaatttgggacttagccatggaagaagtctccacagaggccagtgcctcccttgcccagtattatgatcagccgttgaggtgcttcacctttggggacttccagctatcacctatggtagaagaatttgaagagatcctaggatgccccctagagggaaggaaaccatacctcttctcagggttctatccctttcctcttctcaggaattag

SEQ ID NO: 27785 - DNA, 540 bp, Glycine max
  Peptide Sequence Number=SeqID_119470
gccaagacatcagggaaaaaggtgcctggaaatgtccctgatgcaccattggacaacatctcattccactccattggcaatgtcgaaagagaactgggaagagatgtcttggattgcaaggagatcatggacctcatcaaggctgctggactgctgaaaactgtcaccaagttgggagattgctatgaaagtctagtcagggaattcattgtcaaccttccctctgacataacaaacagaaagagtgatgagtatcaaaaagtgtttgtcagaggaaaatgtgttagattctcccctgctgtaatcaacaaatacctggacaggccaacagatggagtggtggatattgctgtctctgagcatcaaattgcccaggaaatcactgcccaacaagtccagcattggccaaagaaagggaagctttctgcagggaagctaagtgtgaagtatgtgtcataccctaatttcgtccggggacctttgcttgatgacatgccaccattctttggtccttgtgaggtgcttggcacccatcattag

SEQ ID NO: 27786 - DNA, 459 bp, Glycine max
  Peptide Sequence Number=SeqID_119471
aggactacacgtcctcaccttgagaggactacacgtcctcaccatcagagggctgcacgccctcacctctcagaggactacatgtcctcgcccagagggctgcacgccctcacctctcagaggactactgtcctcgctagacttctcgagaggactacatgtcctcgctgtcctcaccatcagagggctgcacgccctcaccatcagaggactacacgtcctcgccttgagagggctacacgccctcatcttgggactacacgtcctcaccatcagagggctgcacgccctcacctccagaggactacatgtcctcgccttgagagggctacacgccctcaccttgggactacacgtcctcgccatcagagggttgcacgccctcaccttcagaggactacacgtcctcgccttgagagggctacacgccctcaccttgggtactagttaccctcacca

SEQ ID NO: 27787 - DNA, 411 bp, Glycine max
  Peptide Sequence Number=SeqID_119472
atggcatctagaaagagaaagagcattggtacaaggcctacatctcagtatgacacaaggagattctcttcattagatgtttggaccagatatactgataatgttctgggaagaaacattttacctatgaggaaagtagagctatatcacactgagctagatgactttaaggctgagctggagaggcgtcatttggtgaaaattgatgctaatagtctcaacacattcctggagacacctgtggtattagctgagggagagactctacccgcctactccaaatactgcaggttgcctacagacttcagagagatagaggctgccttatgcatacctgaccgagggttcattttgaactctgagggccaacctggaaagattctcaggaaggatctaactacactagctcag

SEQ ID NO: 27788 - DNA, 231 bp, Glycine max
  Peptide Sequence Number=SeqID_119473
catcagcccctactatcgagctttcatcaagaagtactgcgtctccaggcaagcgcagagcaaaacaccacagcagcctggggatgccgacagcgggcaacagacgcaccgccatcacctctaaagttcacctctggtcatccacaaaaaggtttgagtattgcctacaccacatggccggccaacaggcgaccaagtccaaagccaaaggacgcacctagttgctcatga

SEQ ID NO: 27789 - DNA, 219 bp, Glycine max
  Peptide Sequence Number=SeqID_119474
atggtgaaagttgggacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 27790 - DNA, 420 bp, Glycine max
  Peptide Sequence Number=SeqID_119475
atggtctcgcatgaccgccacctgatcggcctggtctgcgatacctattggcgcgtggctgatggcgtggtcgagccgttcgacggcgatctggatgcctacgccgcgtggctgcgtacccgcccgcaggcacagggcaccaaggcccgcatggagcaggtggaagagccggtggtggtcaagaccgcgccggtggcgcaggtagtgcagaaaaagccggtgaacccgcacaagctggccgccgccgaggccaaggtagccgagctggagggcgcgctggccgagctcgcccgccagctggccgatccggccaactacgccgatgcgacccgcatggccgtgcttggccgcgatcgggaaaccgccgccgcgcagctggaaaaggctgaagcggcgtggatggagctgctggagtcctga

SEQ ID NO: 27791 - DNA, 75 bp, Glycine max
  Peptide Sequence Number=SeqID_119476
atgggagaagagaacaaggggatggacgttggaggagaagacgatataaaccatgttattgggtcgtgggcctaa

SEQ ID NO: 27792 - DNA, 1689 bp, Glycine max
  Peptide Sequence Number=SeqID_119477
atgcgctggcattccgatgcggcgctgatcaacggcgtgatcgatgccggcggcagcggccggatcataggcacgctggatttctaccgtaaatccagcagggagagcgcgcccatgtataaaaagctgaacagcagcgccccccgcgagagcatcgtgggctcacacgggcagaagaactccacgcaacgcgattcaatcagcctggcgcacgtattcacgccaggaaacaacaccctgatagacacgatggaaagcaaggtcttctatcagcgcacgcgcgttggcgacgacacggtgtcagcgcaggatatcgtcacttcatccaggtggaggtcgaccggcatggagacggagaaccccttggagaatgtttcgaccttctccgacatgaacaccaagacttatggcctgcaaagcgaaatcaccaaggactatggcgcccaggccttgaattacggcgtgaatttctcgataacggatttttcccggccgtttgaacaagtcggcgcggaccatcccaccttgcagccacagggcaacaacagaacctatgacacgaatgtgtggctgagcgacaccatcaccatcggcgcgctttcggtaatgccgggcctgaaatactcgtggcacaaaatcaacccgcagggctttgaggcgccctccgacgacaaggcgctgggcgcattgacgctggcggaaatcaacgagatacatggcaagacgtttacggacgggaagctattgccttcgttgaccgtcatgtatgcgtccaagcaggggttcaatacctacctgcaatacaaacgcggagtctcctaccccaccagcagccagatagcgggaatctggctgcaccccaggatcgggcgcgcctcgcccgccatggtgggcaattccgacctcaagtccgaaaccagcaaccagtttgaattaggggtggttggcaaggcagcccgtggccttacagtgcgcggcaatgtcttctacaacagctacgacaatttcatctataaccggaaatacgccttgagggactaccagacaggcgcgccgaaaccgggcgtgcaaagcctgctggccaggcttccggcctcgatctccagcctcaccatcgcggagaaccgcgacaaggcatacatctatggcgccgaggtcgtcacccggatcgattatggcgcgctgttcggcgccgcccacggattgagcagcacttttgccgtgggatacaaccagggcaaatcgaaatcatcgtattcgggtgatggctgggtggagctggacagcgtgttgcctgtcaaggccattgcatcactggcgtgggatgacccccagaaccgctatggcgcgagccttaccgccaccttcatcaagggcaagcaagccgtcgatcctgtccgccagaatttcccgaacaatggcagcctctcattcgaagaatattccggaaagtacgaaaagaactacctgcgcgtccccggatacagcattttcgatctgacggcctactacaacgtgaagaagcacctgacagtggcgatgggagtctacaacctcaccaaccgcagatactgggaatacgccagcaatagaaaaatgacgacgacctcggagcaggatctgcgtgatatcgccctgggcgccgcgcccggcaggacctaccagctaagcgtcaccgcgatgttctga

SEQ ID NO: 27793 - DNA, 369 bp, Glycine max
  Peptide Sequence Number=SeqID_119478
atggattgggaccagctcttggccgggataggaggtagaacaatcagttggttcccccgatggaaggaaggaaaagaaggagtccttttctcatgtggaaggtacccaaacattccgctgataggaacgaggggttgtattaattacaatcccacgctcgctataagacaactagggtaccccatgaggggagcaccgacggaagaaagcatgtctcctttccttgtgagggatctcggcgcacaaaaccaagactatacaaagatcctaaggcagaaaccccgagtcgaagaagtccaagctctcaaaagcgagttaggaaaggcaaaactcgccaaggagaagttcaaattggctgctaccacttga

SEQ ID NO: 27794 - DNA, 468 bp, Glycine max
  Peptide Sequence Number=SeqID_119479
atgaaaagagaaaaacatgcctcctatagtagtcataactcttgcaaaagcctaagtgaagaactttgtgactattatgaaggaaggcataggtcacatcttagacctcactcccatagaagagaaaaggaaagaaagcctcaagaggctaacattaaactctcatacttccatgggaaggacaatgtagaggctaacttagattgggaaataagggtagagcaacaacttaaaaagaagtctacttcaaaatcttatggctctcactcttatccaaagaaagacaaaggtcaaggaatcttaggacacattacttctcaatgccccaccaccaaaaccatgattatgaggggccaagacatttatagtagccaagatgaggctactacttcaccttcctctagtgaaagtgaaaaagcaaaaggggaagaatctagtgaagaaatctacccccaagaagaaggataa

SEQ ID NO: 27795 - DNA, 109 bp, Glycine max
  Peptide Sequence Number=SeqID_119480
atggcggaaatagcggttataaatcacaagaaacgtaaaaatagcccgcgtattgtccagtcaaacgagctgactgaggcggcatacagtctctcccgggatcaaaaac

SEQ ID NO: 27796 - DNA, 582 bp, Glycine max
  Peptide Sequence Number=SeqID_119481
atgtcgatctccccctacggaagtatccgttggtttgtgtcgttccgacataggggtcgtgcccacaagatacccagtggacccgaaggagcccaacagggctctggggtttccagctctggttacaggcctctatcagtcctacagggtgcccgttccccccagcaagggatcgtgcccacaagacacccagtggactcggaggagcccaacagggccctagggtttccagctctggttacgggcctctctgtcagtcctacaaggtgcccattccccccagcaaggtcacgccatcatgacgtaggggtagcgcccacaagacacccaatggacccggaggagcccaacagggccctggggtctccagctcgggttacgggcctctgtcagtcctacagggcgcccatccccccagcaagttcatgccatcgtgacataggtaaggatcatgcccgcaagccacccagtggacccgaagaagtccaacagggtcttggagttgccagctctgattacgggcctctgtcagttctacggagtgcctgtcgcccccatcaaggtcatcaggccccctactaa

SEQ ID NO: 27797 - DNA, 261 bp, Glycine max
  Peptide Sequence Number=SeqID_119482
atgactaccctgactcagacatggatgatgttgctgcttagcaacatcctacccagcgatcataattctgacctccccctgccgaagtgtcagctggtgtatgccattctgacacggatgagcgttcatgtggctcagttgatcgctgatgccatttatctatttgcaggtatgccgcctaccaggcaccatctggacccggataagtccaacagggccctgggatttccagctttgatctacgaacgcgtggggtgctaa

SEQ ID NO: 27798 - DNA, 116 bp, Glycine max
  Peptide Sequence Number=SeqID_119483
ggattgtcatcatcaaaaagggggagattgtagaaggagattgtagaatgtcataccctaatttcgtccggggacctttgcttgatgacatgcgacctttctttggtccttgtgag

SEQ ID NO: 27799 - DNA, 453 bp, Glycine max
  Peptide Sequence Number=SeqID_119484
gagtgtcatgtcgtgatttctcttatacagtgtgcctccgctcatgaagaaactggctgccaacctcctcaatgtccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 27800 - DNA, 222 bp, Glycine max
  Peptide Sequence Number=SeqID_119485
atggacacttcttcgcccccgttttcaccatgggcaaatatatacgcaggcgacaaggtgctgatgcgctggcgattcagtggctgctgccagtggtgctccctgcatgtctttccgggttggactcaagacgatagttaccggataaggcgcagcggtcggactgaacggggggttcgtgcatacagtccagcttggagcgaactgcctacccggaactga

SEQ ID NO: 27801 - DNA, 666 bp, Glycine max
  Peptide Sequence Number=SeqID_119486
atgaaaagagaaaaacatgcctcctatagtagtcataactcttgcaagagcctaagtgaagaacttcgtgactattatgaaggaaggcataggtcacatcttagacctcactcccataggagagaaaatgaaagaaagcctcaagaggctaacattaacctcccatacttccatgggaaggacaatgtagagacttactcagattgggaaataaggatagagcaaaaacttaaaagaaagtctactagtatgcaagaaaagactagctctataaagtgctttaaatgtcttggaagaggacacattacttctcaatgccccaccaagaaaaccatgattatgaggagccaagacatttatagtagccaagatgaggctactacttcaccttcctctagtgaaattgaagaagcaaaaggggaagaatctagtgaagaaatctacccccaaggagagggacaacctttagtgtttaaggaggagtataaggagaaacttgttagcattgccacacctcttgggcttgagtttattcctcaagtaaaggagttgttggatgagggtttggttcgcaagagcttaaatccttgtgctttgtcggtgcccaaaataggtattattaggcaccaaatccctaaaataggtggtatgatgatgtttgagtag

SEQ ID NO: 27802 - DNA, 264 bp, Glycine max
  Peptide Sequence Number=SeqID_119487
atgcgggggtccggggaatttgtccccttctcagatacgacgtctaggggtagcgaaatgccccaacgcacgtttttaagaaggcgacacggaccctccgttggtttgtttacagtagggatcaagacagaacccatatgcaatgcctatgcaaacgacacaatgcgaggtatcatcccctttgaagaacatattgtagcagtagggactactagcaacaataggttttcaaagagaaaagctctagatgagggttcactgtaa

SEQ ID NO: 27803 - DNA, 342 bp, Glycine max
  Peptide Sequence Number=SeqID_119488
atgcttggggatggaaatgaaggaatgtctacactacctggattgaatcagatacaatttgaagggttttgtaggttcattgatcggggcttaccagaagggctttttaagtttccaaaaattgaggatacagatcaagaaattgaatttcaattatttgtagaaacatatcaattattagaacccttgataaacgaaaaagatgctgtatatgaatcgcttacatattctgctgaattatatgtatctgcgggatttaattttggaaaagtagtagggatcaagcttatcgataccgtcgaccctcgaggggggggcccggaccagcttttgtccctttag

SEQ ID NO: 27804 - DNA, 435 bp, Glycine max
  Peptide Sequence Number=SeqID_119489
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaacccggaaagacatgcaaaagcaccactggcagcagccactggtaattgatttagaggagttagtcttgaagtcatgcgcccggttaaagctaaactga

SEQ ID NO: 27805 - DNA, 288 bp, Glycine max
  Peptide Sequence Number=SeqID_119490
atgggaccaggatcaattgcaacaaaaacatttgagaatataaagtttcctagaggtcgtagtggaattaagagttttgatgcggaactagttgaccaagaagggaactctataccttctaccaccaaaatattaccatggtcacctaatcctaagcttcggcgtcctgagaatgcttttttccaagaaacaaaggcacatgtaatggtggcattcttccacattattggggatttggagtataatcacgaggaacaacctcgaaattccgtgatctttttgctatag

SEQ ID NO: 27806 - DNA, 618 bp, Glycine max
  Peptide Sequence Number=SeqID_119491
atggccccaaggaagcttgcctcaaagagatccaggaaggataaagcggctgaaggaaccagttccgctcccgaatatgacagccaccgttttaggagcgctgagcaccaacagcgcttcgaggccatcaagggatggtcatttctccgggagcgacgcgtccatcttagggacgacgagtataccgacttccaggaggagatagttcgccggcggtgggcatcactggttacccccatggccaagttcgacccagacatagtccttgagttttatgccaatgcttggcctacagaggagggcgtgcgagatatgcgatcctgggtgagggtgctggaggagggccaggaatgcgagtatggccagaggaggaaccgggccgatgggtttgatgaggaggccatcgcccaattgctgtgtataccggggcaggatttttcccggactgctgctggaagacgggtgaggatcatgcgcaccaacatgaccaccctgactcagatctggatgactttgctgctcagcaacatccagcccagcgatcataattccgacctcccgctgcccaagtgtcagctggtgtttggcgcctaccaggcaccctctggacccggataa

SEQ ID NO: 27807 - DNA, 812 bp, Glycine max
  Peptide Sequence Number=SeqID_119492
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggagttcatgaggaggaacccaacctccatgctgaagattttcaaagcatgtaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 27808 - DNA, 709 bp, Glycine max
  Peptide Sequence Number=SeqID_119493
atggccccaaggaagcttgcctcaaagagatccaggaaggataaagcggctgaaggaaccagttccgctcccgaatatgacaggcaccgttttaggagcactaagcaccagcagcgcttcgaggcaatcaagggatggtcatttctccgggagcgacgcgtccagctcagggacgacgagtataccgacttccaggaggagatagttcgccggcggtgggcatcactggttacccccatggccaagttcgacccagacatagtcctcgaattttatgccaatgcttggcctacagaggagggcgtgcgagatatgcgatcctgggtgaggggtcagtggatcccgttcgatgcagatgctctcagccagttcctggaataccctttagtgctggaggagggccaggaatgcgagtatggccagaggaggaaccggtccgacgggtttgatgaggaggccatcgcccagttgctatgtataccggggcaggattttgcccggactgctgctggaagacgggtgcgaatcatgcgcaccaacatgaccaccctgactcaaatctggatgactttgctgctcagtaacatccagcccagcgatcataattccgacctccccttgccgaagtgtcagctggtgtacgccatcctgacacgaatgagcattcatgtggctcagttaatcgctgatgccatctatctatttgcag

SEQ ID NO: 27809 - DNA, 159 bp, Glycine max
  Peptide Sequence Number=SeqID_119494
atgaagagaaaaaagagggaaatcaagtctgaagcgctccctgaagaaaatctaagccgaggtgctgccgtaacgcttccaagacatttccgtgagcaaatccatgaagattttccgtcgttcttcaccgttattcgttcgttctgtggtcttcaatcg

SEQ ID NO: 27810 - DNA, 826 bp, Glycine max
  Peptide Sequence Number=SeqID_119495
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcgctgcgggcctcttcgctattacgccagctggcgaaagggggatgtgctgcaaggcgattaagttgggtaacgccagggttttcccagtcacgacgttggatcttaggatgaccgataggaggaaggaagccataccttttttctgggtactatccttcgatggcgagaatagcaggggtgatcaagatcttggaatgagaattagactgagtgaagcaaagctggtggatctagcagcaattgacacctttcttgcttatcaccacagcaaggaaagcccggttattgctgttttggcagatgcgtatgatacatttgacttaagatgcgagaagagtagtgcgaggattgtctattgtacgcctgctttttatgtatggttggtatcccacgtcttcaatcatgagagtagatctgtctgccccctacaaggtcatcgcatctgcgtcgaaaaggacaaagcaaattgggaagaactcttggcaggcatgacaagagcgtccattagttggttcccatggtggaaagaaggaggggagggagtgttatgctcatgtgaaggatttccaaatgtcccttggatggggacgaggggttgcattaattataatcccatgttggccataagacagttaggttaccctatgagag

SEQ ID NO: 27811 - DNA, 330 bp, Glycine max
  Peptide Sequence Number=SeqID_119496
atgtttatagatgggctgagaccacaaaccaaacaattgttagatgcttcagcagagggaaaaataaagctaaagaccccaaaagaggcaactgagctaattgagaatatgtcagtcaacgatcatgccattctgcgtgacagagttcatcaacccacaaagaaaagcttgttagaactatcatcacatgatgctttattggcacataatcagttgttttataggaaactcgagattttatcagaaacactaggaaatcaacagagacaaggacatactcaaggaggattttcaggcttccagcagggtccttataaccgacaaggatag

SEQ ID NO: 27812 - DNA, 372 bp, Glycine max
  Peptide Sequence Number=SeqID_119497
atgtcttggaagaggacacattacttctcaatgccccaccaagaaaaccatgattatgagggccaagacatttatacagtagccaagatgaggctactacttcaccttcctctagtgaaagtgaagaagcaaaaagggaagaatctagtgaagagatctaccaccaagaagaaggataactttaaatggttaaggaggagtgtaaggagacaacctccacatattctccttggtaaaaagacatttgttagtattgccacacctggtaggcttgagtttattcctcaagtaaaggagttgttggatgggggtttggttcgcaagagcttaaatccttgtgctttgttggtgtccaaaatagggactcattag

SEQ ID NO: 27813 - DNA, 513 bp, Glycine max
  Peptide Sequence Number=SeqID_119498
atgagtcatcattcatctagtgttaatggcgagggtactagtcataaagaccctttatctagaatcttagatgagttgagttccctcaagttatggaaagaaaaacaagagagaaaagaaaaaggaaaaaaaaaagtggaagaaataagtcaagatgaaagaaagaaaataagagaggaagaaagaagaaaaataatgaaagaaatgaaaagagaaaaatatgcctactatagtagtcataactcttgcgagagcccccgtgaagaacttcgtgactattacgaaggaaggcataggtcacatcttagacttcactcccataggagagaaaaggaaagaaagcctcaagaggataacattaacctcccatacttccataggaaggacaatgtagaggctaacttagattgggaaataagggtagaacaacaacttaaaaagaagtctacgtcaaaatcttatcgctctcactcttatacaaagaaagaccaaggtcaaggcatcttagggtga

SEQ ID NO: 27814 - DNA, 326 bp, Glycine max
  Peptide Sequence Number=SeqID_119499
atggctccgaagaaattctccacgaagaggtctagaagggacgccactggagaagactccagtaccacctcagagactaaccaccgtggacaggtgcagatacatgagtgtctctaccagttcagcctcagtcagcaggggcatggttccgccccttttgtatgccctaccccagagcagtttggggctaaggtcgcatggcccggagactggcccgatgcccaggcaggggaggagcctacaaaatcccccggtgaggcagatgagccccatagggacgaggatatgactgacctacttggtttcttgggaaggagcgaagccac

SEQ ID NO: 27815 - DNA, 246 bp, Glycine max
  Peptide Sequence Number=SeqID_119500
atgagcaagatcgtcttaggcgatggtcaaataccgggccaaacccaaagacagagacaaatcgagggggaaaacgagcccgttgatgcgaagagaccgacatcgtcttctgtaccttttgtcatccaaggacaacgagtcaggtttttactcccgttgtccagaaacattcaagcccagcgacgcgcggggttcttctctgttgggcagagacgatcgggtgcaatggcgaagggaagtgtcgtg

SEQ ID NO: 27816 - DNA, 141 bp, Glycine max
  Peptide Sequence Number=SeqID_119501
atgactaaagcacgtcaaaaagggggtacggaaagggaaaagagggaggtggttgccgcccagctcgcacaagcgagctgggttgcttccaccagaaggcaccaccttctgttggaagatcctggaaggcccaaggcctga

SEQ ID NO: 27817 - DNA, 180 bp, Glycine max
  Peptide Sequence Number=SeqID_119502
atgtcggcttcttcgccacctggggctgtagtatgttccaaggcttgggctgttcgcccattaaagcgagcctccggtagcacagccgagacagcgatgggttctctgccccagcggggatggagcgaaagaagttttgagaattcaagagaaggtcacggcgagacgagccgtttctaa

SEQ ID NO: 27818 - DNA, 399 bp, Glycine max
  Peptide Sequence Number=SeqID_119503
ggggccggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgaaacagctatgaccatgattacgaattcgagctcggtaccttccctcaaagttgctctggctgacttgcccgttccgcttctctcccgcttttgggcggttcttcctccagcagcctattctttcacagcttctatgccaagggctattatatatatttga

SEQ ID NO: 27819 - DNA, 195 bp, Glycine max
  Peptide Sequence Number=SeqID_119504
atgtctcgggcttcatcctcctcagtttttgttttaccagggaatactcaggatttagaggggaagtcccacatcttcgtcctcttcaccctccgtctgatctatttcttgcttgaaatcaatggtcgggtcccaggtattagtaccttcgagggactcgtcgtcggatctggcgttttaagcgtcaagaaataa

SEQ ID NO: 27820 - DNA, 387 bp, Glycine max
  Peptide Sequence Number=SeqID_119505
atggcatccttcagccacatgcaatcccaacttcaatcgcagatgcaatctcagggacttgtagtgcctcctgagcctctggttggtccctccggtcctcgagtgagcacaaaggggagttgtgttgatccctcaggaaatgatcctgagacgggtgactctgacaggtgcgacttgtacatagaagcagatcctgcccgcctggttgccatagggagagattctgagggatccactgttgttcataacactcctttgttgtctggccaagtaacggtgagtgtggcggaggttacagatgccgatgctccagttcctgtacccactgatgaggtttccatagtgaggcagacacttcacaccttccttgcttgggcgaaacatctg

SEQ ID NO: 27821 - DNA, 281 bp, Glycine max
  Peptide Sequence Number=SeqID_119506
cttgggaggattgatggggactcggtgttgagagaaacgaggatatgggctacttgggagtacatgagctcagttggaggtgggcaacaggggatgagtggtacctggagatatgtcgcgggggtcaggagaccttggggacgtcaggtcgggcgagctcctggcagtcaacagataaaaggaacaaagaccacaaagcaaggaggctggtgtggtggctgggccagctgtgaatcttgtgtgatatatgggttatgggctctggtaatcgattaccaagg

SEQ ID NO: 27822 - DNA, 47 bp, Glycine max
  Peptide Sequence Number=SeqID_119507
atggaagacgcacgtcgtgagcccttgcgtcgctctcccgctgaagg

SEQ ID NO: 27823 - DNA, 417 bp, Glycine max
  misc_feature (158)..(158): n is a, c, g, or t
  Peptide Sequence Number=SeqID_119508
cgcgcagttgggcaccgtaacccagcttccggttcatcccgcatcgccagttctgctgaccagaaatggcccacttggagctctcgattccatggcgcggctcaacagagcagccgcaccgtatcctgagggaaacttcggagggaaccagcgactanacggcatagttcaccatctttcgggtcccgacaggtatgctctcactcgaacccttcacagaagatcagggtcggtcggcggtgcaacccacagggggatcccaccaatcagcttccttgcgccttacgggccgacgccaggagcgcgcatgtgccgaggcacgccaagggcgcgcgctgccttccacaatcgcgatgatgacgtctccatgagcatatcagcagcccgggcttgggccaccatcgcaatcccgcgtcg

SEQ ID NO: 27824 - DNA, 505 bp, Glycine max
  Peptide Sequence Number=SeqID_119509
atgtcacgaaactttatggactacgcaacaatcccttctttgacttctagaatgttgcggaactttacggattgcccaacaatgcttcctttcgacttccggcatgtctcggaactccacggattgcctaacgatgggttcaatatccctaccagcggaacctccgccattgcactcgatcgtccctggatgacaaaaggtgcagaagacgatgttagtctctgcgcgtcaacgggctcgtttgcccttgatcgacgaaaggtgcgggtaaccataaggcaaccccgcatgtcacctgacttcatgggccagggcgacaaaagattgatggtgcggaagacgacgttagtctccacgtgtcaatgggcacatactgcgattgacaaaagggtgcagataaagggtgcagaagatgatgttagtctccgcgtgtcaacggatagcaaaagaatgtttacaggtcaccgttgggtgtctccgcatgtcaccggactcttgggtcacg

SEQ ID NO: 27825 - DNA, 259 bp, Glycine max
  Peptide Sequence Number=SeqID_119510
atggttaaggaggagtgtaaggagataagtgtctcctccaagaggttagctaagaaggaaagtcattatgtaataaagacaaaaattaaagaaacttccgttcctagacaacctccacatcttctcctttgtaaaaagacacttgttagcattgccacacctcttgggcttgaggttattcctcaagtaaagaagttgttggatgaggatttcgttcgcaagaacttatatccttgtgctttgttggtgcccaaaatag

SEQ ID NO: 27826 - DNA, 489 bp, Glycine max
  Peptide Sequence Number=SeqID_119511
atgtgggcctttcatacagggcgtcaacttgactgggcacacttagtcagatatcgcatgcataaggcattgcgattaaatgctccattgccatatccacaccttgtcactctctttttttgccattttggaattcctcttgattctgaaccttatgttccaatcaagagatcctttttaattggtgctgctgtgattgcttcttttggttaccgcaaagagcatgatggctcttgggtcaaaaagggtgctcaacccgctgatgatgaaggcaacctacaagttgaagataattcctctcttcttcgaaggcttatggataagttcgatggtcttcagacttttgttggtgacaaatttgatgccatggaattgcaagtcgacatgcgattcgatgccatggaatcaagaatcaccaaggttgaagaagatgtctccttcatccgtacttgctttgatccaccaccaccgcctccatcatcctcttag

SEQ ID NO: 27827 - DNA, 344 bp, Glycine max
  Peptide Sequence Number=SeqID_119512
gtaagtggatccgcccgccgttcacccgagccttcattgagaagtattgcacgcctaggcaggcacagggtgatgtgccacaggtcgcagacgcaccactgccacctcatcaggttgatcccgctgggtcattaggcatggagcggtatctacaacacttggttcgccaacagacgaccaaccaccgggggcagtttagggctgaggtcgcatggcccggagattggcccgaggaccagacggaggaggcacctgcaggagctcctgacgatgcagaggacgctcgcatggatgaggagatgacagacttgctcggcttcttgggaggaagtggagccacgtga

SEQ ID NO: 27828 - DNA, 432 bp, Glycine max
  Peptide Sequence Number=SeqID_119513
gactctgccagtcgtttcggcgtccccgtcacacctagcaaggtgattcgtccgcccatcacccgagcttttattgagaagtactgcacgcagagacaggtccagggtgatgcaccacagtccgcggatgcgccgccacctcatcaggctggtccagccggattgtttgatacagagcagtatttgcggcatttggttcgccagcaggcggccaaccaccgggcacatagccagggctttacttcttttccgtgccctactccggaccagttcagggcagaggtcgcatggcctggggattggcctgaggcccaagcaggagaggcaccagtaggggcaccagcagaggcccccgacgaggtagatgaggcccgcgaggacgaggagacgaccgatttacttgatttcttacgaggaagcggggccacatga

SEQ ID NO: 27829 - DNA, 468 bp, Glycine max
  Peptide Sequence Number=SeqID_119514
atgatgatttggaaacaacgtgcaaaattagtcatggccacagccaggtgggcactcaagcatcccgtttatggcattgtgatactacggttgggaatttacacaaacagacccaacgtttccaaattatgttctttcatcagttcaatgaatccatccattcttatctcggttattcaggaaaataaactcttagcgtcagtcccttgtttccagaagatatgtttgctctctacgaatgatttatgcttcctaaccataacatgccgaccttcgagcatttcgtttctaaacgaccatatagaggaaatactaggtgtcgtaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagttga

SEQ ID NO: 27830 - DNA, 178 bp, Glycine max
  Peptide Sequence Number=SeqID_119515
aatgaccaaacttggtctctgcgtgccatcggacacgactgtgtctgaatggcaaaggggtacggataaccgtaagaatgaccaaacttggtctctgcttgtcatcggcccgccgcctctagatgacaaaaggggtgcgaataaccataaggtatctccgcgggctaccggctcttga

SEQ ID NO: 27831 - DNA, 771 bp, Glycine max
  Peptide Sequence Number=SeqID_119516
atgccctcaccttcggaggactgcacatcctcgccatcagagggctgcatgccttcgcgattggaggactacacatccttgccatcagagggctgcacctcctcgcctttagaggactacatgtcctcgccttcagaggactacacgtcctcgccttcagagggccacacgccctcgccttcagaggactgcacgtcctcaccttcagagggctgcacgccctcgccttcagaggcctgcatgccctcgtcttcagaggactgcacgtcctcgtctttagattgctgctcgcccttgccttcagaggactacacgtcctcgccatcagagggttgcacgccctcaccttcagaggactacacaggactgcacgtcctcaccttcaaggggctacacaccctcacctttagagggttacacgcccttgccttcagaggactacacgtcctcgtctttagggggctgctcggcctcgctttcagaggactacatgtcctcgctatcagaggattgcacgtcctcacctttggaggacttcaagtcctcgccatcagaggactgcatgtcctcaccttcagagggctgcacgccctcgtcttcagaggactgcacgtcctcgtcttcagagggctgcacatcctcgccttcaaagggcgacacgtcctcaacttcagagggctgcacaccctcgccttcagaggtctacgcgtcctcactttcattgggttgcatatccgcaccttaagagaatttaaggttctctactcttaa

SEQ ID NO: 27832 - DNA, 543 bp, Glycine max
  Peptide Sequence Number=SeqID_119517
atgcagtcccagcttcagtcacagatgcaatcacagggacttgcaatgcctccggagcctaaggttggtccctcagctgctcatgttagcacaaatgggagttgtgttgatccctcactgaccgatccagagacgggtgacttagacaaatgtgggctgtacatcgaacaaaatccttcccgcctagttgccctaggaagagtttatgagggatccatagttgttcacaacatccctttgttgcatggccaggtgaaggttggtgttgaggaggttaaagatgcagaggttcccgttcctgtacccaatgacgaggcagctgtgtctccagcaaagcctccagataggccaaatcctgaggtcgatgatcccctatatttgatgacattgaccatcccacaacttttcttgaagcctctgcaggttatgcgggatgctactgtgttcagggtgtttaatccagacttcccattgtacatcaagcatgaagatctctctgaaattgcacatgatggtcaatgtctcaacatatctgttatatag

SEQ ID NO: 27833 - DNA, 273 bp, Glycine max
  Peptide Sequence Number=SeqID_119518
atgaatattgactatggtataaggaaggatgagccatcggttattactgaaactagcgaacttgatgttgttgacctttatgaaagagatctgttaaaagctattgatggacagtttacgacctctgagaagtcgcatgctaccacactcattatgcaattctcttccattaagcttactggaacaagaggtatgtgtgaccatatcatgcacttaagggacatagtggctcagttgaaaaccctggaagttaccatgtctaaatccttcctg

SEQ ID NO: 27834 - DNA, 618 bp, Glycine max
  Peptide Sequence Number=SeqID_119519
ggtttcctcatttgggatcctggggaagaggatcaagttggcccttgcgtacagcttgatgcactatctcccttcaaccctttgagcgatatgtggcaaaaggaactacgagatcaccccaaggacgccttcggcatccaggggtcgcggaccgaccatagaaccctgttcaaaaagcggtacgcattagctatccgctctcaggttggacaaatcagtcggggcctgagaggcggtggtttaccctgtggcggatgtcagcggttcgagtccgcttatctccaactcgtgaacttagtcgatacaaagctatatgatagcacttccatttttccgattcggcagtttgatctatgctatgatttatcattcatggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctggtga

SEQ ID NO: 27835 - DNA, 276 bp, Glycine max
  Peptide Sequence Number=SeqID_119520
atgccgatgttggatcaatttcatccatgcattcatgatttcattgaaaacattatcaatgtcaaacttgacggtaactatagatatcgtgcaattgctatcttattaggtataggtgaagattcatggtatttgatttgtaaccatttacttaaagaacttgcaaaatggtctgatgagtatatcaacctgcttgatggtatagacagatttaaggaattaaagtggtcgctacttgtaaatggattatcatggttaccatggataagtggatga

SEQ ID NO: 27836 - DNA, 576 bp, Glycine max
  Peptide Sequence Number=SeqID_119521
atgggtgaccaagaggagatacaggaacagatgaaagccgacatgtcagctttgaaggagcaaatggcttccatgatggatgccatgttaggaatgagacaacttatggagaataacgtggccaccgctgccgctgttagttcggcaaccaaagcagactcaactctcccagctaccgcgcaccatcttctcccaaacgtggtaggacgagaaaaaagcacactggggcacatcagcaacccccatttgggatacaaccgagtggcttacccttatggattaccacctaattacacgccactagtcatgcgtgatgacgcggctcatgtcccttcccccatccttgaacgggagtcttttcgacaatcagatgaggttcacgaggatcgtagagagtatgcccaaggagacatctatttctaccccccggtccccatggaggggccgacacccaacacactgcctcagcccaacctcacgggagaacctcgaaacctcccagcacagccaatattcttgtccacagaaggaccacccccggcaacgaaagaaaaaaggaaactcgatctcatctaa

SEQ ID NO: 27837 - DNA, 456 bp, Glycine max
  Peptide Sequence Number=SeqID_119522
atggcacctacaccttgcacacacattgagatattaggccctacacccaggtctatgaaagaacatgctttacgagacccttaccgaatgcgtgctagagctagagtaatgggtgaaacagacgaggtgcaagagtggataaaggccaacttggagcccatgaaaaagcaaatgaccacaatgatgaaggccatgatgagcatgaaaaagataatgaaggtcaatacggctgtagttgccgctaccagtgccattactaaggtggaactgactcctacatctggcctcaaccaaataaatcatgccatctcggatatggtagggcagataggcaaagaattgggaagtacgggcggcccccattttgtgcaagttcaaaacaagcattccttcccaccatatggcttggctttcaaccatacaccgcccaatgttgcacacactcccaatgaggat

SEQ ID NO: 27838 - DNA, 294 bp, Glycine max
  Peptide Sequence Number=SeqID_119523
atgtggaccaccacgggggaggagcttgccacccagctcgcccaggcgagcaaggttgcttcctccagaagcaacaaccttctggaggaaggatctggaaggcccaaaagttacgaaaactcacggattgcgaaaaacacctcctttcgattttcgccacattacggaatttcacggatcgcgcaagcccgctttttttttatttttggcacctctcgggacttcatttattgtgcaacaaaggatgccaagtatctcaaagcggctaaccaaaggttgcatgtcatcaagtaa

SEQ ID NO: 27839 - DNA, 498 bp, Glycine max
  Peptide Sequence Number=SeqID_119524
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggctccgcccccctgacgagcatcacaaaatcgacgctccagtcagaggtggcgaaacccgacaggactattaa

SEQ ID NO: 27840 - DNA, 1206 bp, Glycine max
  Peptide Sequence Number=SeqID_119525
atgtggtatgatgaaagaatatcaaaatataagaattgtctgaatccaaggttcagtttatgttgtggagatgacaaagttgaattgccattattacaaaatccaccccaatatctgcaacaacttctatttcatgatgatacaattgatagtaaaaattatcaacataactcgcgagcatacaacatgatgtttgcctttacttctgctagaattaagctagataaaacaattaataattcaagaggacctcctacgatcagaatacaggggcaaccatgccatagaataggcagtctattaccaatgcctaggaaaaaacccaaatttgcacagctatatatctttgacacagcaaatgaagtgcaaaatagaattaatgtcatgagctttaagtcacatgctcgatcaacacaatctcatgctaaaagttttagaatggccagagatagattgacagctgatcaagccaataatatcaaattgcaactcatagctgctcggggaaaagatggccgtgtatataatatgcctaatgttccgaaaattgctgctcttattgttggcgattttcatccaggctcaaaaagagatattattgttgaaactcaaaatggagaattacaaagaatccatgaacttcatcctagctatctaccactacagtatcctctactttttctttatggagaagacggatatagagctgacatacttcaccgttgtacttcatccagcaaaaaaagaaagcaaaaccgtctgacaatgagagagtggtttgcttatagacttcagtccaggtcaaatgaagcacaaactttattgcattctcgaaaattatttcaacaattcattgttgaaggttataccatggtggaatctgaaagacttagctatatcagaaacaaccaaaagaagcttagagttgataagtattctagcttacaaacttcattggatactggaacagctaaaggcttaaccaagggaaaaagagtcatcttaccctcaacgtttgttgggagcccacgttatatgaatcaactttactttgatggtatgacaatatgcagtcatgttggttttccaaatctttttattactctaacctgtaatccaaattggcctgaaattcgtagattactttcacctttgaatctcaaaccaacagacaggccagatattgtatcacgaatttcagattaa

SEQ ID NO: 27841 - DNA, 174 bp, Glycine max
  Peptide Sequence Number=SeqID_119526
atggaagcatcgttgcataattccgtgaggttccgtaacattccaatattcctccagaaggatgttgcttctggaggaagcaacctggctcgcctgggcgagctgagctcgcctgggcgagctgagctcgcctgggcgagctgggcggcaaccacctcccctattttgctataa

SEQ ID NO: 27842 - DNA, 270 bp, Glycine max
  Peptide Sequence Number=SeqID_119527
atggccaagttcgacccagacatagtcctcgaattttatgccaatgcttggcctacggaggagggcgtgcaagatatgagatcctgggtgaggggtcagtggatcccgttcgatgcggatgctatcagccagttcctgggatatcctttagtgctggaagagggccaggagtgcgaggaggcgagtgcgaatcatgcgcaccaacatgaccaccctgacccagatatggatgacgttgctgctcagcaacatcctgcccagcgatcataa

SEQ ID NO: 27843 - DNA, 360 bp, Glycine max
  Peptide Sequence Number=SeqID_119528
atggcctctggtaatcgattaccaatggtgtgtaatcgattacacagggtgatagggcactggaacccgcatgcacacttcagtagcctgtggagtggatactactctacacctacttcatatcgactagttgagccggttcaagtgatagaggtgtcatcctctgaagaggatcttgaagaggacctagaggagttaccccctgatcctgctatggacacccttgacttacctgaggatgatgaagacccactccctgatgttgattctctagaggatattatgtcagcatctgaggcagactctacagaggagagtggccctagagggacagcgaatagtgacgactcttcatcatag

SEQ ID NO: 27844 - DNA, 89 bp, Glycine max
  Peptide Sequence Number=SeqID_119529
aggttgactgcgcggaagacgacgtaaatcttcgagtgtcaacgggttcgttggccgcgattgacaaagggtgcagaagacgacgttag

SEQ ID NO: 27845 - DNA, 661 bp, Glycine max
  Peptide Sequence Number=SeqID_119530
atggatgaagccgatcgcatgctcgatatgggcttcagcgatgctatcgatgaagtgattcgctatgcgccggcttcacgccagactttactgttctccgcgacctggccggaagctatcgccgcgataagcagccgggtgcagcgggatccgcagacgatcgaaatcgatagcgttgatgcgctgccgtctattgaacagcagttcttcgacgtttcgcaaagcggtaaaatcaagctgctgcaaaaattgctcagccatcatcagccggcttcctgcgtggtattttgtaatactaagcgtgattgtcaggcggtgtgcgatgcattgaatgctgccggccagagcgcgctatcgctgcatggcgacctggagcagcgcgatcgcgatcagacgctggtgcgttttgccaacggtagcgcgcgcgtactggtggcgaccgacgttgcggcgcgcggcctggatatcaaatcgctggagctggtggttaactttgaactggcgtgggatcctgaagttcacgttcaccgtatcgggcgtaccgcgcgcgcaggcgaaagcggcctggcgattagtttctgcgcgccggaagaggcgcagcgcgctaacattcttgccgaaatgctgcagataacactcaactgggttaacgcgccggcgg

SEQ ID NO: 27846 - DNA, 369 bp, Glycine max
  Peptide Sequence Number=SeqID_119531
atgtgggaggggcagttggatattgaagcggaagaaggagttcttctgcgggaatctgcggaagaaaggggagaaggttcttccgcgcgttctggcggaagaaggtttcgaaggttcttccgctggatccagcggaagatggttccggaggttcttctgtgggctccagcggaagaactatgtcttccgcggatcccgcggaagaacctgcggaaccttcttccgcaggcaacatttcctgctcgcggaagaacctatggaaccttcttccgcaggcaagctatccttctcacggaagaacattcgaaacttcttccgcggagcatgttttggtgttttttggttattttttttgaaaattttgtctga

SEQ ID NO: 27847 - DNA, 846 bp, Glycine max
  Peptide Sequence Number=SeqID_119532
atggccaagtttgatccagaagtactccttgagttttatgccaatgcttgtccaacagaggagggcgtgcgtcacatgagatcctggcttagggctcagtggatcccgttcgatgccgacgctatcagccagctcctgggatatccgatggtattggaagagggccaggaatgcgagtatggccagaggaggaaccggtctgatgggttcgatgaggaggccatcgcccagctgctatgtataccggggcaggattttgcccggactgctgcagggaggcgagtgcgcatcatgcgcaccaacatgaccaccctgacccagatatggatgacgttgctcctcagcaacatcctgcccaccgatcataattccgacctccccatgcctaagtgccagctggtgtacgccatcctgacgcggatgagcatccatgtggctcagttgatcgctgatgccatatatatttttgcaggtccggcgaacactaggcaccctttggacccagataagtccaacagggccctgggattccccgcactgatcacaggactctgccagtcgttcggagtccccgtgttctacaaaggcggccaaccccccgagcacaagtacggaccccatgactgtctgtaccagatgagccttagcatgcagagccagggcttcgcttctttttcatgccctactccagaccagttcagggcagaggtagcatggcctggagattggcccgaggcccaagcaggagaggcacccccagaagctcccggcgatggagaagaagcccacgaggatgaggagatggccgatttgcttgacttcttgggagggagtggagatacgtga

SEQ ID NO: 27848 - DNA, 1839 bp, Glycine max
  Peptide Sequence Number=SeqID_119533
cttcccgctgcgcgcctgggactggaattactacgcggagcaggtacgcaccgcgcaatacgcgctggacgaagggcaaatccgcccctattttgagttcaacacggtactggaaaagggcgtgttctggtgtgccagccagttgtatggcattcgctttgaacagcgccacgatctgccggtctaccatccggacgtcaacgtttatgagattttcgatgccgacggtgcaccgttagcgctgttctacaccgatttcttcacgcgggataacaagagcggtggcgcatggatgggcaatttcgtcgaccagtcgacgctgctggaaagccggccggtgatttacaacgtctgcaattacagcaagccgcagcccggtcagccggcactgctcagctgggatgaggtgatcacgctgttccatgagtttggccacacgctgcacggcctgttcgccacccagcgctatgccagcctgtccggcaccgccacaccgcgtgattttgtcgagtttccgtcgcaaatcaacgaacactgggccagtcaggatcaggtgtttgcccactatgcacgtcattatcagaccggtgaagcgatgcccgctgcgctgcgcgacaaaatggtgcgcgccgcgaaattcaacaaaggctatgacatgaccgaactgctggcggcggcactgcttgatttgcagtggcactcgctgtcaccgcacgataatccgcaggatgtcagccattttgagcagcaggcgctggcggcggagaatattgccctgagtgccgtgccgccgcgctatcgctccagctacttccgtcatatctggggtggcggctacgcggccgggtattacgcctatatctggacgcagatgctggccgacgatggttatcaggcgtttgtcgagcggggcggtctgacgcgcgaaaatggtcagcgcttccgtgagcagattctgtcgcgcggtaacagcagcgatctgcagcatctgtggctggcctggcgcgggccacccagcggtgcagctggctggcctgcacgcttatcccagcggaccgccttcaatggtgtcgcacatgccggccagcacgcgctcgccggtttcctctttcagtccggcataccattccgcggtgaccgccgcatctttggcgtgggtgacatcacaacgcttgcgcgctttcagcaccaaatcacgggtgcgcgccacgcgccgcgcctcatagcgcagcaggccgtcctcaatgcccagcgagtgggcggtcagggtttgcgccagtaccaccgcatcttccatggccgcacagccgccctgaccgatatccggcgtggtgctgtgtgccgcatcccccagcagcgccacacgccctctgacaaagcgactgaagggttcgatatcatgaatctccacgcgattggtggtttgtgcgtcaatgctggcgatcagccgctggaccggttcggcccagccggcaaaatagccgcgcagatccgggacatcaaagaaaaagtagaagcggttaccgctcaccggcatcagcgagacgcgcttgccctcgccgacaaacgtggtccactgatcggcgggcgcgatgctttcatcgatagtgaccaggccattccagttgacgtagcctgcgtagcggcgctcgacgtgttcgcccagcacgtgatggcgaatcaccgagtgggtgccgtcggcggccaccataaaatccccttcagcctggctgccgtcatcaaaccaggcggtcacgccgctggcatgctgctccactcgcacaacgcgtttgccaaagcgaatgcgttcgcggccgtagctgtcgatcagcagcgcct

SEQ ID NO: 27849 - DNA, 234 bp, Glycine max
  Peptide Sequence Number=SeqID_119534
atgataaaatctaggcaatttcaggttaaaaagaggctaagtcatgaagtgcaaaaacgcgcatccaccgctaagcgtagcttcaatgcgcttagcacaacagaagaatctagcagagcatcaatatcaaggccgcgcgctaagcgcgagatcactgtgctaagcgtagtagttgtcttcagtcaggctcagtgcatgactgacgctaagttcaaatccacttactcgcgctaa

SEQ ID NO: 27850 - DNA, 507 bp, Glycine max
  Peptide Sequence Number=SeqID_119535
atggcagaatcatcgaagaagagaaagggatcatcctccaccatcgctgctgagggccatcaccgccacggaccatctgaagcacccacaacacctatccatcctcccttatcatctccaagatcacccactctgttttcttccgatgatcaacatctatggtacctttctcaattctcttctaggatcatcttagaccttaagtacctagacatagatttcttcaatgatgagacatttgattgttatcaagtgtttcaaaattttggcttggttgatttcatgtctttaaaattgccttattatcctgaacttgtcaaagtcttttactgcaatttaaaaattcaggatggcattatttcttctgaggtgcatggtattttcatgatcattgatcaatcattgttcttttctttgactaaattacccagtcaaggtgcaccttttgagggcaccattgttgatgactggaaatttgattattcttgtcatgatgctcgccgtatg

SEQ ID NO: 27851 - DNA, 420 bp, Glycine max
  Peptide Sequence Number=SeqID_119536
atgcgaacatgctttagtaaagagacaaaacttccaactgatcagagcaacatatgccttttggatgaaggacaatgtgtctatcggggaaggagacatttcgtttctaaacgaccatttagaggaaacactgggtccaacaaagataggagaaaatcactcaaagtgtatcaatctcacacaatgcgtggcgagaaagtcgctagcgcacaggattttgtcggcaatcaaagggagaggaccactttaggtcgtgggcaaggattgacattctcaccctgggtcaaggtttatgataagttgggattttggctcaaggcttgtagaacgactggtcatgatatatgtcagggtttggctagtggttcgaggataaaggggatgccctacattatttccatgatacacatgcaacaatga

SEQ ID NO: 27852 - DNA, 228 bp, Glycine max
  Peptide Sequence Number=SeqID_119537
atgacggtgaaacctctgacacatgcagctcccggagacggtcacaacttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 27853 - DNA, 45 bp, Glycine max
  Peptide Sequence Number=SeqID_119538
atggctctggagcggacatggatgcctcgtgtcttgctggaacag

SEQ ID NO: 27854 - DNA, 402 bp, Glycine max
  Peptide Sequence Number=SeqID_119539
atggaattgcaagtcgacatgcggttcgatgccatggaatcaaggatcaccaaagttgaagacgatgtctccttcatccttctttttgatgttgccaaagggggagagaacctagaacttggggattgtcatcatcaaaaagggggagattgtagacaaaggatcaagatgaatgttttgatgatgccaaaggatcacatgtttctcaaagctttattcaagacaaagaaatcaaagatattcaagatggatgatcaagacagtctctacagtcttaggaagagtatattaaataggaagggaattccaattgaagtagcaaaaggtttggccaagaaatttaagttaaaaagtgtttttcaagagatttactctctggtaatcgattaccagaggatgtaa

SEQ ID NO: 27855 - DNA, 399 bp, Glycine max
  Peptide Sequence Number=SeqID_119540
atggaccaattaaagcacctaagcatcccctcaggaatgcttagattctctaaccacgctagttacccacgtctgggccatccgacaagaaaaaatcagcatgcacagggacaggcagatatcctcatagctaggttccctaaccttaactatggtgttaaaatgggttttcgttctctaccgaaaccgcaagccaagttggaaattctgcttcggttgaagggttcctctcggtgtgggttttcaatggagaacaatgatggtttgtggtggctaatggtggatgtgggtgatggagaaagtacttggaactttagaaatggatttggaagaaagaaagaagaagaaatggcatttttcctaagctacaagaaagcaaaggctgaaatgcttaaataa

SEQ ID NO: 27856 - DNA, 446 bp, Glycine max
  Peptide Sequence Number=SeqID_119541
tacaatctaaatcccttaacgaggatccattggagggcaagtctggtgccagcagccgcgctcgtagttggaccttgggttgggtcgatcggtccgcctccggtgtgcaccggtcggctcgtcccttctgccggcgatgcgctcctgtccttaactggccgggtcgtgcctccggtgctgattctgatcctattgtgttggccttcgggatcggagtaatgattaacagggacagtcgggggcattcgtatttcatagtcagagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 27857 - DNA, 378 bp, Glycine max
  Peptide Sequence Number=SeqID_119542
gacaaacccttcttctcaccttccttggactatccttcttctctccagcaagtccttccagttccatatccttgtccactaggtactcccagtcaaaatgttagtgcaatcccatctcctccaccaagttcaactgaagttgttcctccacctcttattacatatcaatgcaggacacggaaaattggttctacagtgcctgaatcttctcctcgtgattcccatcctcctccaacagatcctcaaaccatggatccttattcctccacttcttctcatcactctgattcagattggcctattgtcatcaggaaaggtgggtctatactattaaggttgggcctaatggtgaggttgatcggcataaggctcggttag

SEQ ID NO: 27858 - DNA, 231 bp, Glycine max
  Peptide Sequence Number=SeqID_119543
atgcggggttacgttatggttacccgcaccttttgtcaacaaggggcaaatgagcccgttgacgcaaggagagtaacatcgtcttctgcaccttttgtcatcctttctcgtcaaggttaccttatggttacccgcacatttcgtcaaccaggggcaaacgagcttgttgacgcgcgggaactaacatcgtcttctgcaccttttgtcgtcctgccccgtgaagtcaaatga

SEQ ID NO: 27859 - DNA, 519 bp, Glycine max
  Peptide Sequence Number=SeqID_119544
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctagcccgaccggtcaaatctcatccacaatcgggtgctatcagtcttcttcttcaccttcgtctacacattgttgtcgggggcgacgatga

SEQ ID NO: 27860 - DNA, 246 bp, Glycine max
  Peptide Sequence Number=SeqID_119545
atggtggtcattctgcccaaggaacacctagttcctaaatcaaaggctcctgctaggtggattgtcgtcaagtgtaataaacaaaaaggaagtactaagtgcggctattatgtcatgcactggatgtccaccatcattttaggaagttttaggaataattgggaaacgtattttaacaatgctagaccattggagccagagagattaaaggcgctgcggatccagtgggcacagtattatctctga

SEQ ID NO: 27861 - DNA, 502 bp, Glycine max
  Peptide Sequence Number=SeqID_119546
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatgcatgcgagcgtggcactggccgtcgtttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 27862 - DNA, 228 bp, Glycine max
  Peptide Sequence Number=SeqID_119547
atggattattcacgctttttacaggcatgcattaatggaggttcagtggacgcgattaagggctcggagctgaaagtgccggacgccatctttgcatgggtgctcgacgggcagggcggcgtaaagccgctggctgatgacgatattatcgataagagcagtccctgctggctacatcttaattatacccataccgatagcgccgactggttagccggtacgccgtag

SEQ ID NO: 27863 - DNA, 207 bp, Glycine max
  Peptide Sequence Number=SeqID_119548
atgacgtatttatggatgcaagctaaacatgtttcagaacatgtttggaatggaaaagaagacggaaattacacatcagacgagttgtccccacatatcaaggggaaaaagaaataccagaggaaattattcctcttcttcgacaatgtgaattgttgggagtcagaccacaggaaggtgaacttcaaggcagtgtggttaaattaa

SEQ ID NO: 27864 - DNA, 774 bp, Glycine max
  Peptide Sequence Number=SeqID_119549
atgatcgcccagctgcgttccaaaccttcgctgagccaaaccggcgtgctggataagctcaaggcgctgaatgtgccggtgctgtttatcgacaccatgctcaagccggtggaaaacacgccgaaaagcgtgacgctgctgggggaaaccctcaaccgggaaagtgaagccaagcaatataccgattattatcagcagcattatcaggccattctggccaagacgcaggcggtggaacccaagccgctagtgttctttgaagccaaggccggcctgaacgggctggagtcctgctgcttcacccatgcgcacgtcggctggggcgcgttggtggaagcggtcggcgcgcgcaacatcggctctgcgctgttgccgggcgcgaccggcgacgtggcgctggaaaaggtgatcgccatgaaaccggatgcctacatcgtttccggctcgcagtgggccagcaagaccaacgccgcggtgccgttcggctatggcgtcacgcagcagcaggtggatgaggctttcaatcgcatgaaacagcgcccgggcttcgcgcaggtgtcggcggtgaaagaagggcggttctacggcatctaccataacttctacaaccatccgtacaacattgtcgggttggagtatctggcgaagtttatctatccggcgcagttcccggatctggatccggccaagacctacagcgagatcctcagccgctttaccgaagtgccggaaggcaaaggcattttgggcgcgcaggcgccgacggggaaataa

SEQ ID NO: 27865 - DNA, 300 bp, Glycine max
  Peptide Sequence Number=SeqID_119550
atgaagtttattggtgggaaatggaaagcagtgattttataccatcttattgagggggcaaaaagatataatgagatcaggaaagatattcctaccattacggaaagaacattaagccttcaattaaaacaattggaggaagacggtattatcagcagaaaggtttatacggaaaaaccgccgttagtagtggagtatgccttaactgattttggaaagacgcttcttcctgttttgaatgaaattacaagatggggagacgaagccattgccaattccaaaaaaataaccaggaattag

SEQ ID NO: 27866 - DNA, 369 bp, Glycine max
  Peptide Sequence Number=SeqID_119551
aaacgaaatgctaacatccaaaatctcatttatggttatgggggatttcatcagcagactctccttccccgaaaacaccgagactttttcaagtctcacaagtcgccagaactacgtaggtctgagttcctcattggaggatacgtaggagcaagagcctcgcttttgtcgaccacaccgccttttgttaccatgactcaagagctggtagcccgcggagacaccttacggttatccgcacctcgtcattcagtgaccccaagtgtgattgacgagcagagaccaatatggtcatctgcgccctttctggagatgtcatcattttccgatggagacttttcaagtctcacaagttccagaactacgtag

SEQ ID NO: 27867 - DNA, 171 bp, Glycine max
  Peptide Sequence Number=SeqID_119552
atgacgaaattgaagacgaccttgtctcctgaaactaaggcagttgcacctaagtggattgaagtaaagtggtttgctaatgacacaccgttggacatcgacatcatcaccacaattcgaaagaaatgggcaacattttttttaaagacagcaataagtaaaaacggctaa

SEQ ID NO: 27868 - DNA, 112 bp, Glycine max
  Peptide Sequence Number=SeqID_119553
tttaaggatcaagatcggtagaaagatcaagatcaggaagagcttctcttcgaaggaaagggctaaaggggtgcgatccctctcgttgagagtcaagggtctcctggagtag

SEQ ID NO: 27869 - DNA, 475 bp, Glycine max
  Peptide Sequence Number=SeqID_119554
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccatggtttgaagtgcttgatgggttactgggtccgtattggaaagcggtggggttagccttcaactgtactttcctcctctttggatctgtgattcagcttatagcatgtgcaagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 27870 - DNA, 285 bp, Glycine max
  Peptide Sequence Number=SeqID_119555
tgcttattgcttgccaaagatcctacttctacaattggtaggtcaccggggagcctggtctttactcttctgtgtggtattcattctcgtttggctcttggaatcacatccagcagtggttggaacagctcgcaaaatccaacgacttcacctacttcattgcccccaaccgtttctcgtacctctattgaaacagaatggtttcatgttctttcatcgattggttattcctctccgttcgtatctctttttccaattgcggtctcaatgagtttacaagattga

SEQ ID NO: 27871 - DNA, 567 bp, Glycine max
  Peptide Sequence Number=SeqID_119556
atgctcgaaagttttcaacaacaagatcaaatgtcagttctggaattgtacatagaaaaggatgtggctggtggttctatatttaattctgcaaattctcttacatcatgtggaaataatttatctaataatgagacacaactgccaagaaatgtgagcaatttacatggtgatgaagatgatgatgatgatgattatcttgtgtctaactcatacgtagaagaatctttagacgaagatgatagtattgacggtatatctgatacagacgatgaagttatcgacatgattcaaccagtaagaattattcacccagcagaaggtgtacaaggaattcaaaatccattttggaatgatgttttgcattataataatatcaactggagtcatcctgatgaggaggacatttgtggtttggagatgccatccagttttaatgttggcctagagttatatgttggcatggattttgatagtaaagatgcggtcaagaatgcagtcaaacaatatcttatgaaggtgcatcaaagtttcaaagtggttgaaagcaaatggaacaagtatgtc

SEQ ID NO: 27872 - DNA, 465 bp, Glycine max
  Peptide Sequence Number=SeqID_119557
gtatggcgcctaccaaggcaccctttagatccagataagtccaacagagccctgagatttccctcgctgatcacaggactctgccagtcgtttggagtccccgttgcacctaccaaggccgcaggcgcgccaccaccacctcatcaggctggccaggctgggtcatctgacatggagcagtatttacgacatttggttcgccagcaggcggccaaccactgggcacatgtacagacccatgattgtctgtaccagatgagcctcagcatgcagagccagggcttcgcttctttttcatgccctactccagaccagttcagggcagaggttgcatggcccagagattggcccgaggcccaagcaggagaggcgcccccagaagctcccgacggtggcgaggaggcccacgaggacgaggagatggccgatttgcttgacctcttgggagggagtggagctacatga

SEQ ID NO: 27873 - DNA, 363 bp, Glycine max
  Peptide Sequence Number=SeqID_119558
atgcagctcccggagacggtcacagctttgtctgtaagcggatgccgggagcagacaagcccgtcagggcgcgtcagcgggtgttggcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatccccttggccggggctgcggttgtttggtacactaatctggaagcttcccgcatccgtacttggaaggacctgattactgctttcctaaggaaatattag

SEQ ID NO: 27874 - DNA, 387 bp, Glycine max
  Peptide Sequence Number=SeqID_119559
atgtaccctccactagaactgatccacaagagatgtaccctctcttgttctcagtcaacaacccaagtagatgtaccctctacttgtaccacaaaggatgtaccctccaatgtgttaagacaaagatctcaggcggttaaacctttgaaactttgtgaatggggatacaaaagaattctcaggcgggagaagggagacacaaaagaattaaggcggttagtcctttcgttcttttggaaaagggaaagagagacacaaaaagaattcaggcggttagtccttggcgaattctttttggcaaagggagaagagatgaaaagaatgaatagcacaagttttcaaggtttagaaaaccagaaaactttggaaagctttttggcacaatga

SEQ ID NO: 27875 - DNA, 201 bp, Glycine max
  Peptide Sequence Number=SeqID_119560
atgagaaatcagaaagatcagcagttcatccaatcagaaaagtcagaaccatcatctatgttgcaagatggtgaatcaggaggggcagcaccttcatcagaagattcattgaagacgattatcagaggtggagctggtggaggagacaatatttcaaactcaggagaaggaggtggatccactactggaggttatggttaa

SEQ ID NO: 27876 - DNA, 403 bp, Glycine max
  Peptide Sequence Number=SeqID_119561
atggttggttgtgaccctaaagggaccttctcagttggggctaagctttcccgctctaggatcttttttggcttcctctcggactcgccatacgaggtcgccagtctccttgttgatgattccccaccttttatggggatcatggtgtctgtgccatatgtgcttgatccctatccttgtcaagaagtcttcgtaagtctgagctttgaattgagtgtcgttgtcggtgatgatagcatatgggaggtcgtacttggagataaggttgttaggagaagtgcatggaacgtctgcaaactcttgacatcttcggcatctcttggtaaagttgagggtgtctatcctaagtgttggctagtagtagcccgctcgcaccgctttagtggccaaggagcgtcctctg

SEQ ID NO: 27877 - DNA, 477 bp, Glycine max
  Peptide Sequence Number=SeqID_119562
atggctactccacctgcctcgcctcctcctcctccttctgtagtagcattagtgtctccgtctaccttgaagtggaaatgcaaagtcacacgactacgatccttggccactagactacctggggtagaaagaccagtggtccacgtcgatcctgcaattgggaaggccaacggtccccacaagaagaaattaagaacatatttggggattattgctcgtgataaggtcgacgtgacatacgagacttggaaggaagtccctgctgctcagaaggatttgatatgggaggatattcagaaaaaggcacaggccatccagaagcaaaacactgccctccacgtgttgtctcgtgggggttatgaatatttagaacagaagctgatggctgagaagacaaagaaaaaactggagaagctgcttagttcggaagcactgagggcgtcattgaccctccatctcccatcagacgacacgtga

SEQ ID NO: 27878 - DNA, 192 bp, Glycine max
  Peptide Sequence Number=SeqID_119563
atggcgactccactggggatcacactcctaatgcggtggctaatcaagagtagtcttgaattggttgatacgcgatactacactcaaacgaggctttcctatggacattgttggaccgggagtagtcccgcaatccgacaatatccggaagtggtcaatgactttgggaacttggtagaacccgtgatacag

SEQ ID NO: 27879 - DNA, 417 bp, Glycine max
  Peptide Sequence Number=SeqID_119564
atggtcaagaaaaaagaatttaatgaccaagaaatagaaaaagaagtagaaaaagaaaaagaaaataaaaaaattaaaaaagatgaaaaaaatgagaatgaaaagaagagtagaagtgaaaaagttgtgaatgaagttgcggaagtaccatatccagtggaaactggagataactatgcccttcggagaagaattacagtacatgccactctactccaaattcttgaaggatatgttaacatggaaacagaaataacaatgtcaaatcataaaagcactgagtcagcactgaagaaccttgaggtccaggtgggacacctggccaagcagatagctgacaagtcatccaatagttttgtggaaaaatacagagaagaatcccaaggaggaatgcaaagctgtgatgacaagaagtaa

SEQ ID NO: 27880 - DNA, 96 bp, Glycine max
  Peptide Sequence Number=SeqID_119565
tattttaacgatcctagaccattggagccagagagattaaaggcgcttcaaatccagtgggcacaatattatctccgagttagagcagagagctag

SEQ ID NO: 27881 - DNA, 117 bp, Glycine max
  Peptide Sequence Number=SeqID_119566
atgcttccaagacgtttccgtgagcaatttcgtgaagattatccactgttcttcatcgttcttcgtcgttcttcggtcttcaaccgaataaaatccaaccaatctttcacatcgtaa

SEQ ID NO: 27882 - DNA, 249 bp, Glycine max
  Peptide Sequence Number=SeqID_119567
atgcgtgttccacgaaaggaatacgcgcggagtcgccaccaacgtttatttgaggaaaacgtcggaaaaaccggaaaagacgcgatctacgaactttttagtgaaaaggttcgggagtcgtatttacgcacggggaagggtgtttccctttgctcctacgtgtcataccctaattttgtccggggacctttgcttgatgacatgcgaccattctttggtccttgtgaggtgcttggcacccatcattag

SEQ ID NO: 27883 - DNA, 258 bp, Glycine max
  Peptide Sequence Number=SeqID_119568
atggcggagcatggccatggaatgtattacacgccacaaacatttgctcagtatccgacacagatgcatcggtatccttttcagggtcatcacactgatacttctgcaagtgttgatttgcgtcacgaattatctgctgaggctgacgaagaagaagcggggaggcatcggggcagaagaaatcttgattgccaagcacgaagatgggatcgaccatgtggcaaatcgtcacggcatcacggacaccaaaatgaatga

SEQ ID NO: 27884 - DNA, 396 bp, Glycine max
  Peptide Sequence Number=SeqID_119569
atgaaagcagatcctgcccacctggttaccctggggagagtttatgagggatccactgttgttcatagcactcctttgttgcttggccaagtaaaggtgggtgcggaggaggttatagatgcagatgctccagttcctgtacccactaatgaggcagctgtgtctctggcaaagccacctcaaaagcccgatccggaggtcgatgatccgctttatctgatgacattgaccatcccagagcttttcatgaggccttatcaggttacatgggatgccaccatgttcggaatctttaatccagatttcccactctacataaagcacgaagacctctccgaaattgcacatggtggtcaatgtctcagcatatcagtgttacaattatggattctgtaa

SEQ ID NO: 27885 - DNA, 228 bp, Glycine max
  Peptide Sequence Number=SeqID_119570
atgagtgactcagacaaatgtaggttatacatagaagaaaatcctcctcgcctggttgccctaggaagagtttatgacggatccacaaccattcacaacatccctttgttgcattatcaagtgaaggtcggtgttgagaaggttaaagatacagatgctccctttcctgtacccactgatgagggaactgtgagacccacaaaacctgcaaataggtcggatcattag

SEQ ID NO: 27886 - DNA, 174 bp, Glycine max
  Peptide Sequence Number=SeqID_119571
atggcctttgtggataactgggcggtgagtaaggagaagacccacattgatcctttcactagcaaagaccaaatccgcaaagctttgaaggtgccacttgagctgccaggtctctccacctttgggcgtattcttttgaaggattcgtgccccctttttgcacatgttttgtag

SEQ ID NO: 27887 - DNA, 219 bp, Glycine max
  Peptide Sequence Number=SeqID_119572
atgctgcaggtcgactctagaggatcccgtgtaagagtggtcatgttggtgcgcatgacccgcactcgtctctttgcagcggtacgggtgaaatcttgccccggtatgcatagtagttgcgtgatagcctccctctctggttgtgctcgcacagttggtcacccttcaatatctgggggtggcccaggaactgataaaaggaaactactagccccataa

SEQ ID NO: 27888 - DNA, 345 bp, Glycine max
  Peptide Sequence Number=SeqID_119573
atggagagaagtatgataaatgctgccagtggtggagcccttggagacatgacccctgctgaagccagaaatttaattcagaagatggcttccaactcccatcaatttagtgccagaaatgatgctattgtcattagaggagtgcatgaagtagccacaaattcatcttcatcagccaagactaagaagcttgaaggtaatctttatgcattggttaacctggtatcctatctggccatgaatcaaaaatctgcacctgtcgccaaactctgtggtttatgctcctctgccgaccaccacacagacctttgcccttctatgcaacaatctgaagtaattgaatag

SEQ ID NO: 27889 - DNA, 740 bp, Glycine max
  Peptide Sequence Number=SeqID_119574
gagagcttctggttcgagatggcgatggccggcgtgcaggtcaactggtgctgatggcgctgaacctgctgccgattccgccgctggatgggggacgcatccttttcagcctgctgcccaaccgcctggcctggcaatactcgaaaatcgagccgtatgggctggtaatcgtggtggtgctgctggtgaccgacgtgctctggatattgatgcgtccggtattggctttgggaacgacgatcgttcagtggttcctctaggattttggccaatatccgttaaactcagcgggcagcatggtggccctcgtcaccccgatgcagcccgacggcagcctggactacgctgcctaccggtcgttgatcgattggcatatccaggaaggaaccgatgcgctggtggtggtgggcaccaccggggagtcgccacggtctccatggaagaacacgcggaactgatccgcgtggcggtcgagcatgcggcgggccgcattccggtcattgccggcgtgggcgccaactccaccgacgaagccatccacctcacgcgccacgccaaggcggtgggcgcgcaggccggcctgtcggtggtgccgtactacaacaagccgtccgcaggaaggcctgtaccgccacttccgcgccatcgccgaagccgtggacctgccgaccatcctgtacaacgtgccgggccgcaccgtggccgacatgagcaacgaaacggtgctgcgcttggcgcag

SEQ ID NO: 27890 - DNA, 474 bp, Glycine max
  misc_feature (407)..(407): n is a, c, g, or t
  Peptide Sequence Number=SeqID_119575
atggaagaaagcatgtctcctttccttgtgagggatttcggcgcacaaaatttcaaggctatacaaagaatccataaggcatgggaaaccccattaaggaaagatcaagaacttaggggcattcgtaatggcgccattggtggttaccatgaatggctgaaagttcatatacgaggtttggattggctcgccaagttaaaagtcgtcagcgaagagagttttgaagcaccggaagaggacgagtatgcccaagtatacgcggaaaaagaggctagaggaagggtgatcgactctttacaccaagaggcaaccatgtggatggatcggtttgctcttaccttgaacgggagtcgggaacttccccgattgttagccaatgccaaggcgatggcggacacctactccgnccccgaagaaattcatgggcttctcggctattgtcagcatatgatagactttaatggccccacataa

SEQ ID NO: 27891 - DNA, 131 bp, Glycine max
  Peptide Sequence Number=SeqID_119576
atgacagcggaatggagaaggaagaaagatgattggagacgccacttcaaggagaagatgagtcaagaagaagctcaccactatagtgtcgcaacctacccttcggcgggagggcgacgcgagactcacag

SEQ ID NO: 27892 - DNA, 180 bp, Glycine max
  Peptide Sequence Number=SeqID_119577
atgtattggtctccatctccattagaagctatagttgctgcattacttgtgatcaatttcagctttcacagggatatcaaaggggctaacattctagttgatcctaatggtgaaatcaagttgacagactttggaatggctaaacatgtcagaaattataagcattgcttggtctggtag

SEQ ID NO: 27893 - DNA, 408 bp, Glycine max
  Peptide Sequence Number=SeqID_119578
atgggtgaaggagaggaggtgaaagagcagatgaaggccgacatggaggccatgaaaagagcaaatggccacaatgatggaggccatgatgagcatgaaaaagataatggaatccatgcggttatagttgccgctaccagcactgttgctaaggtgaacccaatgcccccatctggccttaaccaaatgaatcatccaacctcagatatggtaggcaaagatttgggaagtatgggcgacccccattatgcgcaaattcaaaacgagcacgccttcccgccatatggcttgcctcccaactatacaccacccaatgtggcgtgcactcctagtgagaatgtcaataactccactgccatacccattgagagccaacaaccccaaactgatcatgcacatgtctcttaa

SEQ ID NO: 27894 - DNA, 414 bp, Glycine max
  Peptide Sequence Number=SeqID_119579
atgtatgttgttgatgatattgatggatattattccagacaagttttcgccttagcctgcagaatatcaaaatttggatctaaattgtatgtcaacgctgatattacagagatacacgaatttcgtcaaagtttgtctgtgccattttattctggtgggatgatcaatgataaagatggttctcagtcccaatctagccagagtaatgtggtggaaaaatttctacagaatgctcaagtggtcagtataggtgaaatcaacaatctcagacaggattgttactgcttaactgttggaacagttgacgaaatcattattgatgctccatggagttatgacagttgtcctaactgtacaacgacatttgatccattaaaaggtggctcagcttgccgttcttgccataccagtgtg

SEQ ID NO: 27895 - DNA, 252 bp, Glycine max
  Peptide Sequence Number=SeqID_119580
atggccttcatcatgtcctcattcatacatttcattctaaaattcagagattggtgcaaagactattactcaatgctagtcgttcactcacagtttaagatcgcactctcaccggttaagcaaaatcatcaggaatttaaaatccctgagacagatcctgtgtatcctgagtctgagcatcctcctcatctatcagatggaaaacaggggaatcagagagagcaacagcttctccagatgctgactctgtag

SEQ ID NO: 27896 - DNA, 139 bp, Glycine max
  Peptide Sequence Number=SeqID_119581
atggagatactggtggatggcgaatttgatgctaacagattgtttgatgaagctgttttcttgacctggacttggcttagacattttgagaaacatttctcaacccatctaaaccaatgggcaagcaatattagtcaag

SEQ ID NO: 27897 - DNA, 361 bp, Glycine max
  Peptide Sequence Number=SeqID_119582
atggttatccagcttacgaacgctttctacggtgtcggcgaactgcaggctatcgaaataggggaagctactgccgttgacgctgtgccacgggtcgtcgcggttaaagatgcgcccgaaggtgaagatgacatcatcagcgttaaaagcgcgggtcggtttaaaccagtcggtagtctggaactggaccttatcgcgcaggtggaagcggtaggtggcgccgttatcaagcacttcccagctttccgccagctcaggcaccagacgataggtataagggtcgacgtcgagcaggcgatcgtagatctgggcggcgagggtgtcgacaatcaggccgctgctgactttttgcgggttaaag

SEQ ID NO: 27898 - DNA, 177 bp, Glycine max
  Peptide Sequence Number=SeqID_119583
atggctgaagatcaacctaggagagttacccttgaaaactactttggttctactgtgccgcaattcttcactagtatagcatggccagagaaatatttccctgagtccaagatagcagaaggaaaggcaaccatctcttccttccaccagtttctggatgagtctgggatcctctag

SEQ ID NO: 27899 - DNA, 465 bp, Glycine max
  Peptide Sequence Number=SeqID_119584
atgacagatcttgtgagcgcggaagatgacgtaaatctcgcgtgtcaacaggcttgtcgaccgcgattgacgaagggcgcagaagacgacgttagtctctgcgtgctatcagacttttcgtcttacagacgagcaaaaaagaatgtttttaccgataaccactcgggtatttccgcccgtcagcgtgactcaaatgtcagtatggcagatcttgttagcgcggaagatgacagagcaaaaaagaaagcttatacggataaccactcgggtatttccgcccgtcagcgtgactcaaatgtgagtatgacagatcttgtgagcgcgaaagatgacgtaaatctccgcgtgtcaacgggcttgtcggccacgattgacgaagggcgcaaaagacgacgttggtctctgcgtgctatcaggcttttcgttcttacagacagcaaaaaaagaatgttttatacggaataa

SEQ ID NO: 27900 - DNA, 825 bp, Glycine max
  Peptide Sequence Number=SeqID_119585
atggaaaagacatataacccgcaagatatcgagcagccgctctacgagcactgggaacagcagggctacttcaaaccgaatggcgataccagccaggaaagcttttgcatcatgatcccgccgccgaacgtcaccggtagcttgcatatgggtcacgccttccagcaaaccatcatggataccatgatccgctaccagcgcatgcagggtaaaaacaccctgtggcaggcaggtacggaccacgccggtatcgccacgcagatggtggttgagcgcaagatcgccgctgaagagggcaaaacgcgtcaggattacggtcgtgacgcctttatcgaaaaaatctggcagtggaaggctgaatccggcggcaccatcacccgccagatgcgtcgcctcggcaactcggttgactgggagcgcgagcgcttcaccatggatgaaggcctgtccaacgcggtgaaagaagtcttcgtccgtctgtacaaagaaaacctgatttaccgtggcaagcgcctggtgaactgggacccgaaactgcgcacggcgatctctgacctcgaagtggaaaaccgcgagagcaaaggctcaatgtggcacattcgctatccgctggcggacggcgtgaaaactgccgaaggcaaagattacctggtggtggccaccacccgtccggaaaccctgctgggcgataccggcgtggcggtcaacccggaagatccacgttataaagatctgatcggcaaagaggtgatcctgccgctggtgaaccgtcgtattccgatcgtcggcgacgaacacgccgatatggagaaaggcaccggctgc

SEQ ID NO: 27901 - DNA, 294 bp, Glycine max
  Peptide Sequence Number=SeqID_119586
atgatgaccaccgccacgccacttaacctgcaggtgcgcccgattatcgccgccgataatccgcggattgcgcaggtgatccgcgatgtctccgccgagttcggcctgacggcggataaaggttataccgtgtccgacccgcagctcgatcggctgtttgagctgtacagtgcggcggacagcgcctactggattgtggagcatgaagaagatgtatttcctgccgtcggtgcgcggactggggttagcgcgcgaactggcgctgcgcgcaatggattttgcccgccagcgcgg

SEQ ID NO: 27902 - DNA, 432 bp, Glycine max
  Peptide Sequence Number=SeqID_119587
cctttggagcttgtccgtaagctccctttcatagtaggagggattgtgcctcttcctaagggcactcttaagatcattccaatactctactggaggatccccatgaatatttcattccctaacaagggaagtccaccaatagagggcatacccttggaagctaagggtagccaatggaacttttctctcttcgctaatatggtggcaagcaaagagttgctcagcgcacgacttgcgctaagctcaaatccacttactcccgctaagcgtgagggtggcgctaagcgcaacgtcgtgaattcaaagcctgatgcaatcatccctaggaaggtaccggtcactagagccatgactaagaggctccaagatgattgggctagagctgctaatggaagcttgcttgtggggcttctatggaggctggatctttga

SEQ ID NO: 27903 - DNA, 1004 bp, Glycine max
  Peptide Sequence Number=SeqID_119588
caggacgcgcagttgaggcgctggtcgtagtcgtcgttctcagtcacgagcacggtcgcaccgccgtccgcgagctcgtaggggaccgacgccgaccgcaagtgctcgaccaccgcgttggcgtcgttggcgctcatgccggagaacagcggcgtgtacgtgggccgggtgagccagctcgacagcgcaacgatcccgagcgcgagcacggcgacaccgatgatcgcgatcgtgcgctgcgcgaggctgaaccccgcgatggtgcgcccgatccgctggaagacggaggtgacggcctggggcatcaggcttgcatccgcatgatctcgttgaacgcgtcgacgcccttgttgcgcacggcggcgacgagttcgagggtgaccgccgcgcgcgaggacgcgatcatggcggagtggatgtcgtcgaggtcaccggtgaccgcggcgaccttgagggcgtcggactgggactgcagggagcgcaactcgtcgatggcccccgtgacgctgttcgcgaaggcggtgtcgtcggcggtcctcgcgggcgccgtcggcggtgcgagggtgaaccccgaggagatgccctcgatgccggcgagcgcgtccatcagttgcgtccgatctgcagcgcggattccggacatatccgtcggcgtcggcgagcgggtgatcgggctggtgcaccaggcggccttcggcgctgccctgcacggtgccggccacgtagacgccgggggactggtcgccgggctggacggcgatgtacctggcccggaaggcgtccccgtcggtcgcggtcgccgtgttgatgttggcgatgttgtcgctgatggcgtcgagccacttgcggtgcacggtcagtccggtgctggcgatgccgatcgcgtcgaacgtcatgaggtcctcatcgcggtgcgcatcgacgagaacggacccgttcacggcctgggtcgcgaactggtagcgcagcatcgtgtcgatgctggagagggtctcggtgtccag

SEQ ID NO: 27904 - DNA, 345 bp, Glycine max
  Peptide Sequence Number=SeqID_119589
atgacgttgttactttgcaacattctgcccagcgaccgtaatgccgatctccccctgcggaagtatcagttgggatcgcgcccacaagacacccagtggacccggaaaaagtccaacagggccctggggtttccagctctggttatgggcctttgtcggccctacagggcgcccatttcccccagccagttcatgtcgtcgtggcatagggattgtgcccgcaagacacctagtggacccgaagaaggccaacagggtcttggagttgccagctctaaatacgggtctctgtcagttctagggagtgcctgtcgcccccaacaaggtcatcaggccccctactaa

SEQ ID NO: 27905 - DNA, 186 bp, Glycine max
  Peptide Sequence Number=SeqID_119590
atgggtgaagtagaggaggtacaagagaagatgaaggccgacatggaggccatgaaagagcaaatggccacgatgatggaggccatgatgatcatgaagaagataatggaagccaatgcggttgcagttgccgctaccagcacgttgctaaggaaaagatttgggaagtacgggcggtccccatga

SEQ ID NO: 27906 - DNA, 535 bp, Glycine max
  Peptide Sequence Number=SeqID_119591
atggccgccccgacgactggtgtccaactctttagcctagggtggatcgctgactggatcgacaagtcgatcaccacgatgcttaccgatgtcgtcacgccgctggtggcatcggtcaccgagaagataatgccggtcgtcgggttgggattgtcgatcgcgctgatctggtacggatggctcatcatgaacggcaccatccagacgccgattctgcaagccacccgaaagctcgtgagcattgctgtcatagtaggaatcgctggcgctggtgggctgtatcagaggcagatcgccggcgtcatgctcgaccttcccactgatgtggccaagatcttcactggaaccatcaagacaccagcacagatcatggacgatgcggcaaacaacggcaccgagatcagcacccggctacaggagcgcgcgcctaccgaaagggcttctggacacgacgaatgccgaccagataaacgtgtttggcatgctgaccgcactgatattcttcatgatgtgcgcacagcaaatgctcgcacag

SEQ ID NO: 27907 - DNA, 328 bp, Glycine max
  Peptide Sequence Number=SeqID_119592
ggatcgcgcctgcaagacacccagtggacccgaaagaattccaacagagtcttggagttgtcaagctctaattacgggtctctgtcagttctacggagtgcttgtcacctccggcaagggcatcaggccccctactaatcgagctttcatcaagaagtactacgcccccaggcaggcgcaaggcgaaacaccacagcagcctggggatggccagcagtgggcaacagacgcaccgccatcacctctagagttcacctcagctcatccacaaaaagccatcaagcgtccagctcaagacgttaaagaagcgctactaggaggcaaccta

SEQ ID NO: 27908 - DNA, 222 bp, Glycine max
  Peptide Sequence Number=SeqID_119593
atggaggccatgaaagagaaaatggccacaatgattgaagccatgatgagtatgaaaaaaatgatagaggtcaacacgaatacagtcattactacatgtaccaccactgaggtggacccgattcactcgtctggcatcaatcaagcaagtcgtctagcctcacatacggtaggtaagggaggcgaagcgttaggaagtatgggcggcccccatgttgtgtaa

SEQ ID NO: 27909 - DNA, 435 bp, Glycine max
  Peptide Sequence Number=SeqID_119594
atggcagataatacacgtcttaaggagctttctgtgaacatgtccaagatgctcgagatgttagaagccgataggcaagagaacaaagcacgattcgaaactctagagactgcgatggacacattgctgaaatcgaacaacgttggtgtgaatctgcacatgaacgtagcgggaaacaactccattggaggttcgtcgtctcctccaccgtttcaggtacgcaatgtgaaacttgacttccctcgtttcgacggatctgaagttgttcagtggattttcaaggctgagcaattttttgactactacaacactccggatactcaacgtcttaccattgctgcaattcacatggaaaaagaggatctgttcatgattattacactcagttcactgctcttgcaaaccgcgtacaaggtgttactagtgaagctttga

SEQ ID NO: 27910 - DNA, 262 bp, Glycine max
  Peptide Sequence Number=SeqID_119595
tgctttaaaaggtcttgatgatgctccacagcctaaatcaaaggctgctactaggtggattgttgtcaagtgtaatagacaaaaaggaagcattgagtgtggctattatgtcatgcacttgatgtccatcatcatattaggaagtttcaggaataactgggaagcatattttaacgatcctagaccattggatccagagagattaaaggcacttcagatccagtgggcacagtattatctccgagttagagctcagagctag

SEQ ID NO: 27911 - DNA, 489 bp, Glycine max
  Peptide Sequence Number=SeqID_119596
atgggtgatcaagaggagacacaggaacagatgaaagccgacatgtcggctttgaaagaacagatggcttccatgatggaggccatgttaggaatgaggcagctcatggagaaaaacgtggccaccgctgccgctgtcagttcggctgccaaagcagacccaactctcttggcaaccgcgcgccatcctccctcaaacatagtaggatggggaaggaacacgctggggcatgatggcaaccctcatctgggatacaaccgagcggcttacccttatggattgccgcccaactactcacctcctgtcctgcaagacgatgcgggccatattgcttctcctgtccttgaaagagagcctccccaacagcccgacgaggtccacgaagaccctcaagactatgctcgaagggatgtcgagttctatcccccgatcctcaaaagaccggcacccagcacattgcctcagcccaacgtcacgacacaaccaata

SEQ ID NO: 27912 - DNA, 315 bp, Glycine max
  Peptide Sequence Number=SeqID_119597
atggagaagagcaaagtcgatacattgatagcaatttctccaaacacatggcatgcatcaaagtttattcatatttctccccaagataaaggaatatgtgatttatggagacaacaaacaaaggccacatttctccccaagaaaagtgaatatgcgatttatggagacaacaaacaaaggccacttgatcaacaaccccaacaattggaagttggaagtagttattggaagttgaaagttaccaatggaagttggaagttggaagtggaagttactggaagtcggaagttggaaatgaaagttatcggaagttga

SEQ ID NO: 27913 - DNA, 1003 bp, Glycine max
  Peptide Sequence Number=SeqID_119598
atggattgggaccagctcttggtcgggataggaggtagaacaatcagttggttcccccgatggaaggaaggaaaagaaggagtccttttctcatgtgggagatacccaaacattccgctggtaggaacgaggggttgtattaattacaatcccacgctcgctataagacaactagggtaccccatgaggggagcaccgacggaagaaagcatgtctcctttccttgtgagggatctcggcgcacaaaattccaagactatacaaagaatccataaggcatgggaaaccccgttaaggaaagatcaagagcttagaggcgttcgtaatggcatcattggtgggtaccacgaatggctgaaagttcgcatacgaggtttagattggctcgccaagttaaaagtcgtcagcgaagagaattttgaagcaccggaagaggacgaagaagtccaagctctcaaaagcgagttaggaaaggcaaaactcgccaaggagaagttcaaaaatgcaattaccgcaagagcccttgaacaagagaccaagagggctcgcaaggaagagtatggccggaacaaatttcgcggagctctatggggtagcaatagtgaactcaagttgcgaagggaagaaagggaccagtcgcgagcacatggcatggttttgaaagaggagttagtggcctgttcaaggtccaaaagaagcttgtctcagcgtttatgcgagacggagaccaacatgctagctatcatcgccaagtaccaagaagagttaggtctagccgcggcccacgagcataggattgcggacgaatatgcccaggtatacgcggaaaaagaggctagaggaagggtgatcgactctttacaccaagaggcaaccatgtggatggatcggtttgctcttaccttgaacgggagtcaagaacttccccgattgttagccaaggccaaggcgatagcagacacctactccgcccccgaagagattcatgggcttctcggctatt

SEQ ID NO: 27914 - DNA, 654 bp, Glycine max
  Peptide Sequence Number=SeqID_119599
atgggggtgcaaatagcacccaggcccatttgggccctccagaatattcctccagaaggggccgaggcgcttccgaaacgtttccgtaacgttttccgtgaggaatctcgcaaaggtttcaaccgttcttcgacgttcttcattcgttcttcatcgttcttcgatcttcaacggagattagaagcaaaagcagcggctgccgcacgtgtgcaagccaagttagaagccgaaaaaggtcaaggaaagggtaaagcttcactggcaatccaaagtgggaatggacttctcttgaaaggtggcaaagaagctaggcggtcaaatgcaattttgcacaaagtaattactcaggccataccagatactgttggtggaaaacttataggacttgtgacctcaagggaagaaatccctaagctacttaagctggatgatgtaatcgatctggtgattccaagaggcagcaacaaacttgtttctcagatcaagagttccactaaaattcccgttttaggtcatgctggtaagactattatgcttaatggcacttgtactttggactgtgtgattttggtccctcaaaagcggttagagtccctaacagaagcagagaaacaagcactgcttgaagaagttgaggaagagaacaatcactag

SEQ ID NO: 27915 - DNA, 1037 bp, Glycine max
  Peptide Sequence Number=SeqID_119600
gagatcctcatggactgccaccttcaagaagcatagaacatcaagttgatctccttccagaagcttcattgcctaacaggccaacttacaaaagcaatccccaagaaactcaacataaggatgcacatgccaaagttgagtatgtgaaaagattgtatgaccaagtgaatgtgcaaattgcaaagaagaatgaaagctataccaagcaagccaacaagaaaaggaaggaagtggtacttgaacccggtgatgatcctagacatttgagggcaaatgttttccaagaagtagggaatgatgagaatcttgaaactggccaaatacaggctaaaggcccaagtggagaaggacgaaggcccaattccttgttgaaccactctcagacttatcaaggtagtccttgtggcgtctaccctgacttatcttccttcaccggaagtggcgtcatccaaacctccgtagcctgtatcaaacgatccgctcctactcagcgagtcatctcgctaagcgcacaacatcgtctcgctaagtgcaaccatgcgctaagcgcaattccttctctgtctagacctttatgtgaattgggcccagcagagtatgacaagttccaaagggagcttgagaggaggtgcttgcgcaaggccttgaccaggcagatggacggtcatattgatgtggccctggtcaaggagttatatgctaacttatatgatccggaggataaatctccgaggcaggtcaaagtgcaggggaagctaattaagtttgatgccgagtccctcaatgcattcctggagaccccagtgatcttggagcctggggagcactacattacttataccaggttctatgggtgcgccttggaagcttctaaggaaggacctcactactctcgcccagatttggagtgtgttgatgcaatcctccctaggaagggaccagtcactatagccatgagtaagaggctccaagaggattgggctagagctactgaagaaggccctagggttcttatgaacctcaggatagatttctga

SEQ ID NO: 27916 - DNA, 457 bp, Glycine max
  Peptide Sequence Number=SeqID_119601
atggctgagaagataaagaaaagactggaagaagctgcccaatctggaagcactaagggcatcattgactctctatctcccatcagacgccacgtgaaatggaagatggcccgcacgaagaaaactggactgatgatgtccgaggcagcaaaggaaatagctgacaggattgattctttggacgagcaggtgtcacagggatcgttcatcccccatggacgtcaggatatcctgactgctgccattgggcgaccagagcaccctgaccatgttcgtgttgttggagccggtgtcaccataaaacctagaacagctgacccaacaaatcagagaccaactggaggagtcagccacagaaaaagtgactcgaaagatgatggtatccttcagccagatgcagtcccagttttagtctcagatgcaatcacagggacttgcactacctccagagccagag

SEQ ID NO: 27917 - DNA, 609 bp, Glycine max
  Peptide Sequence Number=SeqID_119602
atggggatgatccataatctctaccttcttctatctcaagggaatttgtgccttgtaatacaacttgaatccttcttcttggcagcatcccatactagtaaaagagggcaaaccctattagcaaccatcctaatgtcagctgccatggatttatgtagacgaagagggtgtaacaaagaagaaggtggacgtgattgtgggattggtgctgacttacgtagaggcatgaagggagtgtcatcagtggactcgccatctaatgaggaagaggttggatcttccttgtttcctatgaaggaaactgaccattctttgtcaccaatctatgggttagccttggtagcccttgtcttaacctatcatggaatggccaagggaggaacggacgctcacggttcatcaggagcaacaacattccgcttttggagggccactcatactagtccttcaccatcatcattagtctcacttatgcctttcaacctttgtgcaactgggtttattgcgggtggactagcaggagcgaacatggcagactcatgccttcttttggtctggtgctcctataccaacaactattcttcttcttcatcctttaccaacaactga

SEQ ID NO: 27918 - DNA, 333 bp, Glycine max
  Peptide Sequence Number=SeqID_119603
atggtgttccaaaattgtaagcaactcagcacaaatcctatgtccgaagggtatccacaaaaggcgattcttacattagtcataaatagcttaatatggaagagctttttgctgttagagctactatcatgggatctaaagcttgttcttgtacaaatagaggattacaaggacttgggtgagtatattaatgacaagggaggccaagtggcgaaagggagtgtgcgtcgcgaaagggagggtgaggcgtcaaatggagagaaagtcgcaagagggaaggcaggggccgagaaggatgggtacgccgcgaaagggagggaagggcaaatgtga

SEQ ID NO: 27919 - DNA, 387 bp, Glycine max
  Peptide Sequence Number=SeqID_119604
atgcgagcggggaattccaatgtgtatggattcctcgagccacagtccattcagagatctgggcaatcacaatttgaatcagaaagttacatgaagagttcaaaacgcgatgtctaccttggagcctacctgaatggtgctttgaaaggacttgatgatactccacaacttaaatccaaggctggtgctaggtggattgttgttaagaccattggaagcagagagattgaaggcgcttcgcatccagtgggcacaatattatctcaaagtgaagccagagaagatccccgagcgggaaagcttggccccaactacgaaagtccattcagggtcacaaccagccttgacaacagagcatacaaattacaagaactggatgacaaataa

SEQ ID NO: 27920 - DNA, 282 bp, Glycine max
  Peptide Sequence Number=SeqID_119605
atggcgagtgacatgtacgcacaagcacactactacgactccagtgcatgccacctgtcataccctaatttcgtccggggacctttgcttgatgacatgcgaccattctttggtccttgtgagcacccaggcccatttgggccctccagaagattcctccagaaggcggttgcttctggaggaagcaaccctgctcgcctgggcgagctgggcggcaaccacctcccctattttgctataaataggggaggaaatgaagaaggaaggggtccagccccttag

SEQ ID NO: 27921 - DNA, 678 bp, Glycine max
  Peptide Sequence Number=SeqID_119606
atggatgaagatgtgctaagacaacgcgaagagatctatggaggtccagaggcaaggaaacaaatgaggatatgttcaaatgcatccctaccttcacaccagactatatcatggtgtgacaaacttgcaacggagtctagaaagaattgggactcatactcttcatccaaagatgcaacaattggagctgaaaaagctcaatctcaccaaactctggaaggcagggaatcaatgatcaaggagttccctccaagacagactattgcactcaaccctaacagcctaatcttttatcaatggcctacagacataaagatgtatccttcaggtgcaagcgagattcagttggaaacaccagaagaaagtctgaactttcaagactgggaactatcaagctatgaccttgagctaagaatgaagttatctgcctacaaagaggagatcagatcagggcaagcagaggagatccagttggaaacacctcaagaaagtctaaactttcaagactgggagctatcaaactatgaccatgagctaagaatgaagttatatgcctacaaaaaggagattagatcaaggaaagccaattgctacaaaggcaaggagttgttgattgaatatgatgaagacactccaataattagatttgttaaagctccacctggtcatcttttttaa

SEQ ID NO: 27922 - DNA, 306 bp, Glycine max
  Peptide Sequence Number=SeqID_119607
atgacttttctactagatggtgattttattctcaccattcttctggtcacattaactgatgcaatcctccctaggaaaggaccagttactagagccatgagcaagaggctccaagaggattgggctagagttgataaagaaggccttagggttctcatgaaccttaggctaagctctagcttctcaaggaagcttctcaaggagcttctcaaggaagttttctcaaagaaacttctcaaggaagttttcttaagaaagcttctcaaggaagttttcttaagaaagcttctcaaggaagctacctag

SEQ ID NO: 27923 - DNA, 612 bp, Glycine max
  Peptide Sequence Number=SeqID_119608
atggtggtatcttattccagggataaaatccaagatagtaaacaaactctcaaagagcttgaaactacgcacaacaactatatgaaaagacaagaggagttagataatgatatgcggaagtgcaaggaagagttcaaagagtttgagaggcaggatgtgaagtatcgagaggattttaagcacgtgaatcagaagatcaaaaagcttgaggataaagtagaaaaggaagagggaagtcatagtttatggcaactgaaagtaaaagattcatcaaaaattgaagcccttataaaagagggtgaggaatcaactgttctgataccaaaacttaaggacaatatcccaaaattgcaaaagttgttgcttgatgaggagaaggtcttagaagaaatcacagagagttccaaaggtggtcactgtttagttgaggtgggcaaggggaatgctgaaatagctctttctttggttggttatgaagaagaattgcagagtgcaatggaatatgtatttggttcaacctttgtctgcaaagctattgatgctgcaaaggaggtggcatttaatcgggagattcacacaacaagtgtcactcttgaaggagatatattttag

SEQ ID NO: 27924 - DNA, 705 bp, Glycine max
  Peptide Sequence Number=SeqID_119609
atggaagcttgcttgtggggcttctatggaggctggatctttgagcttcaatgggatcctttaatggtgattttccaccatggagatgcagcagaagacaaaggaaaagaggagcttcaccaccaagatgagccttggataagaagcttggtaggatgcttcaatggaggaaaagaaagagggagagaaaaagagagggggcagcacgaaattgaaggaataaaagagggagagaagtggaactttgaagcatcttctggtgacctccgaaggttgccacaagctccgttgtcacctccttcactttgtcgtgacctccgaattatgccgcaagctccgttgccattcgtcattgtcattgtctatcttactcagtctcaacagccaactgcctctggccgttgtgcagatacaccatctgtgatcaagtatgcaaaaagcaataagaagccaatagccaccatcaaatttcaacaaaaatttgttggagttaagctggcaccagctgttaactttaactcatcaagaggtccttcaacaagttatcattgggtcttgaagcctcacataatggcacctggctctaatgttcttgttgcttatgttcctacagaaccgacaactagaattggcaccaatgtgatgttatctagtggctacaagttgctgtctggaaccccaacaaagcacttgatccaagtttga

SEQ ID NO: 27925 - DNA, 606 bp, Glycine max
  Peptide Sequence Number=SeqID_119610
atggaaccaaggaagaacgaagtaattgtgattctaggaatcaacaacgaaaaggatgccaaaaacgtgttcctagaagattccttcatccatggaggatgggtgagcttccaaagtttagaagaagaggggtttactatcaaaggtttctttgattgcattcgatggatgagttttctacaaaattttagtgtttggtactatggtccctacgctttattctgggggacttcttgtcagaacaaagtcagtattagtggcactgtcaaaggaaaagggtgcaaagtctatgttagtgacagggatagattttgcacatataagatgatggtgggtaagaaagtggatctgcttgaagtcatcttctattactggatgcaaaccttcaaaggcagattcaacccaaaagtgaagaagaaccatgtcccttatgcatacaagaaggccaagttggatgaaactttggaaagaaaggaagctcaagagttggaagaaagttttctttcatctatgaaagctctgtcaactgaagagaataagaagaaattggctaaatatgccagacttgctaccttggtaggcaagatatctgaaaaaattccataa

SEQ ID NO: 27926 - DNA, 150 bp, Glycine max
  Peptide Sequence Number=SeqID_119611
atgtggctattcaatcaaacccagataccgtggtgccggggaacttgtgcggttgattttgctctgagcatgttccccatcacgtgttgggttttgttggagatcgacacgtacatattgatcattttaatgtttgatcttttcatctga

SEQ ID NO: 27927 - DNA, 963 bp, Glycine max
  Peptide Sequence Number=SeqID_119612
atgggctcagaaatctaccctgaggttcatgagagccctgaggccttcttcagcagctctagcccaatcctcttggagcctcctgctcatggctctagtgactggtcccttcctagggaggattgcatcaggaagaatgccatttttgatggactcattagaactagtgattttgataaagcccattgtgttttgcaagtcttgtcgaaaagtggttatgttcctacaaataaacaatatatcactttaatcaatggcatgtgtagagttagaaacataaaaggagcattgaaatttcaagatgaaatgaaaacacttggcatcaactcccacaatgttgttgtgagtcttattgttagagggcttgcaaattcaaagaagattgacaatgctatttgggttcttgatttgatgcttgagatgcaaattattccaattgttgatactttcactactttaatgcacgtttattacaaagaagcttatgtcacaaaagctttagaattgaagagcataatggaagattgtcatgtgaagcttgataagattgatagtttgtatcccaattggaaagttgtacttgaagctttgaagaatctgatttgggatgacattgtgggaacatttgatattcctgaagtgtccaatgccaagaagaagaaaaacatgatggaggataaaaggaagaaaaaacaggaggaatcaatcgaatctgggggttcaacaattgttgaccctctatctcccattgaaagacatgtcaagtggaagatgacccgcaccaaacactttgggaatatgacatctgtggaggcacaacaaatatctgataggattgcaaatcaaatgacacaaggaagctttgtaccccatggttgccaggatatactagctactgccattgggcaacctgagcactcaggtcgtgtttgtgctgtgggacttggtgtcaccattagctaa

SEQ ID NO: 27928 - DNA, 213 bp, Glycine max
  Peptide Sequence Number=SeqID_119613
atggcctttccttactcaaaacataaccgagtccataactacttggaagtcgaccgtgaaaggttgtctacttcaaggatcattagttgttgtcgaggatttggaacggttgagtaccgaaatgcgaattttaaagttgaaaagttgaagctggagcaggatagggtcgagtttgataaagataagaaactttttgctgatgaagaagcttag

SEQ ID NO: 27929 - DNA, 330 bp, Glycine max
  Peptide Sequence Number=SeqID_119614
atggcgccaagcaaacctggaataatgagattgcttgaggataaggcgaggagggacgtggctgaggttgttgctgccaaagtcgttgctgctgcagcaaatgacactactggtgggtcggttacaccgactaataatttggtggagaaggaaaatgatgacagtcagcgaagaaatgtcctcagacatgatgttcgcaaaaatgatctcatcaatttgggtgaatctcaagaccatcctggttcgaccaagtctgatcttcagtctccagtggatgcgaatgttggcgataactgggattttcaagatttccagtggatgcgaatgtag

SEQ ID NO: 27930 - DNA, 273 bp, Glycine max
  Peptide Sequence Number=SeqID_119615
atgggggtgcaaatagcacccaggcccacttgggccctccagaagattcctccagaaggctgttgcttctggaggaagcaacctggctcgcctgggcgagctgagctcgcctgggcgagctgggcggcaagcatctcccctattttaaaatctaagccgaggcgcttccgaaacgtttccgtaacgttttccgtgaagaatttcgcaaaggtttcaaccgttcttcgacgttcttcattcgttcttcatcgttcttcaatcttcaacgggtaa

SEQ ID NO: 27931 - DNA, 399 bp, Glycine max
  Peptide Sequence Number=SeqID_119616
atgcaagtgatgaaatctgccactcaagtggaagcaacaccgccaccaccgtcgtcaatttctctagggcttaacaagatgagatcctatgagatggtgcaccacctagtgtcgtgcaacgccgttgtggtgttcagcatgagcgactgctgcacgtccaccgtcgccaagcgcctcctcttcagcctcggcgtcggcccaaccgtggtggagcttgacgagcaggccgatggccccggcatccggtccgttctctaccagctcgccgggtcccaccagcctgtccccgccgtcttcatcggcggcaagtttctcggtggggtgcaaaccctcatggccagccacattaacggcaccctggttcctctcctcaaagaagctggggcactctggctttga

SEQ ID NO: 27932 - DNA, 336 bp, Glycine max
  Peptide Sequence Number=SeqID_119617
atggaccgggaagagttggaagtggaaacatatgatgataccgatagtggtcgtgaaacactatgcgtatttaccttccctttgttcccagccacagatccaaggcccttccttgaagatgcagacactgcagacttgctagttttctcattggtatgcttcaagcttttgtcccctgatgatgaagtttcctttctgctgcttgaattagaagtgatgcaatcctaccccgcaagggcattggatagaaaacaacaagtagattgggctagagatgcaagagaaggccctagggttcttatgagccttagggtagatttcgggcccatgggctaa

SEQ ID NO: 27933 - DNA, 324 bp, Glycine max
  Peptide Sequence Number=SeqID_119618
atggagaaagggcttctatatctacatgaagactctaggctaagggtgattcacagagacctgaaagctagtaacattctattagatcatcaaatgaatccaagtgtagcacttgtttttgccacactcatctcaatggcttttgtagacagctttgttgaattgcggtgttcaacaccagttaccgcacaaagcaaaggatcactcagtgttttgatcaagaatacaaaaggataccaaggaaggggacaaaaaggtctttttcttgatttttctagatcccagctgtcgcaacctacccttcggcgggagggcgacgcgtga

SEQ ID NO: 27934 - DNA, 543 bp, Glycine max
  Peptide Sequence Number=SeqID_119619
atgtatagtaaggccttgtcttcaaaggccaaggggaaggaaaaagaggaaaaggattcctccaagaagattgttaagaaggaaaatcattttgcaacaaaatgtgatatcaaaagagcactccttcttaaacaatctttctaccatcctctatcaagggaaacatcccttagccctgccatacctcttgagcttgaggttattccgcaagtaaaggagttattggatgagggtttggttcgtattatgaggcaccgaatccctatgataggtggtatggtgaatgtgttgaatggtgcaaccctcttttgtaaaatcacttatgcatccaacatcttcatgattcacttacatagggactcattaggtagtgatcaaagggttcccacgaaccctaagagaataaaggtcattcctgagtggcctactccaccaagtgttgagggaagaagcccagagtttcaagaacctctggatttgaggtcaaattcttttcaagggggagggaatgatgcaatcctaacccctaaggacattggatag

SEQ ID NO: 27935 - DNA, 1269 bp, Glycine max
  Peptide Sequence Number=SeqID_119620
atgttgcactaccaggcatttcagctactttctaagtgtggcgtggatgttgagtgcgtcactggtcgctggtggacactaccgtacaagcatcatgcagttgctgatgaggcaaccaaggatgagcatcatgcagtgcctgccataagctcttacctcttagtgaagttatggtgtgactgccctttctggcctgatgatggcatgtgtcggttgcgggactgtagtgtgtgtgaatgccctgaaaatgaattccccgaatcatttaagaagcctgaccgtcgcctttcaatgactgatcttgtttgtcaagaaggaaaacctcaggcagccgttgaccgtactttagacagtaaagctttcagaggatggacagaaatagacaatccatggacaaatgatgatgagactgacaatgatgagatgacatacgtgaatcttcaactgaatccggaaagatatactggttacactggtccatctgcaagaaggatatgggatgctgtctactctgagaactgccccaaatatccgtctcaggagttatgccaagaggaaaagattttgtataaattgatatctggtcttcactcctccatatcaattcatatagcttctgattatctacttgaggaagctacaaatttgtggggacaaaatcttactttgatgtatgaccgagtcctaagataccctgatcgtgtcagaaatttgtatttcacttttctctttgttctgcgagcagtaaccaaagcttcagattatctggaacaggcagagtatgatactggtaaccccaatgaggaccttacaacacaatccttgataaaacagctactttacaaccccaagcttcaagctgcatgtccaattccatttgatgaagctaatttgtggaaagggcaaagtggacctgagctaaaacagaaaattcaacaacaattcagaaacatcagtgcattgatggattgtgtaggatgtgagaaatgtcgattatggggtaagcttcaggttcttggtcttggaactgcattaaagattctcttctctgttgatggtcaagaaaactcgagtcatacactgcagctgcaaaggaatgaggtaattgcattgacgaaccttcttaatcgactctcggaatccgtcaaattcgtccacgaagtgggacctacagctgaaagaatcatggaaggaggacatttttctgctcatacaagaacactgattagctcatggaaaaaaatttggtcctatgtatctaaaacttag

SEQ ID NO: 27936 - DNA, 432 bp, Glycine max
  Peptide Sequence Number=SeqID_119621
atggtagtgagcaacttcttctccttattcctccttctccctcacgtgagcaagaaagagattttgggtggtggtgtatgtatccgtgaggtgtatgtggttaggcatggcagcggaatccgaccccatgggaaccaaatcgaacctgccccgactttgacggataaaaaccgcgttgaccgggtttggagtcggattcgggttttccccgataacccaaaacgggggcgggggaggtcactctacctacctctctttgcctctcacaaattcactaatttgcgccgctatagctcctcagtcctcactctaccactcctgtacttcaatctcctctccgatcttgattctgccatagacgaggacaccaaggtttctctctctctcttaaccatccatggcattgctttggataattttatctccttttaa

SEQ ID NO: 27937 - DNA, 183 bp, Glycine max
  Peptide Sequence Number=SeqID_119622
atgggtacgtatttcttaatcccggcggggatcgggggcggggtcaaggatcggttacaaagtcgagggtgggaaatgcaatacccgtccctgtttcaccccgttgtcatgcctaaaggtggtgggatccaagatgtcggatacgatgtcctgacatctggcccgaaaatactggacatataa

SEQ ID NO: 27938 - DNA, 363 bp, Glycine max
  Peptide Sequence Number=SeqID_119623
atgggcccgaaatctaccctaaggctcatgagaattctagggccttctcttgcatctctggcccaatcttcttggagttttctatccaatgcccttgtggggcataaactaggatttaatccaggtggatttgcaggttaccagcaaggtgctaattttaatcagaatcaagggcagtggaggtctcatcctgggaatcaattcaacaaggaccaaggaggaccatccaacttgcctcaaaatcaagcgcctagcctttatgagaggacaaccaagctggaggagactttggctcaattcatgcaagtttcaatgtccaatcacaagagcacagaatctgctataaaaaacctggagatttga

SEQ ID NO: 27939 - DNA, 498 bp, Glycine max
  Peptide Sequence Number=SeqID_119624
atggacatggatgtgggctcgttcatctctggacaaatctcacagatggcccagtccaactcctctcggctaggattccctgcacttattacaacactatgcatcgctagaggagtggtccctgactcacttaattttgagtccttgagccctgccattaatttggcatatattagggagaactgttggaacccggatgatcccatgatcacatttccgaggacccacaagactcgggctaggggacctgacgcttctgctccttcttcttctgctccccttgctccaacaccaccaccaccagctctagtaccagcaccctccagctcctctactcaaagcacagatattcttgtgccaatgctgcaaagctttcaccatggcttatgcctggcaacaccagaggccgaggaagaggctgaggagactccagacgttacttttgttgccacacccatcgaggatatagattatgcagttgatatggcggcgacatag

SEQ ID NO: 27940 - DNA, 171 bp, Glycine max
  Peptide Sequence Number=SeqID_119625
atggcggctcatggtggccaccggtggtcgtggggggtggaggaggagtttctagggtggtttggacggatttttgagagggagatgcgtgaaatcatttcacttagcgagctcgtctcgctaagcgagaatgaatttttggcgctaagtgcaaacccctctcgggtttag

SEQ ID NO: 27941 - DNA, 474 bp, Glycine max
  Peptide Sequence Number=SeqID_119626
atgatgatttcagattttgtgaagagattcaataagtttctgagaaacaaaagaaatcaaaggaaatcaaacatcaatcaaaagaagaaggaagaagatttctccttaaccccaaaatgctatgaatgcgatctacctgggcacatgagattcaattgtcctgtctttaaaagaagaatggaaaaatccgaccagaggaatttcaaagaaaagaaagaaaagaaagcatacattacttgggaagataatgacataaattcttcaagtgatccagaaaataaaatcataaatctgggtctcatgttgaaagactatgaaagtggagaagaacaagttggaagtggaagtgattggaagttgaaagttggaaatggaagttggaagtggaagttactggaagttgaagttggaagtggaagttggaagttggaagttggaagttggaagttggaagtggaagttactggaagttga

SEQ ID NO: 27942 - DNA, 1563 bp, Glycine max
  Peptide Sequence Number=SeqID_119627
atggccgagaaaacaaagtcaagactgaatgaaggtgacaatagtcaaaatgcaaatatggtcgtcgaccctccatcccctattgcgagacatgagaaatggaaaaaggctaggacaaacaaatttggacaaatgacatctgcagcagctcaagaaatcgcaaacaaaattgatgaattacaagaacaagctaaacagggagcttttgtcccacatggtcgtcaagacatcctaaacacttccattggtcgtccagagcatcctggacgtgttcctgtcagtggacatggtgtgaccataaccagctactttagacatgcttcctgtgggtcccacagttcttcgcctgcgatcaccgccgaaagattggttgaaatcatacaaactataaagcaagaggtgaagaaagaggtagaagacgagaacaaagaccgtatggacaagatgaaaatggagttggatgagatcaagagtgaattatcccaaattcatacgcaacagtcagctcccccaagaccgtctaaccctgacgtatttgttgcacgtgttagcacgaaagagagttgtgctaaagttgctaataatgttgttggtagtgagcggtctacatttgatacatgtagtatgggcttctacattgtttgtggtgacagtacacagctggtggcagggggaaaggtctttggagtaggtggcacgatacacactgttgcttatggagatgatgtagtaagggtgtgtgttgacactgtatacgatgctaaagccattgtcccgttacccacttcagagattcagtatgtcagggacgccgtgaactcattcattggatggcccagacatctagtgaaacctttatcttatgattctgaccttaatgtgcggaagccagttgaacatagtagtgatgcaaaacttgcaggtgaatccgatccattgggagagttgatgaagatattgttttatgtgtaccagaatccaatggaagtgccgtgggaggctcaccaatttggacttcctgagattggggcaaaattttacatcacacatgcagatctagcggaaataatatcaggtgacaagtgtttaaacatagcgatactacaattgtgggccatatttatgaatgagtgcggtagaagcaaagctgatcagtcactatatggtttgctggagcctcaatctatacaaaatgctaaggaaagacgtcaacaatgccaacaatacattgaaacatgggtcaaggaatcacaaaggcagttgtatttaggagcttacttgcatcaggcacattggcaactatttgttctccacctaagggaaaacacggtcgtttggttttgttctctgaggaagaagcctgatattagcatcaaaggcgcaattaacagtgcaatgaagacaataaccagttcttttgaaggcatgtctaatcaaggtgcacctcggtgggttgaacccaagtggttttctgatggctcatcgttagacgtggaggtcatcacaacaattcgacagaaatgggcaacttactttttatcttttaggaaaagcagttgctaa

SEQ ID NO: 27943 - DNA, 972 bp, Glycine max
  Peptide Sequence Number=SeqID_119628
atggctgctgaaactccttccaccaatccactcattgagctagctatagtgtcatcccttcccaccaacatgaggggacttggctttcacgctgtccaaggttgcatccttactggagtttgggtcattgcccatgagtgtggccaccatgcattcagtgactaccagttgcttgatgatatttttggccttgtcctccactccggtctcctagtcccatacttttcatggaaatacagccatcgccgtcaccactccaacactggttctcttgagcgagatgaagtatttgtgccaaagcaaaagtcctgtatcaagtggtactctaaataccttaacaatcctccaggcagagtcctcactcttgctgtcaccctcacacttggttggcccttgtacttggctttaaatgtttctggaaggccttatgatagatttgcttaccactatgacccatatggtcccatttactctgatcgtgaacgacttcaaatatatatatcagatgcaggagtacttgcagtatgctatggccttttccgtcttgccatggcaaaaggacttgcctgggtggtgtgtgtttatggagttccattgctagtggtcaatgggttttcggtgttgattacattcttgcagcatactcaacctgcattgccacattacacttcctctgagtgggactggttgagaggagctttagcaacagtggatagagattatggaatcctgaacaaggtcttccacaatattacagacactcatgtagcacatcacttgttctccacaatgccacattatcatgcaatggaggctacaaaggcaataaaacccattttgggagagtattatcggtttgatgagactccatttgtcaaggcaatgtggagagaggcaagagagtgtatttatgtggagccagatcaaagtaccgagagcaaaggtgtattttggtacaacaataagttgtga

SEQ ID NO: 27944 - DNA, 186 bp, Glycine max
  Peptide Sequence Number=SeqID_119629
atggaagcacctgcggctattgtcgtgggagacggtgagggcaacctcactggaggtcctttaatgatgattttccaccatggagatgcagcggaagacaaaggagaagaggtgagaggaggtgccatccacaagggaataagccatggaagaaggagcttcaccaccaagatgagccttggataa

SEQ ID NO: 27945 - DNA, 117 bp, Glycine max
  Peptide Sequence Number=SeqID_119630
atggagttgcagcggaagataaaggagaagagcctagcacatgggaagcttcctggagaagcaaggaaggtagcttccctgggaagctacaggaagaaagctgccttgagaagatag

SEQ ID NO: 27946 - DNA, 2004 bp, Glycine max
  Peptide Sequence Number=SeqID_119631
atggattgctatgccaagtttggactcctgaacacatcccagagacttttccacttcactgaaaacccagattctgttctctacagtgcaatattgagaaacttgcatcagtttggtgaatatgagaagaccctcttgctgtacaaacagatggttgggaaatccatgtacccagatgaagaaagttgctcttttgctttgagatctggctcttctgtgtctcatgaacatgggaaaatggttcatgggcagatagtgaaactgggtttggatgcatttggcttggttggaaaatctttgatagagttgtatgacatgaatggtttgctgaatgggtatgagtcaatcgaaggaaagtctgtgatggaattgagttattggaataacttgatttttgaggcatgtgaaagtgggaaaatggtggaaagctttcaactcttttgtaggatgagaaaagagaatggccaacctaattctgttaccgtgattaacttgttaaggtccactgctgaattgaactcattgaagataggacaagccctccatgctgtggttgttttgagcaacttgtgtgaggaactaactgtgaatactgcactgttgtcaatgtatgcaaagttgggtagtcttgaagatgcaagaatgctgtttgagaaaatgcctgagaaggaccttgtagtctggaacataatgatttcagcatatgcggggaatggatgccccaaggagtccttagaacttgtatactgtatggttagattaggttttagacctgacttgtttacggcaatccctgcaatttcttcggtcacacaattgaagtataaggaatggggaaagcaaatgcatgctcatgtgataagaaatggctcagattatcaggtatcgattcacaattctcttgttgacatgtattctgtgtgcgatgacttgaattcagcacagaagatttttggcttgataatggacaagaccgtggtttcatggagtgcaatgatcaaaggatgtgcaatgcatgaccaacctcttgaggctctgtctctattcttgaaaatgaagttgagtggtactagagttgacttcattatagtcatcaacatcttgccagcctttgcaaaaataggggcattgcattatgtaagttacttacacggttactcactgaaaaccagccttgattcactcaaatccctgaagacatcgtttcttactagctatgctaagtgtggttgcatagaaatggccaaaaagctttttgatgaagagaaaagtatccatagagatataattgcttggaactctatgatcagtgcgtattctaaacatggagagtggtttagatgttttcagttgtacagccaaatgaaactatcaaacgttaaactggaccaagtaacatttctggggctgcttacagcttgtgttaactcgggccttgttagtaaaggcaaggagattttcaaggaaatggtggaaatatatggttgccaacctagtcaggaacaccatgcttgtatggttgatctactagggcgcgctggccaaattgatgaggccaatgaaataataaaaactgttccattggagtcagatgccagggtttatggccccttgttgagtgcctgtaagatacactcagagacccgtgtagcagaacttgctgctgagaagctcataaatatggaacctaaaaatgctggaaactatgtactgctctctaatatatatgctgcagcaggaaagtgggacaaagttgctaaaatgaggagttttcttagagatagaggtctaaagaaaacaccaggttatagctggcttgagttaaatggacaagttcatgagtttcgtgttgcagatcaatctcatccaagatgggaggatatttattcaatattaaaagtgctggagttggaagcgggggatatggaggatgatcttgaactctttgacccttctgttattaaggggtgtgaattgcacatgaatcaactcaaccaactttaa

SEQ ID NO: 27947 - DNA, 594 bp, Glycine max
  Peptide Sequence Number=SeqID_119632
atggaggctgcggaagctcagaacactgtgacttttgagcctctacaaaaagatctcaatatggagatcattgttgatgtggtcaatagagataggctaaactcaatggagaagcaagttaggaagattcgttctgatcagaggctgttgttctccaacattgatcaacttcagaggattatgaatgagttctttgcaaggttccttcgccttgaggagtggatccctaacaaggaaagacctatcttgatccctaaagttgctcttatgcagtatgagcctccaccaccaccaagagctaccaccccgccttcatcttcttcatcttcaaaaaactcatctcctaatatgcatgattggtttacaccttttgttcctcccttctattttttgcttgatgacaaagagggagaagtttatgagagattaacacgacacaatgaccatgtgggtgtcagagagcttgcagaggcaccacgtgaaaaagcggaagagtttgagaaccttgaccggggaggagccaaggcatgtgatgacaatattccatggcttaatatgggaaaggtagccaaagtagaggatgaaagcctatga

SEQ ID NO: 27948 - DNA, 162 bp, Glycine max
  Peptide Sequence Number=SeqID_119633
atgcaattaaggatgacacataagctaaactcgattaatgagattgataactctagagagacaaagaaattagctatgaggatcatcaacatttggagtgttcagatacctgctaggttaattgttgacatgatctttatggataagaatataatggcttaa

SEQ ID NO: 27949 - DNA, 168 bp, Glycine max
  Peptide Sequence Number=SeqID_119634
atgtcgagcatcgttgaagccaaattgagctgcttggcactagttgtcgtgcaatacgaaaggtttttcgacgtttcagtaaggaatgcggaaaataccaaaaagggagggcaaaagggtcatttggaagctttttctggcccctggcccgcctatgccaccaaataa

SEQ ID NO: 27950 - DNA, 357 bp, Glycine max
  Peptide Sequence Number=SeqID_119635
atggcactgctaactaacttccccagcctcgtactatcatctaactgcaatctaattacagtttatactaatcatcttgcatcagaatcattgtctttcattttgaatcaccatagaaaagactttattgacaatagagaatttatcaccaagtcccttaaggaactgagtaataaaatcatgttggtgatagcttttagtgaaacaactacaaggaacaaaagggagaaaatggtcaagctcatcacacaagaccataaacttcttcttgaagtgcatcaatgtggagaagatttccatgagaaaaacattccttcaagtcattccatatatcaatggcacaatcaagatagatga

SEQ ID NO: 27951 - DNA, 405 bp, Glycine max
  Peptide Sequence Number=SeqID_119636
atgaaaaagtatttttactatggtaaccaggatgaagtccgcaatgccacaaaatttgatctaccaaataaggatagaaaggattcccaaggaatatgctttttgggcaaggtatgtggagtgagtagctcctttacatcatatctatttcatggtgctgaatttggatctaagagaaaatatatgtttcgaaaagtgaccatccagctcaagcttgtggagggtgactctgctggaactggaccatttctatctcaatgcattgagcttttctcaagtgcagacaacccgatttgcatcaatgaattgaatattaccagtttaggcatcatggagattcctatttgcttaggtggctccatttcatccactggctccactttatatgtgctcatgttttcctga

SEQ ID NO: 27952 - DNA, 213 bp, Glycine max
  Peptide Sequence Number=SeqID_119637
ggggctgttctaaggatcctggatgtgcctggtgaggtatttcagctgttttgggtgaaaaacaattgtttccgtgaagaaaatccaagccgaggtgcttccgtaacgcttccgagaggtttccataagcaaatccgtgaaggttttcctccgttattcaccgttcttcatccgttcttcattcttcgttcttcgttcttcgttcttcaacgg

SEQ ID NO: 27953 - DNA, 108 bp, Glycine max
  Peptide Sequence Number=SeqID_119638
atggtggtctctttctccttgaaggtctcgtgcaagaagaaaatgaaggttcaagttttggtttttggagaggaaataacaaaaatggatattgtaggcataggctaa

SEQ ID NO: 27954 - DNA, 111 bp, Glycine max
  Peptide Sequence Number=SeqID_119639
atggtggttttccaccatggagatgcagcggaagacaaaggagaagaggaaacccaggtaacagacctttgggattatggcttaccatttgatgttgtatggggaatttga

SEQ ID NO: 27955 - DNA, 285 bp, Glycine max
  Peptide Sequence Number=SeqID_119640
atggataagtggatgaatataacccacatgggttatgtgattgcatcaaggtataatgccatccttttttttctttctctccaacaaagcatgacgttttttcctcttagaagtcaactaccgagggattcttctgtttatcacattatatctattggtcatctgtatgacaatcattttgttcaggtatttctaagagatggttgtcccttgccgctagtagctttattatggtcaaacacattgtcattatcaagaaaaaatgtggcttactccttatattag

SEQ ID NO: 27956 - DNA, 399 bp, Glycine max
  Peptide Sequence Number=SeqID_119641
atgtacaaagataagcgggcttacttagctcatgggcccgaaatctatcctaaggctcatgagaaccctaaggccttctcttgcatctctggtccaatcttcttggagtcttttatccaatgcccttgcgggttaaagtacaagcacaaacagatgtcactactagatgttatcacccacattatcattgaagatacaaataggaaggaaaatgctgcagcaaggaccaaagcaatgtctgccaaggcaaacacagtacaagaaaaaccatttcataagaggtacaaagttatgagaaatgataatcctcctaagcctagggctaacctagttgaaggagatgatattattgatgtggtcatttatcaagtgaatgttgtcaccaatgtgaacaaatga

SEQ ID NO: 27957 - DNA, 1018 bp, Glycine max
  Peptide Sequence Number=SeqID_119642
ggtagagcaacaacttaaaaggaagtctacttcaaaatcttatggctctcactcttatccaaagaaagaccaaggtcaaggaatcttaggggtgagaccttctaagcccaaagatgataaggggaagacaatagaaaagcaaccccttaaggctagtatgcaagagaagactagctccatgaagtgctttaaatgtcttggaagaggacacattacttctcaatgccccaccaagaaaaccatgattatgaggggccaagacatttatagtagccaagatgaggctactacttcaccttcctctagtaaaagtgaagaagcaaaaggggaagaatctagtgaagagatctacccccaagaagaaggacaacctttaatggttaaggaggagtgtaaggagacacttgttagcattgccacatctcttaggcttgagtttattcctcaagtaaaggagttgttggatgagggtttggttctcaagagattaaatccttgtgctttgttggtgcccaaaataggtattattaggcaccaaatccctaaaataggtggtgtgatgaatgctttgggtggtgcaacactcttttgtaaaattactcatgcacccaacatcttcatgatttgtgcacatagggactcattagcaccactcattgagttggtgaggaaccatgttccttcatgggaagatgcccaggaaatgagttttcagaccttaccttacttcaacatactaaacaccactaatacatatggggagggaataccacatgatgcaagctccattggagcttgtaggcctaggatcttcttcatcaatggattcctttgcttcttggaagatgaatggcagcggaatggagaaagggaaagagagaggagacgccacttcaaggagaagatgagtctagaagaagctcaccaccataggaggccatggataagagcttggaggaagaaggagatgaatgaagggagaaggagagaagagcacgaaattttgtgctctaaatga

SEQ ID NO: 27958 - DNA, 513 bp, Glycine max
  Peptide Sequence Number=SeqID_119643
atggccaagaagaaaggttctctagttggccttctatgtcttatcactgctcttggtgctagaagagacattgacatcaccaatgatattgctcagtcatatgtggatttgaaaacttttggcaagggtttagttgctcaccttgccacctcctacctattcctatctcaggaggaaatgttggctgccatgggttggcttactctttcaggggaccaagctcaagaaagccaaatgggtggtgaggctaccaatggagttggagccggagctgaagatgtagctaatgatgggaatgatggatcaatgttactaaatttgttgttaacgatgaagttggagcagagaaagagattaatgttgaggaaactactaaggttgtaccttaagagaacaacaatggagaggaatttgaaactgctgaatggtcctactctctcgtattctctatttcttccttatttctttattctctctattctctttgattctgaacaatttaatgtcttgtag

SEQ ID NO: 27959 - DNA, 600 bp, Glycine max
  Peptide Sequence Number=SeqID_119644
atggagcagtggtgctcctccatgcatagctgtgatgcgtcatcgacagtgacaagggtgaacaagaatgagagaaatgacatgatcagcacggaggaggaggaggagaaaaagaagaaggagcggtggcactctgccgtgcatggtcgtgaattgccttggcgaaatcacttctcacatgaaattgaagagacaaatttaggattgttgctcctctctgcttccaaaatcaccacccaattcaacaagactcttttggtgcttgctactagatctatagttgacgcaacaggaaggttccccctcatgacctctcaaaaaaggtcatcctcaaagccgacgtgtaaggtctgggaccccacattcgccgcatcaaccctgacgtgtccaggttctggatttcggttagaacatttggcatccaccgtggagccgcgcactcggtctggcctcagacgcgagacccctctcgaagactctcatcctcattcggcagctgtggtagacatggacattttacggctgctccaaaaccgcatcgcaaagatggagcaacgccatgaagaggagttgacaaagctaaaggctgaccatgactag

SEQ ID NO: 27960 - DNA, 1659 bp, Glycine max
  Peptide Sequence Number=SeqID_119645
atggcggttgcactctgcaacacgcttgcttcctctgctctccatcaaatgtcccgtcaagaaaacccgtttcttcatttgtatcatcctttgcctcttccttcttcagttttcttcagcttggtggttgttgaatgtccccacgaagaagcatccagcaggcaagcttggtggttgttgaatgtcgtcacgaagaagcatccagcaggcaaggtttttgtaccctttgctcttataattatagctcgcattcttgacaagataaaggacatcgatggatcaaaagaaacccttaaacttgttgtcaggataactgacctttggtttgttggaatgccaaataagtctgaacaagctgagatgattatagtggactcagattttgtttcatactttgcccatgaccagggtgatcaaattcacgtggtttgtaagagagaccaactgaagtcttggaagtcggttttgaaagagaattgtactcatgtgatgcacaattttaaagtcatgaagaatgatggtcaatacagagtttgtgaccaccaatataaattggtgtttactggagttattgttcttagacaaactcatttggacaatgttcctttaaaaaaaaaatacaattttactcaattttccaatatcattgttggccactttcaacctggcctgttggttgacattattggtgttgttgatgaggttgtcttccgccatgtttcatcaaggagtacaagggttgtttttaaactgaaggacttgagcgaacaattgctatcttgcactctgtgggaagattattgcttgcagttcttagagtacttaaatgagtgtcaaagtgatggcccgataattgttttgttgacccatgctagaattaaagaagcccagggatcgtatccaccgtcagtgagtaattctttgaaggcttcaaagttagttagtaatgaactggtggacgaaattcaagaattcaaagataggctttctgaattaggcattgaggtccactcagttatgacacctcgcggtcaagggagttcacagctttcagcttgcatccaatgtcacaaaaaaactgatatagacactattgtgttcacatgcgcatgtggcaaatataatgaacaagctatgttgaggtatagacttgaggtgatggtcagccacaaggaggaaagcaccaaatttcttttctgggaccatgaatgcactaacttaattggacaatcagctgatgaagtgaataggttaaaaatagttgatggtgatgtcgatttaaatgcatcaccaaaaggacttgataagttgttgggttatgtgtttgcctttaaagtcaaggttcaaccaaagttcaggaatgttgttgttctaaaatactcacgtgacttaagtttgattaacactataatggagttactgcctgatgctgaggcatcttccaagatcgatattgcaatccctgattccaatgatccttatcaccatgaatctcaatccatgtctggaacagcagaccatgatccacttctcggactccccttaacaccaacaaagcgacaaccatctcaggaatgtgatgatgaagcaagaagctctcagatttcacctgcacaactttcatctaacaaattagtgaaacatgctaaaattgaatga

SEQ ID NO: 27961 - DNA, 657 bp, Glycine max
  Peptide Sequence Number=SeqID_119646
atgtatgtgttgcggttcttgtggactccttatgacacaccaaaaataaggccattaattaatgatgttgaggtatcaatgattgttcaggcagaagtctctcacatatgttttgcaattgtggaatggcatccaatagacaggtattatccgtattatcctgatcatcaccaacaccaatcatatgcagaaccaaatgtacctccgattcatgttcctggatttatgtcccaacatcatccatcacaagcacaatatcaattagcagccttctctagatatgcgtctcaaggatgtcaacaaagttttcaactagtagaattctcatcatatatgcctcaatactcatttcaagtctcttctacctcaaatgttttttatggcccctcacaaatgtttgtcaccactttcaacactccaccatttgcatataatctatcatctgcatataatctaccaccatcgacctcttgttatcgtccatcattacctactcaaatgcgtgacttaggtcatgaagatgaggatgatgatgatgatgttggtgatgatgatgatgacaatggtggtgatcatgttcctcaacaacaacacacaattacacgtgaacatcttagaacaagaggaggtagaggttgtagaccaagaggacaataa

SEQ ID NO: 27962 - DNA, 641 bp, Glycine max
  Peptide Sequence Number=SeqID_119647
atgacgttgctacttagcaacattctgcccagcaactacaataccgatctccccctgcggagtatcagttgggatcacgcccacaagacacccagtggacccagagaagtccaacagggccctggggttttcagctctagttacgggcctttgtcagtcctacagggtgcccgtcccccccagcaagggatcgtgcctgcaagacacccaatggacccagagaagtccaacagggccctgaggaaggcacagggcgagacaccacagcaggctggggatggccagcagcaggcaatagacgcaccgccgccacctccagagcctctcagctcatctacaaaggctagagcattgcctacgacctgtggccgaccagcaagcgaccaagtccaaagccaaaggtacttggcacccattgttacacaatccgtgaggttccgtaacatgctggaaatcaaaaggaagcattgttatgcaatccttgaggttccgcaacattctgaaagccaaaaaggggatgattacgtaatccgtaaggttccggtgcaaatagcaaccaggctcacttgggccttccaggatgttcctccagaaggcggttgcttctggaggaagcaacctagctcgcctgggcgagctgg

SEQ ID NO: 27963 - DNA, 1401 bp, Glycine max
  Peptide Sequence Number=SeqID_119648
ttcgccttcagagggatatacgcgctcggcatcagagggctacatgaaatccccttcagaggactacacgtcctcgccatcagagggctacatgtcctggcctttagaggactacacaccctgcccttcagacgactacacttcctcaccttcagaggactacccgtcctcaccttcagaggactacgcatcctcaccttcagagggctccacgccctcaccttcagaatgcttcacgtcctcgccttcagagagctacacggcctcgccgttagaggactacacgtcctcgccttcagaggactacacgtcctcgtcttcagagggctacacgccctcaccttcagaggactacacgtcctcacctttagagggctacgcgccctaacgcgctcaccttcaaagggcttcacgccctcgcctttagaggactacacgtcttcgccttcagaggtctacacatcctcgccttcagagggctacacgtcccccccatcagaggactacacgtccttgccatcagagggctacatgtcctcgcctttagaggactacacgtcctgcccttcagaggactacacttcctcaccatcagaggactccacatcctcaccttcagattgctacagggcttcaccttcagaggattgcgcgtcctcaccatcagagggctacacatccacaccttcagaggcctacatgccctggccttcagagaactatacgtcctggccttcaaaggactacacatccatgccttcagaggaaaacacatcctccgtctgtagaggactacacttcttcaccttcagagggctacacgccctcacgccctcatgccctcaccttcagaggacttcacgtcctcgccttcagagggctacacgccctcgccgactacacgtcctcaccttcagaggactacacatcctcaccttccgaggactacacgtcctccccttcagagggctacacgtccttgcctccggagggctacacgtcctggccttcataggactacacgtcctcaccttcaaagggctacacgccctcgcctttagaggactacacgtcctccccttcagaggactacgcgtgctcaccatcagaaggctacatgtcctcaccttcagtggactacatgtcctccccttcagagggctacacgccctcaccttcagaggactatgcatcctcaccttcaaagggctacacgccctcgccttgagaggactacacgtcttcgccttcagagggctacacgtcctcgccttcagagagctacacgtcctccccttcagtggactacgcgtgctcgccatcagagggctacacgtcttcaccttcagagaactacacgtcctccccttaagagggctacacgccctcaccttaaaatga

SEQ ID NO: 27964 - DNA, 654 bp, Glycine max
  Peptide Sequence Number=SeqID_119649
atgcaagttagggttcgagggcatctgacaaaatttgatgttgattccctcaacacatttttgcagactccagttgtcgtggagggatttgtacttaatgctgaaggcctaccatggaagatcttgaggaaagatcttaccactctagcccaaacctggagtgttctatcttattctaacttggccctgacatcccatacttctgatcttaatctggatagggccagatttcactcattgctcagtccaactcctcgaggctttgatttccagccttatcactgccttgtgcaaggcccgaggagtcaccccagaagaattgctggaacctggatgacccttcgatcacttttccagggacccaaaaatccagggctagaagatctgaggccctatctccttcagttgcccctactccccctacttttgctccctctacttctgctttcccatcaccaccagcagctccagttcttccaagtccctcagcttagagcctttcatgtctatgatgcagagcctgcaccaagggcagctcctgattatgcagagtttgcaggatgtggtccagcagcggccagttatgagcctgatagagtttgttcagaaggtggcctggccaggagttcagccttctcctttgggagggggtga

SEQ ID NO: 27965 - DNA, 183 bp, Glycine max
  Peptide Sequence Number=SeqID_119650
atgagatttctatcagcaatttcagcatataaacatcacaaacatcatcacaaaaaccctaaaacagaatggaaatggtggccaaaggttgaagctttgcttgaagcttcaatggagaatgaagaagaagaaagctacgtgagagagggagagaaaaggcttctgaatttctgctttggctga

SEQ ID NO: 27966 - DNA, 282 bp, Glycine max
  Peptide Sequence Number=SeqID_119651
atgactttacaactggttgaccgctccattaccagaccatatggagcaattgaagatgtgttggtcagagtgaaacattttatcttcccggcagacttcatggccattcattttaactgcaagctagttgacatgggtagaaagaagctggaaatgggttttgaggatcagaaaattgattttgatttgtttgttgaagacaagcccgctctagaacaaaatgtttgcttacaggtaatggaagtgggtcaagaggttctgaaagtaagaaccaaaacatga

SEQ ID NO: 27967 - DNA, 486 bp, Glycine max
  Peptide Sequence Number=SeqID_119652
atggctgagaagacaaagaaaagactggaggaagctgcccagtccggaagcactgagggcgtcattgaccctccatctcccatcagacgccatgattctttggtggaacaggcatcacagggatcgttcgtcccacatggacgtcaggatgtcctgactgttgctattgggcgaccaaagcatcctggtcgtgtctatgctgctggagccggtgtcaccataaagcaatatttcggatcggctccgcgaacatcacgcagttcttcctccatgcttcctgaagacctacaacagctgacccaacaaatcagggaccagctggaggagtcgatcacagaaaaaagtgactcgacaggtgatggcatccttcagccagatgtagtcccagtttcagtctcagatgcaatcacagggacttacactacctccggagccagaggttggtccctcaggtgctcgtgtcagcatcaaggagagttgtgttga

SEQ ID NO: 27968 - DNA, 294 bp, Glycine max
  Peptide Sequence Number=SeqID_119653
atggtgcccttcacatgtgcatgcggcaaatacaataaggaagttgtgcttaggtataggcttgaggtgatgatcaaccaggagatgaaagcacaaaattcctgctttgggaccgtgaatgcagatggtgatgttgatttgaatgcttcaccccaagcacttgataagctgttgggttatgaacttgctttcaagataaaggtgcaacccaagttcaggaattttgctgttttgaagtgttcaactgactcaagcttaataaatgttgtgatggatatgctagctgatgctgag

SEQ ID NO: 27969 - DNA, 183 bp, Glycine max
  Peptide Sequence Number=SeqID_119654
atggaagtctataacgaaggggtgctgttgaatagttacctcgacgttggaacaagttgcccgcgtatgtatccctgcatgcataatgtttccggtaccacctatcctgacaacgcattaaagctcagttgtgctggtggtggatctggcacgagtttcgacaatgtcagctgttgctcgtga

SEQ ID NO: 27970 - DNA, 193 bp, Glycine max
  Peptide Sequence Number=SeqID_119655
gcaagcggagggagaactagacgtatcttgctaggcaaagacaggttagaatggatagcttcgcgaggtgccgcgcaatctgctgctgctgggatggatcataggatcagatgtgatctctggtgtctccaccataatgcccagaagccggtggttatgctggaaaaggctattctcgtcacgttcaacgcgg

SEQ ID NO: 27971 - DNA, 321 bp, Glycine max
  Peptide Sequence Number=SeqID_119656
atgaaggaaaataaagcgaaattggctcgtgttatctacgaggatatcgatgtgtggaactggtacgatgttggcaacccattctggataccgagcgacggccagaaatccagcgtcaaactgcttcttcacttcttcttttatcttcaaggacgtttcgggttttcatcctcctcaatttctgttttactggggaacacccgggatttagaggcaatcggtgctgcacaatgtcagaactcaaaccgggcatatcttggtatgaccaagcaaagatgtcttggtagtcttttagcaggattattaattcttcacggatag

SEQ ID NO: 27972 - DNA, 567 bp, Glycine max
  Peptide Sequence Number=SeqID_119657
atgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggtgcaaggccactctgccacttacaataccccgtcgcgtatctaagtcgtctgcaaaggattctacccgccgctcgatgggattgcgcttcaaggcgtctcgtagggctaatccgcctcaccgagggtcaccaacggcacgtgcctttgggggccgagcccctactgctgtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 27973 - DNA, 687 bp, Glycine max
  Peptide Sequence Number=SeqID_119658
atggcgagccaagagaagtggggcccgtttgcggatatactagctttgttgatttttggggttgtcctctttccgaacgtggacggtttggtggacttggccgccattgacgctttcctcgcatatcaccatagcaaggagagtccagtggtggctatcttggtagatttgtttgatacctttgaccagagatgtgagaaaaacagtgcacggattgtctgttgtttacccgctctctgtgtgtggatagtttcacacctattccaacaagacaccagacacccatgtccgcttcaaagctatcgctcatgcgcccaaaaaggaagagtcgattgggaccaacatttggctggaataggaggcaacgcaatcaattggtttcctcgttggaaggaaggcaaggaaggagttctcttctcgtgtggggactaccctaatgttccattgatagggactaggggttgtattaattataatcccgcactcgccataagacagctagggtaccccatgaggggagcgccaaccgaagaaagtctctcgcctttccttatgagggatctaggtgcgaaaagtctcaaggggatacaaagagtccacaaggcgtggagaagtccgttgaagaaagacaaggagcttagaggcatccgaaatggcgtcatcggtggttatcatggatggctatga

SEQ ID NO: 27974 - DNA, 823 bp, Glycine max
  Peptide Sequence Number=SeqID_119659
atgaggggagcactgacggaagaaagcatgtctcttttccttgtgagggatttcggcgcacaaaattccaagactatacaaagaatccataaggcgtgggaaaccccgttaaagaagatcaagagcttagaggcattcgtaatggcatcattggtggattggctcgccaagttaaaagtcgtcagcaaagagagttttgaagcaccggaagaagacaaagaagtccaagctctcaaaagcgagttaggaaaggcaaaacttgccaaggagaagttcaagttggccgctacacacgttcggaaggagtgtgccgggttacgggaagagaatgcaattaccgcaagagcccttgaacaagagaccaagagagctcgcaaggaagagtatggccggaacaaatttcgcggagctctatggggtagcaatagtgaactcaagttgcgaagggaagaaagggaccagtcgcgagcacatggcatggttttgaaagaggagttagttgcctgttcaaggtccaaaagaagcttgtctcagcgtttatgcgagacggagaccaacatgctagctatcatcgccaagtaccaagaagagttagccatggcccacgagcatagaatcgcggatgagtatgctcaagtatatgcggaaaaagaggctagaggaagggtgatcgactctttacaccaagaggcaaccatgtggatggaccggtttgctcttaccttgaacgggagtcaagaacttccccgcttgttagccaaggccaaggcaatggcagacacctactccacccccgaagagattcatgggcttctcggctatt

SEQ ID NO: 27975 - DNA, 253 bp, Glycine max
  Peptide Sequence Number=SeqID_119660
aaaaaaaaaaagaaggagtagaggcgagagtcgtcatggactaatcacggaaagggtgagacggacgaaatcaatgtcttatctttgctttcctctaatctccgataaaagatacttggcaccctttgttgcacaatatgtaaatctcgagacgcgccggaagtcaaaaggaagcagggttatgcgatccgtgaaattccataatgtggcggaaaccaaaaggaagtgttgcgcaatccgtgagtttctgtaa

SEQ ID NO: 27976 - DNA, 324 bp, Glycine max
  Peptide Sequence Number=SeqID_119661
atggaaaattccgacaagatgaatttcaaagagaagaaagaaaagaaaggatacatcacttgggaagataatgtcataaattattcaaatgattcagagaagaaaatcataagtctagacaacaaacgaaggccacatttctcccccaaaaaaagtgaatatgcgatttatggagacaacaaacaaaggccacttgatcaacaaccccaacaattggaagttggaagtagttattggaagttgaaagttaaaaatggaagttggaagttggaagtggaagttattggaagttggaagttggaaatgaaagttattggaagttga

SEQ ID NO: 27977 - DNA, 387 bp, Glycine max
  Peptide Sequence Number=SeqID_119662
atgaccggtagattgctggccaagtcattaacatttgataatcgcatcatgcactatataattgttagaattttgcttcctcggtcttcgaatttggcacaagcctctgaggaggatttgattctgatgtgggctttccttaccggtcgtcagatcgactgggctcacttggttcggtaccgaatgcataaggcattatgggccaatgcacatctcccttaccctcaattgataactttgtttctgcgtcattttcaaattccgcttgatgatgaaccatttgttcaagtcaagcgttcctttgcaattggtgctagtgcagtgacttcctttggataccgtaaggatcagaatggtgaagaaagacgcactccctcctcaagatga

SEQ ID NO: 27978 - DNA, 519 bp, Glycine max
  Peptide Sequence Number=SeqID_119663
atggtcattgcagttgatggtgcccatgttagatacgttggatgttgtgtattttcacgggggacgaagtgcactgaccttgtcggatggcccatttgtgggggaccagtgtggttaaagaatctaagcatttctgaggggatgcttaggcgctttaattggtccatggtctttggcacttgctttgggccacgttcatatgtcgtatgtagtgtatgttcatggggggtggagtgcactgaccttgtcggatggcccattcatgggagacaagcgtggttaaagaatctaagcatttctaaggggatgcttagaatgacagtagtgtcgcaacatgcacttttgcgggcgtgcgaggcgaggctcacgggtgcactttccaaaggaggaaagatgtgcggagtcgccactaacgtcgacaaaagcggggctcttgctcctacgtatcctccatcgaagaggaaatcagacctacgtagttcttccctaagagtgaatcaagcgattctttttacttga

SEQ ID NO: 27979 - DNA, 508 bp, Glycine max
  Peptide Sequence Number=SeqID_119664
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagggatcctcgagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 27980 - DNA, 279 bp, Glycine max
  Peptide Sequence Number=SeqID_119665
gagcaaaagcctcacttttgtcgaccacactgctttctgttaccatgacccaagagctggtagcccgcggagacaccttacggttatccgcacctcgagtgtgattgataagcggaggccaatatggtcatctgcaccctttctggagataggcggcgggcccgatgacacgcggagataccttacggttatccgcacccttttgtcatccagaggcggcgggcccgatgacacgcagagacaaaaattggtcattctgcacccttgtgtcatccagag

SEQ ID NO: 27981 - DNA, 418 bp, Glycine max
  Peptide Sequence Number=SeqID_119666
atggctccgggatggtggcctcagatgactcgtcctccatatgctgaggtacctgggatgtgggaccttcgtcttccttatgaagagaagggcgcttctgaagtggatgctggagtagaagctgtagaagtagaaggaagcttggctagccttgccctcaccctcctagcccctcagatagagactacaacccctatggccctacataatacggtgatcagagcagggaacccaagtctagaagtgttagactgggctatagaggtcatctggccagagatcagcgctcctatgttcatatccaaaatcttcccaggatggccttcagagttcaagatgaaccctcaaccaggtatgcataaggcaggctctatctctctgaagtccataggcaacttgcagtatctggagtatgcgg

SEQ ID NO: 27982 - DNA, 522 bp, Glycine max
  Peptide Sequence Number=SeqID_119667
ggacttgcactgccttcggagcctgaggatggtcccttagctggtcgtgtcagcacaaaggggagttgtgttgatccctcagggaacgatccagacacgggtgactcagacaaatacgggttgtacatcgaagaaaatcctccctgcctggttgccctaggaagagtttatgatggatccacaaccgttcacaacatccctttattgcatgatcaagtgaatgtcggtattgagcaggttaaagatgcagatgctcccattcttgtacccactgacaagggagctgtgggaccagtaaaacttgcagataggtcggatcatgagttcgatgatcccctatatttgttgacattgaccagcccacaacctattttgaagtcgttgcaggttatgtgggatgctactgtgttcggggtgtttaatgaagacttccccttgtacataaagcatgaagatctgtctgaaatagcacacggtggtcaatgtcttagcatctctgttaaacaattgtggattctgtaa

SEQ ID NO: 27983 - DNA, 4674 bp, Glycine max
  Peptide Sequence Number=SeqID_119668
atggacgctgtgtcatccgcactactagagccagtaactaattctgtgttggatctgattaaaaagcaagtggattacatccgttataggcaaaacattgatgaactagacgagtgtgttaagcagcttaaacataaaaaggagatagtagatcataaatgtgaggaagctgtcaaaaatggacacgaaattgaaggtaaggttagagaatggttagggaaagtgggtaaatttgagacagaagtggagaagtatcggaaggatgatggccacaaaaagacacggttttccaattgtttatttctttacttttggcatagactaggcagactagcaaagaagatggcagttgagggtaaaaagataaccgatgattgccccaattctgatgaaattgcctatcgggtatacgtaacatctaatgatgccattttgtctaataatgaccttatggattttggttctagaaaatccataatggaacaaataatggcaacacttgttgaagatcccactgtgaaaatgattggagtgtatggacgaagtggggtgggtaagagcactttaatcaaagcaattgctaaaattgctcgagacaagaagttgtttaatgtggtggctttttcagaaataacagacaaccccaatctaaaacaagtccaggaagatattgcttaccctttgggattgaaattggaaggagaaggtgagaatgtaagagctgataatctacgaaggaggttaaagaaagagaaagagaacacccttataatcttggatgacctttgggacagattagacttgaataggttgggaattccacttgatggtgatgttgatgataatgatttaagcaagaagacaaatagtgataatcagggtccccaagggccgacaaaagaaaaatctcttggtgattataagggttgcaaaattttgctaacttcaaggaaacaaaatgtattaacggataaaatggaagttaaattaactttctgtgtagaggaattagatgaaaaagatgctctgaagttgtttcggaaggaggctggaatacatggtgaaatgtccaagtctaaacaagaaattgttaagaagtattgtgctgggttacctatggcaatagttacagttggaagggcattaagagacaagagcgactcagagtgggaaaaacttaaaaaccaagacctggtgggagttcagaatccgatggagatttctgtaaaaatgagttatgaccatctagaaaatgaggagctcaagtccattttctttctttgtgctcaaatgggtcatcaacccctaattatggacttggtgaagtattgctttggtttgggaatacttgaaggggtttactggcttggggaagctcgggaaagaatatctacatcaatcaaaaagctgaaagactcaggtttggtgttggatggaagttctagtattcatttcaatatgcacgatctggttcgagatgctgctttatctatagcacagaacgagcaaaatgtatttactttgagaaatgggaaacttaatgattggcctgaactcaagaggtgcacttctatttctatatgcaatagtgatatcattgatgagcttcctaatgttatgaactgtcctcaacttaaatttttccaaattgacaatgatgatccatctttaaaaatacctgagagtttttttaagagaatgaaaaaactcagagtgttaatattgactggctttcatctatcaagcttaccatcttcaattaagtgcctatcagacctcagattgctttgtttggagcgatgcactttagatcacaacttatccatcatagggaagctgaaaaaattaagaattctcagcttttctggatctcgaattgaaaatttgccagctgagttgaaggacttggataaactacaattactagacatcagcaattgttcaatagtcaccatgattccacctaatcttatatcaaggttgacttcgttggaagagctgtatgtaagaaagtgtttcatggaagtgtcggaggaaggagagagaaaccaaagtcaaaattcatttatttctgaactaaagcatttgcatcaattgcaagtggtggacttaagcattccatgtgctgaattttttgcaaaggaattgttctttgacaacttaagtgattacaagattgagattgggaacttcaaaactctttcagctggagatttcagaatgcctaataagtatgaaaatttcaaatctttggcattggagctgaaggatgacactgacaatattcactctcagacaggaataaagttgttgtttgaaacagttgaaaatttgtttttgggagagctgaatggtgttcaagatgttattaatgagttgaatttgaatggatttccacatctgaaacacttttccatcgtaaacaaccctagcatcaaatatatcatcaactcaaaggatttgttttatcctcaggatgtttttcccaagttggaatctctatgcctctacaaactaaaagagatagagatgatatactttagttcaggtacagagatgatatgctttagtccatttacagattgctcgttcaccaaattgaaaacgatcaaggtcgagaagtgtgaccaattgaagaatcttttctccttttgcatggttaaattgcttgtgagtcttgaaacaattggtgtttccgattgtggttctttagaggagatcattaaaatacctgacaattctaataagattgagtttcttaagttgatgtctttgtcacttgaatcattatcatcattcactagtttttataccacagtagaggggtcttctacaaacagggatcagatacaaattactgttatgactcctcctctttttggtgaactggttgaaataccaaacttagagaacttgaatttaatctcaatgaacaagatccagaagatatggagcgaccagcccccgtcaaacttctgctttcaaaacttaataaaattagttgtgaaagattgtcaaaatttgagatatttgtgttcattgtccgtggccagcagtttgaggaaactgaaaggcctctttgtaagcaactgtaaaatgatggagaagatttttagcacagaaggaaatagtgcagacaaggtttgcgtctttcctgagttagaggaaatccacctcgaccaaatggatgagttaacagacatatggcaagctgaagtgagtgctgattccttttctagtctcacttctgtgtacatttataggtgcaataaactagacaaaatttttccgagtcacatggaaggatggtttgcgagtttgaacagcttgaaggtttcttattgtgagtcagtggaagtgatttttgaaatcaaagattctcagcaagtagatgcatctggtgggatagacacaaatttgcaggttgttgatgtatcctatctcccaaagttggagcaagtgtggagcagggatccaggaggaattcttaacttcaaaaaactgcagagtatacatgtgttttcttgtcatagactgaggaatgtatttccagcttctgtggccaaagatgttccaaagcttgaatacatgtcggtctcagtgtgtcatggaattgtggaaattgttgcctgtgaagatggatccgaaacaaacactgaacaattagtgtttcctgaactaaccgacatgaaattatgtaacctatcaagcatccagcatttctacagggggagacatcctatagagtgtccaaaattgaagaagttggaagtaagggaatgtaacaagaagctaaaaacattcggaaccggagaaaggagcaatgaagaagatgaagcagttatgtcagctgaaaagatattccccaacttggagtttttggttattgactttgacgaagcacagaagtggttattgagcaacactgtgaagcatccaatgcaccgtttaaaagagcttaggttaagcaaagttaatgatggtgaacgtctctgtcaaattctgtacagaatgccaaatctagaaaagttatacttgtcgagcgctaagcatttgcttaaagagtcgtcggagtcacgtttgggaatcgtattacagctgaaggaattgggtttgtattggtcagagataaaggatataggatttgaacgagaaccagttctacagagactagagcttttgagcttatatcagtgccataaattgatttatttggctcctccctcggtatcattggcttacttgacaaatttggaagtatggtattgttatggattaaggaatttaatggcatcctcaacggcaaaaagcttggttcaacttaagtccatgaagataaggggatgtaatgaattagaggaaatagtaagcgatgagggaaatgaagaagaagagcaaatagtgtttggcaaattgattactatagaacttgaggggctaaaaaagctgaaaagattttgcagttacaagaagtgtgaattcaaattcccgtcattggaagtattgattgtgagagaatgcccatggatggaaagattcacggagggtggcgcaagagcaccaaagttacaaaacatagttagtgctaatgaagaaggaaaagaggaagccaaatggcagtgggaagcagacttgaatgccaccatacaaaaagggttcaacaagcatttttaa

SEQ ID NO: 27984 - DNA, 639 bp, Glycine max
  Peptide Sequence Number=SeqID_119669
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccagatcgttacgcctttcgtgcgggtcggaacttacccgacaaggaatttcgctaccttaggaccgttatagttacggccgccgttcaccggggcttcggtcgtcggctcccctgtcatcaggtcaccaacttccttgaccttccggcactgggcaggcgtcagcccccatacatggtcttacgactttgcggagacctgtgtttttggtaa

SEQ ID NO: 27985 - DNA, 261 bp, Glycine max
  Peptide Sequence Number=SeqID_119670
atgcggctatccgcacggtcgatgagtgataaacgtgtagagacaaattctacgccctttatcattcaggagcaacgagtcgagtggaacaacaagttgggtggtaaatgcgcagagacagattctgcgccctttatcattcaagagcagcaagctgagtggataaacgcgtatagacgaattctacgccttttatcattctggaacaacaagttgggtggtaaatgcgcagagacagattttgcgccctttatcatttag

SEQ ID NO: 27986 - DNA, 1402 bp, Glycine max
  Peptide Sequence Number=SeqID_119671
atgttcttcggttggtggctgtgcctgatgcatattttcagcggtattgcgcagtgcctgaccatcattggtatccccgtggggatcgccaattttaaaattgccgccattgcactttggccggtaggacgccgcgtggtctccgttgaaacggctcgcgccgcgcgcgaagccaacgcccgccgtcgctttcacgcctggctatataacgccaggatatttattgcgctttgtggcaccacggttgcgccgtggtggattggcgaagtcaaactcaccatcccgttaacgcttggggtggttgccgcggcgttgaccgacctcgacgatcgccttaccgggcggttacgtaatctcgctattacgctggtctgcttctttattgcctccgcgtcggtggagttactgtttccatggccgtggctgtttgctattgggttaaccctgtccacgacgggttttatcctgctcggcgggctgggtcaacgctatgccaccattgctttcggcgccttactgatcgctatctacaccatgttaggggtcactctgtataacagttggtacctgcagccgctctttttgctggctggcgccatctggtacaacgtattgacgctcgcagggcatcttatttttcccatccgcccactgcaggataatcttgcgcgcagctatgaacagctggcccaataccttgaacttaaatcccgactgttcgatccggatatcgaagatgaaagtcaggccccgttgtacgatctggcgctcgctaacggcaagctggttgcgatgcttaaccagacgaaagcgtctttactgacacgcctgcgcggcgaccgcgggcaacgcggcactcgtcgcacccttcagtattatttcgtcgcccaggacattcatgagcgtgccagctcatcacatattcagtatcagacgcttcgcgaccatttccgctacagcgatgtgatgttccgtttccaacggatgttgtcaatgcaggcgcaggcctgtcaaaaactttcccgcgccattctcttacgcatcccgtatcagcatgatgcgcactttgaacgcgcctttatgcatctggacgcggcgctggatcgcgtccgcgccagcggcgcgccgcaagatcaggtcaaagcgctgggttttctgctcaataacctacgcgctattgatgcgcaattggcaactatcgaatcggtgcagaccagcgtgctggccagcaaccatcccgaaaatctgcttgccgacgatcgccctagcgggtttagcgatatctggttacgactgcgcagcaatatgacgccggaatcggcgcttttccgccacgcggtgcgaatgtcactggtgctgtgcgcgggctatgcgttcattcagtttaccggcctcaaccacg

SEQ ID NO: 27987 - DNA, 288 bp, Glycine max
  Peptide Sequence Number=SeqID_119672
atggcaaatgtggcggaaagccatcaaccacgatgcgcgcgttggcgatcggctggtgaaaattgttgtatccctgattacaacgtgtcggttgccgagcacctgatcccggccgccgatctctcggaacagatctcgactgcgggcaaagaagcatccggtaccggcaatatgaagctggcgctgaacggcgcactcaccatcggtacgctggatggggccaacgttgaaatcgcgcagcaggtcggtgaagagaatatctttatctttggccataccgtagagcag

SEQ ID NO: 27988 - DNA, 667 bp, Glycine max
  Peptide Sequence Number=SeqID_119673
atggggacaaatcaaaacggccaaaggttttatcaagtcaaggttaaaagtctagatgtcactagcctcaaggaattaggacgattgatgggacctctccaaaggcaagccttccgcaaagtgtatgggaagattctagatttggccgcagcggaggtatttacggaagctgccgtatccctcgcccaatactatgaccagccgttgagcaaaggagttggatcgcacgaagcaaactcggaacgacgtagtgggcctcagaagtatttggaaggtaaggcaagggatatggcaagccaagagaagtgggggccgtttccggatattttagctttgctgatttttggggttgtcctcttcccgaacgtcgacggtttggtggacctagccgccattgatgctttcctcgcctatcaccatagcaaggaaagtccagtggtggctatcttggcagatttgtttgacacctttgaccggagtgcgatcaattggtttcctcgttggaaggaaggcaaggaaggagttcttttctcgtgtggggactaccctaatgttccactgatagggactaggggttgtattagttataatcccgcactcgccataagacaactagggtacccaatgaggggagcgccaaccgaagaaagtctctcgcctttccctt

SEQ ID NO: 27989 - DNA, 276 bp, Glycine max
  Peptide Sequence Number=SeqID_119674
atgaaagataaaagtgaggactttgagtcccatgaaatcataaagcaaaggacgttgagtcctatgaaacaagccaatgggcactggtaccaaagggctcaaccttatgaaaaagcaagagatgcatgcaacattcatcttgaaatgctagtaatgcaaaagattgactgtctctttctgaaagacgtgataattcatgagacctcatcctatctttttgcaaatctcttcggggactccctcagagtgtatgttttgtttgatttagtcacttaa

SEQ ID NO: 27990 - DNA, 94 bp, Glycine max
  Peptide Sequence Number=SeqID_119675
atgacggcccatcattcatcggctcagccgaaggcatcccggcgcgttttcgtaggcgcctcccttggccatctcatcgaatggtacgactacg

SEQ ID NO: 27991 - DNA, 492 bp, Glycine max
  Peptide Sequence Number=SeqID_119676
atgcggggctaccgtatggttatccgcaccttttgtcatccagagacgagacggcaagtccaatggcatgcgggggtaccctatggttatccacatcttttgttatctagagacggcatgtccgatgacatgcgggggtaccgcatggttattcccacctttcgtgaaccggggcaaacgagaccgttgacgcgagagacttacgtctcttctgcaccttttgtcattgtagagacgacatgtccgatgacatgcggggacggcgagtccgatgacatacgggggtaccgtatggttatccgcacctttcatcaaccaggggaaaacgagcccgtcgacatgcagagactaacatcaccttctgcaccttttgtcatccagggacaacaagtcaggtggcaggcagagataccttatggtcatccacacctttcatcaaccgaggcaaacaaattcgacgatatcaggatgatgttggtcgtccgattctga

SEQ ID NO: 27992 - DNA, 312 bp, Glycine max
  Peptide Sequence Number=SeqID_119677
atgttggtgcacacgatctgcactcgcctctttgcagcggcacgggtgaaatcttgccccggtatgcatagtagctgtgtgatagcctccctctctggttatgctcgcgcagttggccctcctccaatatcagggggtggcccaggaaccgttaaaaggaaactactggcgagggagtgtagtcctatgatggcaatgacgtgcaatcctctaaaggtgagggcgtgtagccctacaaaggtgaaggcacatgaccctttgacggcgaggaagtgtagtcctctgaaggtgagggcgtgcagccctctgatg

SEQ ID NO: 27993 - DNA, 480 bp, Glycine max
  Peptide Sequence Number=SeqID_119678
atgaatatgtttatagataggctgagaccacaaaccaagcaactgttagatgttactatagagggaaagataaaactgaagaccccgaaagaagcaattgagctaattgagaacatgttacaagttgtaccatctgtggtgaggctcatgaaacaggccaatgtattcccactgaagaaaacactcaagaaattcattatatgggaaatcaacagcggcaaggtgatgacaacaaaagatgatgacaaaggtgatgaacaaaaacctcaaagatcaaagaacaaatcaagtgaatcaaagaacatctcaagtgaatcaagaacaagtcaagagttcaagaatcaagaagaattcaagactcaagaagaaaacctagaatcaagaatcaagattcaagattcaagatctcaagaatcaagatcaagattcaagactcaagattcaagaatgaagaaaagactccctcaagataagtattaa

SEQ ID NO: 27994 - DNA, 519 bp, Glycine max
  Peptide Sequence Number=SeqID_119679
atgaacaaaggtgacaccaactcccaagctattgtaataaaaagtgttgaggatgaagatggtgtgtttttgacaataaacgatgaggttgctaaaacaaaatgggtgatgaattatgttgtctcaaagcacatttccagagatcgaaagatgtttaatactttaaaaaccgatggacaattttgtcatttcaagttagggaatggtggaaaattgaaggttgaatgcatagggagtgtgaggataaagctccataatggtgctattcgaactttctcaaatgagaggacatcacaagggtacaagtatgttggttcaaagtggggatgtaaagtgtacaaagggatacacttggtgttgcaaggacagaaaaataaaggtaacctttgttatttggatggtcaagtcttgaagaggaaccatgataataaagtgaagaagaaagtgaagttttctaatattgtggaagtgttgggagatacttctattagaaggagagtttattcactttcaaattga

SEQ ID NO: 27995 - DNA, 498 bp, Glycine max
  Peptide Sequence Number=SeqID_119680
atgcatgaacgacaatcaattcatggggctccgaataaaagtggagaatggagaattgcactaggcaatcactacgcgtggctccagactcattggtggaggatacatgaacgacaatcaattcatagggctccgaataaaagtggagaatggagaattgcactaggaaatcactacgcgtggctccagactcattggtggaggatgcatgaacgacaatcaattcatggggctccgaataaaagtggagaatggagaattgcactaggcaatcactacacgtggctccagactcattggtggaggatgcatgaacgacaatcaattcatggggctccgaataaaagtagagaatggagaattgcactaggcaatcactacgcgtggctccagactcatgggtggaggatgcataaacgacaatcaattcatggggctccgaataaaagtgttggcaggaccgaatggtccatcgggggaaacatcgggttaagctga

SEQ ID NO: 27996 - DNA, 225 bp, Glycine max
  Peptide Sequence Number=SeqID_119681
atgggagagagcaaaaagaaaagaaaggaaattcccaatcaaagagtgggagagagcaaaaagaaaagaaaggaaattcccaatcaaagagtgggagaaagcaaaaagaaaagaaagaaaattcccaaccgaagaatgggagaaagtaaaaaaggaagaaggaaaaggaaggagagaaagttcctgatcaaggaagcagaagaaatgtgtagaaaggtcttttga

SEQ ID NO: 27997 - DNA, 228 bp, Glycine max
  Peptide Sequence Number=SeqID_119682
atgggtgagagtgaaatgctgacaactgcttgtaggaagaataaagcaattaagtctcaagctaatcaggaggggaatggtaaaataccacctcaagctgatattaagaatgtgacaaagtgtttcttttgtaagaagaaggaacacatgaagaagaattgccccaaatttcagaaatggcttgagaagaaaggatatgaaaaacttaaggaaaccagtgagaagtga

SEQ ID NO: 27998 - DNA, 297 bp, Glycine max
  Peptide Sequence Number=SeqID_119683
atgaggcagatatgccgtggtcatttgatagcacttatttttcctttcacaaagaatggagaaatagggaaccaaagcaagattttagaaagacttcattgtgatgcacaggagttgagaaacctccaaatcaccatacaagatttgatgaaaaaagtagacatgaatgagaagagcacaaaaggaaaaagtgttgagtttggtgaggtgaaagggcatcaatcaagattgacatgggtgcatttaataccaacttactgtattgccagtaagattgctgaatcaacctcatggtaa

SEQ ID NO: 27999 - DNA, 45 bp, Glycine max
  Peptide Sequence Number=SeqID_119684
atggatcgttttaaggtccaaggccttaaaaggaccaccttccaa

SEQ ID NO: 28000 - DNA, 390 bp, Glycine max
  Peptide Sequence Number=SeqID_119685
atggacgaagatcaatggatgtatgacactataatatttgaagaagttgatatggatgatcgaaatgaacaagaatgtggtgtgaatgaaccacaagttgattgttcagattcgttcaatacttctcaggtgtttggcagccgagatgatgttttgcagtgggctcgatccgttgctcatgaaaacgaatttgtggcggtcattataaggtctgacacaaacactagtagtggaggaaggagttcatttgtgttaattggttgtgaaaggagtggtgagtataggtgtaggaagaaagaatttgttagaatagatactgggactaggaaatgtggtgtcccttcaagctttgtggcaaaccagtggttggagggcaaggttggacggtga

SEQ ID NO: 28001 - DNA, 843 bp, Glycine max
  Peptide Sequence Number=SeqID_119686
gtttccgtgctaaccaccggtttggacgccccgcacgtcgacctgattgcgattttgcgcccgacggaatccgtcagcctgtatcagcagattgtcggtcgtggtctgcgcctggcaccgggcaaaactgactgtctgatcctcgattacgccggtaacccgcacgatctttactctcccgaagtgggcacgccaaaaggcaaaagtgacaacgtgccggtacaggtgttttgtccagcctgcgggtttgccaacaccttctgggggaaaaccaccgccgacggcacgctgatcgaacactttggccgccgctgtcagggctggtttgaagatgatgacgggcatcgcgagcagtgcgatttccgttttcgtttcaaaaactgtccacagtgcaacgccgaaaatgacattgccgcccgccgctgccgtgagtgcgacacggtgctggtcgacccggacgacatgctgaaagcggcgctgaagctgaaagatgcgctggtgctgcgctgttccggcatggccttacagccgggcgcggatgaaaaaggcgagtggctaaaaattacctattacgacgaggacggcgctgacgtcagcgagcggttccgggtacagacgccagcccagcgcacggcatttgagcaactgtttatccgcccgcatacccgcacgcctggcgtgccgctgcgctggatcactgtggcggatatcgtgcatcagcaggcgctgctgcgccatccggattttgttgtcgcccgcaaaaaaggccagttctggcaggtacgtgagaaggtctttgactatgaaggtcgctaccgtcgggcaaacgaattgcgtggttag

SEQ ID NO: 28002 - DNA, 219 bp, Glycine max
  Peptide Sequence Number=SeqID_119687
atgacaaaaggtgcagaagacgacgttagtctctgtgcgttaacgggcttgcttcccccctggttgacaaaaggtgcagaagacaacggcgtctccgcgttccaacggactcacagttttgtcacgatagcaaaaggtggggcggtcgacaaaagcgaggcttttgctcctacgtatcctcaatttgtgatgaggaactcagacctacgtagttcttga

SEQ ID NO: 28003 - DNA, 213 bp, Glycine max
  Peptide Sequence Number=SeqID_119688
atgggggtgcaaatagcaaccagacccacttgggccctccagaagatcctccaaaaggctgttgcttctggaggaagcaaccctgctcgcctgggcgagctgggtggcaagcttctcccccaattttctataaatagggggagaagtgaagtttcaaccgttcttcgacattcttcattcgttctacatcgatcttcagccttcaacgggtaa

SEQ ID NO: 28004 - DNA, 57 bp, Glycine max
  Peptide Sequence Number=SeqID_119689
atgagggaggtggtttccgctcagctcgcccaggaattaatgaaacattgggcttaa

SEQ ID NO: 28005 - DNA, 222 bp, Glycine max
  Peptide Sequence Number=SeqID_119690
atggaaggagctggtgacaatggtggtgtatatcatcaactggacggatctcagtgcttattactggacgcgatgactacacaaatgcaacgtttgttgaaccataacaatgaagagctctacaggcgaatagaaggactagagcaccaaatgaatccaaatgctgggagggtcaataatggatcgaaccgaatagagggcaagacagaattgagggagtaa

SEQ ID NO: 28006 - DNA, 511 bp, Glycine max
  Peptide Sequence Number=SeqID_119691
ggagttctcttctcatgtgggggctacccaaacatcccgttgataggaaagaggggttgcattaactacaatcccgcacttgccataagacagttagggtaccctatgaggggagcaccgacggaagaaagcctgtctcctttccttcttaggggcattcgtaatggcgtcgttggtggctatcatgaatggctgaaagttcgtacacgaggtttggattggctcccaagtttgagaaccgctaaaagagaggaagttgaggcaccggaggaagatgaagaggtgcaagcccaaatagtcaaagaaaggttcaaatcagcagctttgaagacccgaaaggagaatgccgaactgagagatataaatatagctaccaccaaggccttggaacaagagaccaagagggctcgtagggaagagcacggccggaacaagttccgagaggctctgtggggcagcaacaacgagcttaagctccggagagaggaaagggaccaatcacgagtagaca

SEQ ID NO: 28007 - DNA, 663 bp, Glycine max
  Peptide Sequence Number=SeqID_119692
atgagtcatcattcatctagtgttaatggtgagggtactagtcataaagaccctttatctagaatcttagatgagttgagttccctcaagttatggaaagaaaaacaagagagaaaagaaaaaggaaaaaaaagagtggaagaaataagtcaagatgaaagaaagaaaataagagaggaagaaagaagaaaaataatgaaagaaatgaaaacagaaaaacatgcctcctatagtagtcataactcttgcaagagcctaagtgaagaacttcgtgactattatgaaggaaggcataggtcacatcttagacgtcactctcataggagagaaaaggaaagaaatcctcaagaggctaacattaacctcccatacttccatgggaaggacaatgtagaggttaacttagactgggaaataagggtagagcaacaacttaaaaggaactctacttcaaaatcttatggctctaactcttatccaaagaaagaccaaggtcaaggcatcttaggggtgactccttctaagcccaaatatgatatggggaagacaatagaaaagcaaccccttaagggtagtatgcaagagaagactagctccatgaagtgctttaaatgtcttggaagaggacactttacttctcaatggcccaccatgaaaccatga

SEQ ID NO: 28008 - DNA, 835 bp, Glycine max
  Peptide Sequence Number=SeqID_119693
cgcccaatacgcaaaccgcctctccccgcgcgttggccgattcagtaatgcagctggcacgacaggtttcccgactggaaagcgggcagtgagcgcaacgcaattaatctatgaccatgattacgaattcgagctcggtacccactatggattttcgaagctgacactgaaggtgggatggcgaatgatgcttggagtgggtgcaattccttcggtagtcctaacggtgggagtgttagcgatgcctgagtccccaaggtggctagtgatgaggggtcgtttgggagaggcaagaaaagtgcttaacaaaacctcagacagcagggaagaggcccaactaaggctagccgaaatcaaacaagccgcagggatccccgagagttgcaacgacgacgtcgttcaggtaaccaaacgaagcacaggtgaaggcgtatggaaagaactcttcctctatccaacgcccccaattcgtcacatcgtaatcgctgcccttgggattcacttcttccaacaagcgtcgggcgtagacgccgtcgttttgtacagccccaggatcttcgagaaggctgggatcaaagacgacacgcataaacttcttgcaaccgtggccgttggattcgtcaaaaccgttttcatcttggcggctacttttacgttggaccgcgtgggtcgtcgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 28009 - DNA, 585 bp, Glycine max
  Peptide Sequence Number=SeqID_119694
gcaaagtttgatatcgcagaagctacgaaggtgaagacgaaggttatgtcaacagtagcgacgagatggcggcaatttaagtccacattgactagcaaatttgtgtttgctaagactgaaggtcaacaaacacaggatgttgtgacaaaatatggactagatcctgaagcgtggaaacaatttgaagaaacccgcctgacacctaactgggagggtattaggaaacgagcacaatcaattcaaaaacacaacgactgccctcacgtactttcacgtgggggatatgatttgcttgagaagaaattgttagaccagaaacgaaaaaggatacaagaggaagcattgttgagtgaaaatccagcaagtgttgatgaacccccatccccaataaaaaggcatgttaagtggaaggttgctcggaccagggctgttggcaatatgacatctgactctgcacaggaaattgcagataaaatagactccttagaagagcagcaggctcaggtgtcactattactcagtactacggaagggcatcaaggacatgcagcagctcgtccacgtccatcagccaacaacaactag

SEQ ID NO: 28010 - DNA, 69 bp, Glycine max
  Peptide Sequence Number=SeqID_119695
atgggagaaagtaaagaaagaaaagaagaaagctcctggtcaaagaaaccagaagaaatgtgcagagag

SEQ ID NO: 28011 - DNA, 213 bp, Glycine max
  Peptide Sequence Number=SeqID_119696
gtcaaacatgatatcaaaatttctaacggtgaaaatgctcggaattgggctgcaaatgtagtgctcaaatttcaggacgatccaacggtgaatgactccgagatcgtcgtttttctgagacaggttaggtggcctgcgagaaaaagagagggttttgggagaagagagaagaaacgaaattgtgaggcagaggagaatgaggagtcagtctga

SEQ ID NO: 28012 - DNA, 894 bp, Glycine max
  Peptide Sequence Number=SeqID_119697
atgggcatcattggtggttaccatgaatggctgaaagttcatatacgaggtttagattggctcgccaagttaaaagtcgtcagcgaagagagttttgaagcaccggaagaggacgaagaagtccaagctctcaaaagcgagttaggaaaggcgaaacttgccaaagagaagttcaagttggccgctacacacatccggaaggagtgtgccggattacaggaagagaatgcaactaccgcacgagcccttgaacaagagaccaagagggctcgcaaggaagagtatggccggaacaaatttcacggagctctgtggggtagcaacaatgaactcaagctgcgaagggaagagagggaccaatcgcgagcacatagcatggttttgaaggaggagttagttgcctgttcaaggtccaaaaggagcttgtctcagcgtttatgcgagacggagaccaacatgctagctatcatcgccaagtaccaagcagagttaggtctagccacggcccacgagcataggatcgcggacgagtatgcccaagtatacgcggaaaaagaggctagaggaagggtgatcgactctttacaccaagaggcaaccatgtggatggatcggtttgctcttaccttgaacgggagtcaagaacttccccaattgttagccaaggccaaggcgatggcggatacctactccgcccccgaagaaattcatgggcttctcggctattggaaaaacaccataactaaatgcgccacaaggcatccctatcgcatcagatccaaatctagaacaatgggtgatcaagaggagacacaggaacagatgaaagccgacatgtcggctctgaaagaacagatggcttccatgatggaggccatgttaggaatgaggtag

SEQ ID NO: 28013 - DNA, 156 bp, Glycine max
  Peptide Sequence Number=SeqID_119698
atggccctctacgggtcggcgttcgcttactcgaacccactcatggatactaggctgccttgtagcggcgttttccgcttgtccagagctgggaagggacgacgatttgtcaatcgtgaccctagcctctatttgcgtccatccctaagtacctaa

SEQ ID NO: 28014 - DNA, 396 bp, Glycine max
  Peptide Sequence Number=SeqID_119699
atggcaacccaagagaatgataagaagaagaagaagggaattgctcttaaagcctcatcttcaatacaagaagaaagtgatatggaatattcaattgacttggataatgatgaagaacttagtctctttgtcaaaagattcaacaaatttcttaggatgagagaaactcaaagaagacaaaacttcaaacctaaaagaaggattgaagaatcatctcaaactccaagatgctatgagtgtaatcaactcgaacatctgagggttgattgcccaatctttaagaaaagaatggagaaattcgagaacaaaaacattggagaaatggaggcaaagaaggcctacatcacatgggatgataacgacttagaatcgtctgatgattatgaaaaagagtga

SEQ ID NO: 28015 - DNA, 498 bp, Glycine max
  Peptide Sequence Number=SeqID_119700
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgagaaaaatggaagaagggagaacgtggcctttgaggaaaagagaggaaggggctttcatttcggcgtcggagcaagcaacctcgttcagtggtgtttctgggtaccgagctcgaattcgtaatcatgtcgggaaacctgtcgtgccagctgcattaatgaatcggccaacgcgcggggagaggcggtttgcgtattgggcgctcttccgcttcctcgctcactga

SEQ ID NO: 28016 - DNA, 512 bp, Glycine max
  Peptide Sequence Number=SeqID_119701
cgataaagccgacgcctggccgcgacatttgtcggggggacaacagcagcgcgtggctgatcgcccgtgcgctggcgatcaaaccgctgctgatgctgttcgatgaaccgacctcagcgctggatccggagctggtgggggaagtgctggctaccatgcgtaccttagccaatcgcggcctgaccatgattgtggtaacgcatgagattggctttgcgcgtgaagccgccgatcgcgtggtgttcatggatggtggcgtggtggtggaacagggaccgccagagcaggtgattggcaatccgcagcatccgcgtacccaggctattgccaaactgctgatcatcggtgcgcttatcgtactgctttttggcaccaacaagttacgttcactgggtggcgatctgggttccgcaatcaagggctttaaaaaagccatgaaagatgatgaatccaccgcaaccaaaagcagtgccgaagaaacgcctgctgaacgcgtcggccataaagagtaa

SEQ ID NO: 28017 - DNA, 302 bp, Glycine max
  Peptide Sequence Number=SeqID_119702
acatagtggtgcctagaaagatacgtccagagagaaatgtggtgatctaccacactgagtttgatgatttcaaagaagagcttgagagaagaaatgggcatgaagagttgaccagctttgtagaaggcagcattgatgttgccattgtaaaagaattttatgctaacctctatgatccagaggataaattaccaaaacaggtgagggtcagaggtcatctagtgaattttgacgaagatgccctcaacacattcttgaagactcttgttgatgcaatcataccccccaagggcattggatag

SEQ ID NO: 28018 - DNA, 135 bp, Glycine max
  Peptide Sequence Number=SeqID_119703
gccactcgatccaacaagtggtatcagagcaggtgttgagggaaggagcccagagtatgaaaaacctcgggatttgaggtcaaatcctttccaaggtagagggaatgatgcaatcctatcccgcaagggcattgg

SEQ ID NO: 28019 - DNA, 525 bp, Glycine max
  Peptide Sequence Number=SeqID_119704
atgcttcaggttcaggaagctaagaacaagcttgatgttcctaaagatgcagaggaaaaattgtgtgatgaaaccaaggggcataaactagatattactagtgatagagatgtccaaattttggatgatacaaagtcaaacagaagaagtggtacttctactatgggcgatgaagcaataaaattatctggttcaaataggagaccacattctgaaataactaagaactccaaaagaggaaatgcgaaagccaatatggaaactgataatttagactctgttcaggaaccaaaatcagaaacgcagttgaatactgtaccaaggaagaggggccgtaagcctaattctttaatgaatgcggaggaagcctatgatcactcatggatttctcaggaaacaaaacctgggaaatcagccaatccagaaaggcttgcaattgcagctctccttatccatcttctgaaaaacctacttctagaaaggataagttgcatagaatgcctaaaactgttagtgaaactctag

SEQ ID NO: 28020 - DNA, 387 bp, Glycine max
  Peptide Sequence Number=SeqID_119705
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggatttcaaagctcatttggagcacaaaatttcgtgctcttctctccctctcccttcattcatctccttcttcctccaagctcttatccatggcctcctatggtggtgagcttcttctaaactcatcttctccttga

SEQ ID NO: 28021 - DNA, 433 bp, Glycine max
  Peptide Sequence Number=SeqID_119706
cgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccagaaagttcttgttctagcaactacaaatacaccttatgctctagaccaggtgcacctaggagatactccccataacttggctgaaagtgattttgaacatttgactcgcaagacagaggggttttcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 28022 - DNA, 566 bp, Glycine max
  Peptide Sequence Number=SeqID_119707
tggtcatgttggtgcgcatgatccacactcgtctctttgcagcggcacgggtgaaatcttgccccagtatgcatagtagctgcgtgatagcctccctctctggttgtgcttgcacagttggtcgccctccaatattaggggggcagaggaccttaaattctcttaaggtgtggatgtggagcacactgaaaatgaggacgcgtagccctctaaaggtgagggcgtgcagtcctctgagggtgaggacgtgtagtcctctgagggtgaggacgtgcagtcctctgaaggtgaggacgtgcagtcctctgaaggcgaggacgtgtagtcctctggaggtgagggcgtgcagccctctgatggtgaggacgtgtagtcctctcaaggcgaggacttgtagtcctctgaaggtgagggtgtgcagtcctctgttggcgaggacgtgtagtcctctcaagtcctctaaaggcgataagtacaagtacccaagggtccacccttatgagaaagccagagatcgactcatcgagagggccggtcatcccaaatccacaagatttggacattag

SEQ ID NO: 28023 - DNA, 258 bp, Glycine max
  Peptide Sequence Number=SeqID_119708
atgactgcgacaatgggaagagatctcgagaaggttccccgacacttagatgcgataaggtgtaatcgacccggtcacataaaggcacactgccccacacatgaatcacggctagagaagaaaagtcatgaagaaagaagatccaagaaggcatatatagcatgggatgacaatgactcacccgatggttcggagaaggagatcaaccctctatccaaggactatgagagagatgagaacatctctcaagaagattaa

SEQ ID NO: 28024 - DNA, 923 bp, Glycine max
  Peptide Sequence Number=SeqID_119709
atggagaagctctccgatgacgagctgaaagcaaaaaccgtggaattccgcgcgcgtctggaaaaaggggaaaccttagaaagcctgatcccggaagccttcgccgtagtgcgtgaagcgagtaaacgtgtgtttggcatgcgtcacttcgacgttcagctgctgggtggtatggtgcttaacgagcgctgcatcgcggaaatgcgtactggtgaaggtaaaaccctgaccgcaacattgccggcttacctgaacgcgctgaccggtaaaggcgttcacgtggttaccgtcaacgactatctggcccagcgtgacgccgaaaacaaccgtccactgttcgaattcctcggcatgacggtcggcatcaacatgtccggcctgcctgcgccagccaagcgtgaagcgtataacgcggacatcacctacggcaccaacaacgaatacggcttcgactacctgcgtgacaacatggccttcagccctgaagagcgcgtccagcgtaaactgcactacgcgctggtggatgaggtggactccatcctgatcgatgaagcgcgtaccccgctgatcatctccggccctgccgaagacagctctgagatgtaccgcaaagtcgacaaaatcattccgcacctgctgcgtcaggagaaagaagactccgacaccttccagggtgaaggtcacttctccgttgatgaaaaagcgcgccaggtgaacctgaccgagcgcggtctggtgaaaattgaagagctgctggtcgctgaaggcattatggaagagggggagtccctgtactctccgagcaacatcatgctgatgcaccacgtaacggctgcactgcgcgcccacgcgctgttcacccgtgacgtcgactaccttgtgaaagacggggaagtcatcatcgtcgatgaacacaccgggcc

SEQ ID NO: 28025 - DNA, 402 bp, Glycine max
  Peptide Sequence Number=SeqID_119710
atgccctcaccttcagaggactacatgtcctcgccttcagagtactacacaccgtcactttcagaggactacacatcctcacctctagagggctacacgccctcacctttagaggactacatttctccccttcagaggagtacatttctcaccttccaaggacttcacgtcctcgcctttagaggaatacacgtgctcaccttcaaaggactacacgtccttgccttcagatggctacacaccgtcaccttcagaggacaacacgtcctcgccttcagaggactacacttcctcgccttcaaaggactacacatcctgacttttagaggactacacgtcctcaccttcagaggattacacgccgtcaccttcagagggctacacgccctcaccttcagatga

SEQ ID NO: 28026 - DNA, 180 bp, Glycine max
  Peptide Sequence Number=SeqID_119711
atgcccttttgcgggcgagcgaaggcgaggctcacacgtgcgctttccaaaggaggaaagatgcgcagagtcgccaccaacgaaggtattagcacctctcacgttgacaaaagcggggcttttgctcctatgtaccctccatctaagaagaaatcagacctacgtagttctttcttaagg

SEQ ID NO: 28027 - DNA, 216 bp, Glycine max
  Peptide Sequence Number=SeqID_119712
atggcctcctatggtggtgattcttctaaactcatcttctccttgaagtggcgtctcctctctctctcttccttcttcatttcgttgccattcatcttccaagaagaaaaggaatccattgatgaagaagatcctaggcctacaagctccaatggagcttacatcatgtggtatcaagagcatcttcatctaggttctatcatttttcattcataa

SEQ ID NO: 28028 - DNA, 204 bp, Glycine max
  Peptide Sequence Number=SeqID_119713
atggctactactcctgagagatcacttgagggcagaccagagcctcctactccagtggtagacctctcctcaccacagcttgcagctgacccttccactcctgtacttgacataccagaggaccagaccacactagtgctggcactaaatacctctcctccagctactccagtacttcacttgacagatgaggaggatgcttag

SEQ ID NO: 28029 - DNA, 261 bp, Glycine max
  Peptide Sequence Number=SeqID_119714
atgctttcacttgaaattagtgaggagaggaagaaagaaggagaaaatccaagccgaggtgctttcgtaacgcttccgagacgtttctgtgagcaaatccgtgaagattttccgctgttcttcaccattcttcatccgttcttcggtcttcaaccgaactatgtaggtctgatttcctcattgcaattaaggatacgtaggagcaaaagccctgcttttgttgatcacccccaagagatcgttaatggtccaacgccttaa

SEQ ID NO: 28030 - DNA, 483 bp, Glycine max
  Peptide Sequence Number=SeqID_119715
atgtgcttcaccctctcatggcataccagttttgcaggaatgtgtaaggttgtttggttgtcaaaaaacaatcctgctgattcaggatatggtacatgtaaatcctttaacaagtatctcaaccaagaaaattcacaagtggttttagccataaacctatatatgatgagggactggccgatgtgccgatggttattagtcgaccactgggatgctgttgaggcgtgcaatggctttctaggaggatttgttgccatcacttttggatgcttagttgttaaggccataggatgggtaagtgtaacaatgggccctatattctatgccttgcacaagcttgagatattgagaattcctattgatgaggaagttgttgaccttgatatctcaagtcatggagggtatgcttatgctcaagaaaaaaatgagagtgagatgattaaatatgaaaagtataaccatacatgggagattaagatttaa

SEQ ID NO: 28031 - DNA, 384 bp, Glycine max
  Peptide Sequence Number=SeqID_119716
ttaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctggggggcgagcctatggaaaaacgccagcaacgcggccttttacggtcctggccttttgctggcctttgctcacatgttcttcctgcgttatcccctgattctgtggataaccgtattaccgcctttgagtgagctgataccgctcgccgcagccgaacgaccgagcgcagcgagtcagtga

SEQ ID NO: 28032 - DNA, 490 bp, Glycine max
  Peptide Sequence Number=SeqID_119717
caaagaaggagcctctgtcaacaagttcccccgatggaaagaaggaagaaccggggctcttatttcgtgcggaggatttccaaatgttcccttgatggggacaaagggttgcatcagttacaatcccgtccgcaaggcatgggagatggtgcaaaagaaggacaaggaactcagaggcagtaacaacgggcccatcagcggctaccgtaggtggttgaaagcccacatgcaaagtctggattggctcctgagtttgagaaccactaaaggggtggaagtcgaagcaccggaggaagacgaagaggtacaggcccttagggcagaactcgagaaagcccaaacagtcaaagaaaggttcaaatcagtagctcttaagatccgaaaggagaatgccaaactgagagacggcagtaacaatgagcttaagcttcggagagaggaaagggaccaatcacgagtagacagtttactcttgaaggatgagttgaag

SEQ ID NO: 28033 - DNA, 360 bp, Glycine max
  Peptide Sequence Number=SeqID_119718
atggttaggaccagaggattaggtcgtgccttaggtcaggttactggcagaggtgtgggcagaggagatcgtgatgattctggtgatgctccgcagcgtcgacggcatactgcatctgcacagaggcagcgggtcgctgtgactgcgacgcacgatgagccagtcatccctgcgccagatgttcaggatgacccgatggaggcaccaactgctgcagaggacattgtggcagacattcctgcggacacaggcatagaggctgctgaggacgagcataagggattttcgggtggtccgagtgacccatccgtgtttaccctgtatgcgaatcacgtttcttgcagcgtatggacgagagag

SEQ ID NO: 28034 - DNA, 492 bp, Glycine max
  Peptide Sequence Number=SeqID_119719
atgggatgccaccatgttcggggtcttaatctagacttcctgctctacataaagcacgaagacctctccaaaatcgcacacggtggtcaatgtcttagcatatcaatgttacagttgtggattcttggacactggcagatggtggtcatcgtgcccaaggaacacctagttgtgtggttttgtttattgcataacaggccagacaactaccttaaggggataattatcagtgctttaaaaggtcttgatgatgctccacaacctaaatcaaaggctccggctaggtggattgtcgccaagtgtaatagacaaaaaggaagtactgagtgcggctattatatcatgcactggatgtccaccatcattttaggaagtttcaggaataactgggaagcgtattttaacgatcctagaccattggagccagagagattaaaggcgctgcggatccagtgggcacattattatctccgagttagagctcagagctag

SEQ ID NO: 28035 - DNA, 183 bp, Glycine max
  Peptide Sequence Number=SeqID_119720
atggcagtggaatggagaagaagaagagttgagaggagatgcaacttcaaggagaagatgagtcaagaagaagctcaccaccataggaagccatggataagagcttggagcccactaatccaagaccaagtccaagattctccactaagtgtgcttaggtgtcatgaggcatgtaaagcatga

SEQ ID NO: 28036 - DNA, 438 bp, Glycine max
  Peptide Sequence Number=SeqID_119721
atggtcattgaccaatcgctattctatgatttaacccaattgccaagtgaaggcgtaccatttgaaggtacactaattgatgattggaagtttgatttttctgtgcatgatgcctgccggttggtttgcaccaaccaagcggatatgaccggaaggatactttctggttcattggcttttgaaagccgcatccttcattatctaattgttcgcatcttgcttccaagatcttcaagcattgcacatgtttttgaagaagatcttattgttatgtgggcttttcataaaggcctacaaattgattgggcacatcttagatcctttctaataggtgcttcagtcattgcatcctttggttatcaaaaagagcatgatggctcttgggtgaaaaagggtgctcgacatgttggtgaagaaggacatgatggagaagattaa

SEQ ID NO: 28037 - DNA, 444 bp, Glycine max
  Peptide Sequence Number=SeqID_119722
ggtggacccttgagtactagcaccctcaccttcagaggactacacgtccttgccatcaaagggccgcacgcccttgccattagaggactacacgtcctcgccatcagagggctgcacgccctcacctttagaggactgcacgtcctcacctttagaggactacacgtcatctcctttagagggctacacgctctcaccttcagaggactacacgtcctcgccttcagacggttgcacgccctcgccatcagagtgctacatgccctcacctttagaggactgcacgtcctcacctttagaggactacacgtcctcaccttcagtggactacacgttctcaccttcagagggctacgcgttctcaccttcagaggactacacatcttctccttcagggtgaatgctgtgaaaattttctcggactcccaaaatggactcggatga

SEQ ID NO: 28038 - DNA, 126 bp, Glycine max
  Peptide Sequence Number=SeqID_119723
atggaccccaagagaataaaggtccttcctgattggccgactccaccaagtgtcgagggaaggaaccctgagtatgaagaacctcgggatttgaggttgttagtgcttagctttactgagttttaa

SEQ ID NO: 28039 - DNA, 306 bp, Glycine max
  Peptide Sequence Number=SeqID_119724
atggaacaatttctggacaaggtggcctggcatgaagcccaactccctttgggaagagcccatgaggttgttcctcccaatcctataccaacaaggacagagcctgcaccagctgagtcgcaacctccagtagtagacccacatacttctccggaggttgagatactatctcctccaccagctccaccggcaccacctttgatactcattcctgatgacgcagatgctgaaactgctcctcctcctgactcaacagcatactacctagaggatggttcagacttttctgactggatggacaattga

SEQ ID NO: 28040 - DNA, 504 bp, Glycine max
  Peptide Sequence Number=SeqID_119725
atgccgatctcccctgcggaagtatcagttggtctgtgccgtcccgacataggtaggggtcgcgcccacaagacacccagtggactcgaagaagtccaacagggccctggggtttccagttctagttatgggcctctatcaatcctacagggtgcccgtaccccccccccctgcatggtcatgccatcgcgacatagggatcgcgcccgcaggacacccagtggaaccaaagaagtccaacagggtcctggggtttccagctctgattacgggcctctatcagttctacgtagtgcctgtcaccccagcaaggtcatcaggcctcctactaaccgagctttcatcaagaagtattgcgcccccatgcaggcagagggcgagacaccacaacagcctggggatggccagcaacaggcaacaaatgcaccggcaccaactccagagcccctcagctcatccataaaaaggttagagtattgcctacgacacatggccgagcaatag

SEQ ID NO: 28041 - DNA, 697 bp, Glycine max
  Peptide Sequence Number=SeqID_119726
gctggcttcacctgactttgttcacttgatccttggaaagaagcttagcaagaagttgcttcgaaagttggagaccactctcagagtggttggagctgtgcttgatgatgccgagaagaaacagatcacaaacaccaatgtcaaacactggctcaatgatctcaaagacgctgtctatgaagccgatgacttactcgaccatgttttcaccaaagctgccacccaaaacaaggtaagagacttgttttctcgcttttccgataggaagatcgttagtaagttagaagacatagttgtcagacttgagtctcatttaaaactcaaggagagtcttgatttgaaagagagtgcagtggagaacttgtcatggaaagctccatcaacatctctggaagatggatctcatatatatggtagggagaaagatatggaggccataatcaagttgttgtcggaggataacagtgacggtagtgatgtgtctgtggttcctattgtgggcatgggtggggttggaaaaactactttggcccaattggtgtacaacgatgagaatttgaaacagatatttgattttgattttaaggcatgggtttgtgtttctcaagaatttgatgttctcaagaggattatgttgattggagtcttcttaagaaaccattcaaccgtgggattaggagaagtaagattcttctaa

SEQ ID NO: 28042 - DNA, 444 bp, Glycine max
  Peptide Sequence Number=SeqID_119727
atgaggggcaccgtgcatgagcctcaagcgaacctagggggaggacccttggatactagtaccctcaccttccgaggacaacacgtcctcgccttcgccttcatagggctatacgtcctcacctccagaggactacacgtcctcgcctttagaggactacacgtcctcaccttcagagggcttcacgccctcgccttcagaggactatacgtcctcaccttcagaggactatacgtcctcgctttcagagggctgcacgtcctcaccttcagaggactacacgtcctcaccatcagagggttacacgtccttaccatcagagggctgcacgtcctcaccttcagaggactacacatcctcaccttcagaggactagacgtcctcgtcttcagaggactgcacgcccttgccatcagaggactatgcgtcctcaccttcagatga

SEQ ID NO: 28043 - DNA, 570 bp, Glycine max
  Peptide Sequence Number=SeqID_119728
atgaccaacagattgtttgtcgggtcatcagcctttgattgccgcatcatgcactacatcattgttagaattttgttacccaattcttctaatcttgctcaagcctccaaggaggacttgattttgatgtgggcttttcttaccgattgtcagattgactgggccgacttggttaagtaccgtatgcataaggcattacggaccaatgcacctcttccgtatcctcagttagtcactctttttcttcgtcactttcaaattcctctcgatgatgaaccttttgttcaagtcaagagatcttttgccattggtgttggagcgtggaataggaaacaagattcaccaccaccggtttctgatgagcatactctgtctcctctgccacagagagatgcttcctctactcttatgcatgaagtcctttctgaactacgtggccttcgagcgttcgtaggtgaccgtttggatgccatggatgctcattttaaaggcatggatacacggattactcagcttgaagatgacatgggtttcattcgtcgttgcttcgatccacctgctgccccatag

SEQ ID NO: 28044 - DNA, 339 bp, Glycine max
  Peptide Sequence Number=SeqID_119729
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcgccgcgggcctcttcgctattacgccagctggcgaaagggggatgtgctgcaaggcgattaagttggtcgggaaacctgtcgtgccagctgcattaatgaatcggccaacgcgcggggagaggcggtttgcgtattgggcgctcttccgcttcctcgctcactga

SEQ ID NO: 28045 - DNA, 303 bp, Glycine max
  Peptide Sequence Number=SeqID_119730
atggggccctggggtttccagctctggttacgggcctctatcagtcctacagggtgcccgtaccccccccggcaaggtcacgtcatcatagggattgcgcctgcaagacacccagtggacccgaagaagtccaacagggtcttggagttgtcaagctctaaatacgggtctctatcagttcaagggagtgcctgttgcccccagcagggtcatcaggccccctaccaatcgagttttcatctagaagtgttgcgcccccaggcaggcgcagggcgagacaccacagcagcattgggatggacg

SEQ ID NO: 28046 - DNA, 546 bp, Glycine max
  Peptide Sequence Number=SeqID_119731
atggatattattccagacaagtatcccctaagcctgcagcatatcaaatttggatctaaattgtatgtcaacgctgatattacagagatacacgaatttcgtcaaagtttgtctgtgccattttattctggtgggatgatcaatgataaagatggttctcagtcccaatctagccagagtaatgtggtggaaaaatttctacagaatgctcaagtggtcagtataggtgaaatcaacaatctcagacaggattgttactgcttaactgttggaacagttgacgaaatcattattgatgctccatggagttatgacagttgtcctaactgtacaacgacatttgatccattaaaaggtggctcagcttgccgttcttgccataccagtgtggtcgatacagttccacggtataaattaaatgttaagatggagcataatggggacaaaggaaacttccttctctgggatgcaacatgtatcaagctgtttggtaaaactgctggagaatgtcgagatgagttgatagcggttggggatgatattaag

SEQ ID NO: 28047 - DNA, 528 bp, Glycine max
  Peptide Sequence Number=SeqID_119732
atggtgggttacacaccttcaagttttacagatttggtcttcactagcaaaaagatcgaagtggatccgaaaagaggcaaatttgatcatcctactaggacgactgagaaaattggggcaaataaagagggtgaggatgagggagaaacccatgctgtgactgccattcctgtacggccaaatttcccacccacccaacaatatctttactcagccgataacaaactttctccttacccaccacccagttatccacaaaggccatccctaaatctaccacaaagtctgtctaccgcacttccaatgacgaacaccacctttagcacaaaccaaaaacaccaaccaagaaccgtaaccctagccaaggttcatcaacctccatttatccgagaatacgactcgaacgcaacgtgtgcttgtcacggagaagccccggggcgttccattgagcatggtagggctctgaagcgtaaggtgcaaggtctaattgatacgggctggctgaaatttgaggagaattgcgtgtaa

SEQ ID NO: 28048 - DNA, 492 bp, Glycine max
  Peptide Sequence Number=SeqID_119733
atgatatttatggattgtcatcatcgaaaagggggagattgcggaagcaaaaacttccaagattattttgatgatgccaaagaatcaagagttaagcaaattccaaagattcaagaatcaagtttcaagaatcaagattcaagattcaagaatcaagtttcaagaatcaagattcaagaacaatcaagatcaagattcaagaacaatcaagatcaagattcaagactcaagattcaagaatcaagagaagactcagtcaagataaggtacatcctttgtggcataagtagagggtacatctacttgggttgttatactgagaacaagagagggtacatctcttgtggatcagttcaagtggagggtacatccacttggttgttcaaagagaacaagggagggtacatcccttgtgaatctttggcttgtaaaggattttacaaggttgaaagaaatctcaagaaccgttggttgcttggggactggatgtag

SEQ ID NO: 28049 - DNA, 96 bp, Glycine max
  Peptide Sequence Number=SeqID_119734
atgtcgggcaatcagtgcgacaatctatcgattgtatgggaagcccgatgcgccagatttgtttctgaaacatggaaaggaagcgttgccattgat

SEQ ID NO: 28050 - DNA, 762 bp, Glycine max
  Peptide Sequence Number=SeqID_119735
gcggcacggcacggcattatgtctgtgacgagcagtctggctggttgcccgatctgaaagacattgaaaacaagatcacggctaataccaaaggcatcgtgattatcaacccaaataacccgaccggcgctttatatcctaaagaaacactggaaggcatcatcgagattgcacgccatcatggtttggtaatctttgccgacgaaatttacgataaggtgctgtatgacggcaacacgcatacgtctattgcctcgctggcggatgatgtgctgtttgtgacctttaacggtttatccaagaattaccgcgcctgtggttatcgctctggctggatgattatctccggtgataaaaaagatgccaaagattacatcgaaggcctgaatatgctggcttccatgcgcctgtgcgccaacgtgcccggtcaattggcgatacagacagcgcttggtggctaccaaagtattaatgacctggttgcacccagtggccgcttatgcaaacagcgtgacctggcttacgacatgctcacttccatgccgggcgtgacctgcgttaagccagcagcggccatgtatctgttcccaaagctggatccagtcatgtatccaatcgaggatgaccagcagtttatcctggatttgttgctggaagaaaaagtgttgctggtgcaggggaccggttttaattggaaggcacctgatcatttcagggtcgtgttcctgcctaatatcgatgacctgacagaagccatgacgc

SEQ ID NO: 28051 - DNA, 627 bp, Glycine max
  Peptide Sequence Number=SeqID_119736
atggacctcatcaaggctgctggactgctgaaaacagtcaccaagttgggagattgttatgaaagcctagtcagggaattcattgtcaacattccctctgacataacaaacagaaagagtgatgagtatcagaaagtgtttgtcagaggaaaatgtattagattctcccctgctgtaatcaacaaatacctgggcagaccaactgaaggagtggtggatattgctgtttctgagcatcaaattgccaaggaaatcactgccaagcaagtccagcattggccaaagaaagggaagctttctgcagggaagctaagtgtgaagtatgcaatcctgcataggattggcactgccaactgggtacccaccaatcatacttccactgttgccacagggaaagctgctgcttcaggtgctgtgtccaaggatgatttgattgctgaactcaaggacacatgcaaggtgctggaggcaaccatcaaagccaacacaaagaagaaaatggagctggaacgcctgatcaaaagactctcagacaatggcgttgatgatggagaagcagctgaggaagaagaagatgcagcagaggatacagaatcagatgatgatgattctgatgccaccccatga

SEQ ID NO: 28052 - DNA, 371 bp, Glycine max
  Peptide Sequence Number=SeqID_119737
atgggtgccaagcacctcacgaggaccaaagaatggtcgcacgtcatcgagcaaaggctggtaatcgattaccagaggcctccacagtctcccagttccctttttaagcctggtaatcgattacatcccctggagctcgcctgcttaggtacatcacaggttctcactgaccgactatgcccaggttgggtcaggattggtcaagcttggttttgggcaatagcaccccacctgacgtccccaaggtctcctgacccccgcgacatatctccaggtaccactctgtggtcaacgaataaaagcaggaagtttcacccttctacacttcctcatctcaagcttgtaggattatggggtacccatcacatgtg

SEQ ID NO: 28053 - DNA, 177 bp, Glycine max
  misc_feature (7)..(7): n is a, c, g, or t
  Peptide Sequence Number=SeqID_119738
atggggnttcaaatagcaactaggcccacttgggccttccaggatgttcctccagaaggcgaaaatccaagccgaggcgcttccgtaacgtttccgtgggtgatttcgcgaagattttcaaccgttcttcgacgttcttcgttcgttcttcatcgttcttcggtcttcaactggtaa

SEQ ID NO: 28054 - DNA, 352 bp, Glycine max
  Peptide Sequence Number=SeqID_119739
atggatccactcggtgggagtcgttccctctacactccaccaaaaattgaagttcgtagtggaggggcatttggtcatggtatcgggggaggaagacgtcttggcaagttgcccgtcctctatgccatatgtggaagccgcggaggatcttgcttgtctgatacggcaatgatggtggcccgggtgatgttggggtatggctacgagcccgaaatgggtttaggcaagaacaacggcggcaaaaccagcctggtaagcaccagaggaaaccgcaggaggtttggggtaggctataaacccacacaagcggacataaggaaaagtatcgcagaagggaagaacaaaggccaag

SEQ ID NO: 28055 - DNA, 243 bp, Glycine max
  Peptide Sequence Number=SeqID_119740
atgcacaaacagcgcttggcaatcaatttgtggggctccaaactcaatggtggaggatgcatgaatgagaatcaattcatgaggctccggataagattcgttggtggaggatgcacgaacagcgctaggcaatcaattcgtggggctccggactcgatgataagattcgttggtggaggatgcacaaacagcgctaggcaatcaattcgtggggctctagactcgatggtggaggatgcatga

SEQ ID NO: 28056 - DNA, 222 bp, Glycine max
  Peptide Sequence Number=SeqID_119741
atgtttcgggcttcatccttctcagtttctgctttaccggggaacactcgggatttagaggggaagtcccacatcctcgttcccttcatcttccgtttgattcgtttcttgctcgaagttgataagcgggtcccaggtattagtaccttcgggggactcgtcatcggatctggcgttttaaaaagtaaagaagtaaacatgcaaatggatgagaatgggtag

SEQ ID NO: 28057 - DNA, 327 bp, Glycine max
  Peptide Sequence Number=SeqID_119742
atggacaaatcagaatatgtttggcaacagacatggcaatggatggcagatgatatcatattcaatcatagaaaacaagctcaacagctgagttctacttcagcaatatatggtgctggcaaatttgtttggaacaatagatatgtatactcccccaaatggtggaatttttgctacccaatgcatgcttccttggcagtggagcggctatatttccaccttgaaaatcaacaacatgtttactggacagatgatcaacaaataggtgaagtcctatcaaaaaacacaatcaaagaatcccatgttcacagcttggatgcattctaa

SEQ ID NO: 28058 - DNA, 441 bp, Glycine max
  Peptide Sequence Number=SeqID_119743
atggcagaggtctccacagaggccattgcctccctcgcccaatattatgaccagtcgttgaggtgctttacctttggggttttccagttatcactcatggtggaagagtttgaagagatcctaggatgccctctagggggaaggaaaccatacctcttctcaggattctatccctctttagctagaatttctaagatagtccaaatctcgatgcaggaattagaccacagaaagcaagtccaaaatggggtggatggagtaccgaggaaatatttggaagcaaaagcaagaatcttagcaggtaaaggcgaatgggcctcgttcatagacatcctcgcgcttttgatctttagaggggtcctctttccaaatgtggatgggttggtggacctagcggcaatcgacacttttctcgcctttcatgactgcaaggaaagcccg

SEQ ID NO: 28059 - DNA, 483 bp, Glycine max
  Peptide Sequence Number=SeqID_119744
atgctaaaagttattcaatctccagccaaatatctccagggacctgatgccgccatgctgtttggcgaatacgctaaaaacctggccgacagcttttttgttgtcgccgatgacttcgtgatgaagctggcgggcgacaaagtattgaacggcctgcatagccacaatattagctgccatgcggaacggtttaacggcgagtgcagccatgcggaaatcaaccgcctgatcgccattcttaagcagcacggctgccgcggcgtggtgggtataggcggcgggaaaaccctcgataccgcgaaggcgatcggctattaccagaagctgccggtggtggtgatcccgacaattgcctcaaccgatgcgccgaccagcgcgctgtcggttatctacaccgaggcgggcgagtttgaagagtatctgatctacccgaaaaacccggatatggtggtgatggacacggcgattatcgccaaagcgccg

SEQ ID NO: 28060 - DNA, 207 bp, Glycine max
  Peptide Sequence Number=SeqID_119745
atggttacccgcacctttcgtcaactaggggcgaacaagcccgttgacgcgcagagactaacttcgtcttctgcaccttttgtcatccagggacagcaagttaggttttactctcgtcgtccagaaacattcaagcccgaggacgcgcgagattcttctctgctgggcggggacgatcgagtgcaatggcgtagggaagtgtcgtga

SEQ ID NO: 28061 - DNA, 180 bp, Glycine max
  Peptide Sequence Number=SeqID_119746
atggactcaaggatcaccaaggttgaaggagatgtcacggttgtcatcatcaaaaaggaggagattgtagaagcaagcttcatgatgatgaatcaagttgattcaagtagttttgatgatgacaaaaagcccaagagaatgatttcaagattgagtcaacaagttcaagatcaagattaa

SEQ ID NO: 28062 - DNA, 234 bp, Glycine max
  Peptide Sequence Number=SeqID_119747
atgggggagacacatgaaattccccaccacaatctagccgacttcaagccttgcctcagatatgccactaaagggcaagcagttggtgaggaatgcctcaaggacattgaaggaggcgaagattatgcctttgctaaaggagttgttcctaatacccgaacatggtcattccctagttcaaggtgccagactttaacaagtacaaggggactacttgctccaagaaccatctaa

SEQ ID NO: 28063 - DNA, 524 bp, Glycine max
  Peptide Sequence Number=SeqID_119748
agcgtcgatttctgccacaacagtttcacatgcttccgtccagtgtggaaactcgaggttttgatagacgaagggagattgttcaagcggaagatttttcccaacaaatggagcagcgtggccatggaatgtactacacgccaccaacatttccccagtatccttcgcagatgtatcagtatcctttcgaaggtcatgatactgatatgtctgcaagcgaacattcgtatggtggtgttgcggaaacacatcctcatttttcatggccgaccatgacccattcgcagcaacatgatgccccaatggcaacacctaatgccccattagctccgcaatggaatgtacccggagcaatacctgatataggtaatttattaggtgttgatttgcgtcacgagttttctgctgaggctgagcaacaagggcggcgacagcgggcaagaagaaatcctgatcgtgaagcccgaaggtgggatcgaccatgtggcacaggctcacgccatcacggacaccataatgactga

SEQ ID NO: 28064 - DNA, 555 bp, Glycine max
  Peptide Sequence Number=SeqID_119749
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcgcctttgagggttaatgttctgtttaagcatatacaagatatgctgtctggcgaaaccgcggtgattgctgagacaggggactcttggtttaactgccagaagctgaagttgccaaaggggtgtgggtaa

SEQ ID NO: 28065 - DNA, 339 bp, Glycine max
  Peptide Sequence Number=SeqID_119750
atgtcatcgggcccgccgcctctggatgacaaaaggcgcagcggcctggaaggaagacgacgatttgtctctgcgtgccatcggacacgattgtgtctgaatggcgaaaagtgtgtcggaatgaccataatttgtctccgcatgtcatcgggccaccgcctctggatgacaaaagcgcagaatgaccataatttgtctctgcgtaccatcagacacgatcgtctgatggcgaaaaggtgtggaatgaccataatttgtctccgcatgtcatcgggctcaccacctctggatgacaaaagggcgcataatgaccataatttgtctccgcgtgccatctaa

SEQ ID NO: 28066 - DNA, 657 bp, Glycine max
  Peptide Sequence Number=SeqID_119751
atgacccaagagctggtagcccgcggagacaccttacggttatccgcacctcgtcatttagtgaccccaagtgtgattgatgagcagaggccaatgtggtcatctgcaccttttccggagatgtcagcagtttccgatggagacttttcaagtctcacaagttatccagaactacgtaggtctgagttcctcattggaggatacgtaggagcaagaccaattgcttttgtcggccgccccataatctttgtcatcccagaggcggcggccgatgatacgcgagatcccatacgtttgcacccttgtcatccagaggcggcgggcccgatgatacgcggagataccttacggttatccgcacccttttgtcatccagaggcggcaggcccgatgacaagcagagaccaagtttggtcattctgcacccttgtatcatccagaggcggcgggcccgatgatacgcggagatacagagaccaagtttggtcattctgcacccttgtatcatccagaggcggcgggcccgatgatacgcggagataccttacggttatccgcacccttttgtcatccagaggcggcgagcccgatgacaagcagagaccaagtttggtcattctgcacccttgtatcatccagaggcggcgggcccgatga

SEQ ID NO: 28067 - DNA, 270 bp, Glycine max
  Peptide Sequence Number=SeqID_119752
atgggaggtttcattcatgacattgtggatgtgaaagcggacggtaactatggatatcagtccattgccggtttattagagagatttgaagaattaaggctgtccatacttattgatgggttttccaaggttagtgtcgacaagtggatggatataacggagatgggatatgtcattgcatcaaggtataatgtttatttgaaagaccgttgtcctttatcgcctctcacattgttgtggtctaggaattgtctgcctcaggcaaagtag

SEQ ID NO: 28068 - DNA, 441 bp, Glycine max
  Peptide Sequence Number=SeqID_119753
atgacgctttccaagaaaaggaacgcagaaagaaatataaagtttttgcaggacattaaggcagcagcaattcaggaagaacctctatcttctgaggcatcttctagttttccaaaacaaagggaatctcacacagtattaattgaagccaatatcatggctgatgagccaagacgagtgaccctggaagattactcaagtacttttgtgccgcaattcttcacaagcattgtgtggctagagttaattcagaacaatttgtttcatggtctgcccaatgaataccagtatgcatatctagttacctatattgagatatgcaatactgtcagaatagctggtgtgcctgaggatgctgttagattgagcttgtttccaattttctttgtctggagaggcaaaaagatggctccaattcgtttaaaggttaataagtcttaa

SEQ ID NO: 28069 - DNA, 288 bp, Glycine max
  Peptide Sequence Number=SeqID_119754
atgtacatacaccctagtattttgctaccccacccacagtgtaaattgccaaaggatatatgtggggcaattactctaacctttttcgggaatgaatgcatgtcccaaaaaaatagcaaatatgtgcaaaccaaaatgccccatgggttgtttccttacaaaggtcacgcgctaatgccattgaggcatttcaccgaacacttggtgggcgcgcgtttaggtatcaatagcaagagaacggggacagtgtggcatgtcccattgcttcaaaatgcattatacgcctag

SEQ ID NO: 28070 - DNA, 426 bp, Glycine max
  Peptide Sequence Number=SeqID_119755
atgccggggagcagacaagcccgtcagggcgcgtcagcgggttttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccgtataaagtacttaatctatatgctactcttatgcagttctcttggcagaccacgaagattttctga

SEQ ID NO: 28071 - DNA, 435 bp, Glycine max
  Peptide Sequence Number=SeqID_119756
atgcctactgacaccagagaaattgaggctgcatggtgcatacccggccgagggtttattctaaatgctgaaggtcacctgaggaagatcctcagaaaatacctaaccacccttgctcaggtctggagtgttctatcctactccaatttgtctccgacctcccacacattggatctgactgtggatcgagctaggaccagaggagttacctctgacagtcttatctttgaatgtctgagcccggtcattaatttggcctacataaggaagaattgttggaaccctgatgatccaacaattattgttaggggggccagaagaccaagagtaaggccagctgagactccttctacatcaacggctcctcatccagtttctacatcagcagctcctcctccagcttgtattgcaacaactccttctaccccaatttaa

SEQ ID NO: 28072 - DNA, 270 bp, Glycine max
  Peptide Sequence Number=SeqID_119757
gagttgaacacagctgatattgatccgctgctacatccgctgaaagatctgttgccagttctgatcgatggggataggcatgaaggccaatcattccggttatctgagtttccctcgacaatgccggagatgttctcagatgctcttagatcgggggttgagaagtacggaagtgacagagaagtcaaccttctttgccaagggactaaactatctgctctatctgatactgaactagatgccgcaaaagtcccaactctggctcaataa

SEQ ID NO: 28073 - DNA, 825 bp, Glycine max
  Peptide Sequence Number=SeqID_119758
atgccatcgcctgctgccgccgccgctgatgctgccggccagcatctgcaggcgatcgttgccggcgccgaactgcacgccaccggtaccgccgctgatggtgccgcggttgaccacgctgctgtcgcctgcacctttgaaggcgatgccccagccagcggctgcgctgatctggccgtcgttgacgacgccgctgcccccctgcagatacagagcgtagccctgtgccgaggaaatgctgccactggcagcattgttgaccgtcaccacggcgtcggcattgatgccaccggcggtgccgctaccgacggtgccgctggccgcgatgctgccctggttgttgatggtgccgctggccgtcggggcgacgtagatcgcattggcgttgctgctactcagctgtgcgccgctctgcacgttgatggtaacgccggtggctccggcgccaagggtgactggcgttgcatcggggttgggcgcggccgcactacaggtgacggtctgcccggcggcgggggcggacgcatcgcatcccgcccaggctgccggggcggacaaggcgagcaacgacggcgccgccaggatctggaccagggaaacggtcaaacgacgccggcggaacccgggcgggacgacatgggacatacggcactcctgggtcggggatcaggaactgcggatgctatgtacggcgctactcacgcagcaaccggtcacgctttcgatgtgaaatcgggaagtgctcacgcgccccgcatatcgatgaatgcgttcaccatcattggcccgccaagagcatccacgcatggcgtgcccatggggtaa

SEQ ID NO: 28074 - DNA, 607 bp, Glycine max
  Peptide Sequence Number=SeqID_119759
atggatcttggcggcgaattcgttgagcagcgcgaccttggtgaccgcgtcggcggcctgcacctgcttgtccaggtcgccgatgccatgcagcaccagggtgccgatcagcaccggtgcgagcatgccggcgatcttgttgcagatgcccatcagcgcgatgcggcgtgccgcagtttcaatcgggccgaggatggagatgtagggattgatcgccgtctgcagcagggccagcccactgccgatcacgaacagcccgcccagcgcgccggggtaccagcgctgcgtcgggaattcaccgaagagtgccgcgccgccggccatcaccagcaggctcaggctgaggcccttcttcatgccggacaggtagaacaccatcagcaccaggaaggcgccgacctcgctgagttggaaggccaacttgacgaaggtgatcagcgggccgttgagccaggtaaagaagccgatcaggaagaacaacacgccaacgatggcgatggaggtggccacgttcgggcgcgcgcttgcagcggggacggcggacatcaggagggctcctgcggcgacggccacagaatgcggcgtcggagagtggctggaacaacgt

SEQ ID NO: 28075 - DNA, 537 bp, Glycine max
  Peptide Sequence Number=SeqID_119760
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgccggccagtgccaagcttgcatgcttgcaggtcgactctagaggatcccctgactcgctgcgctcggtcgttcggttgcggcgagcggtatcagctcactcaaaggcggtaatacggttatccacagaatcaggggataacgcaggaaagaacatgtga

SEQ ID NO: 28076 - DNA, 222 bp, Glycine max
  Peptide Sequence Number=SeqID_119761
atgttgctaagtagcaacgtcatccatatctgtgcaagagttgtcatgttggtgcgcatgatccgcattcgtctctttgcaacggcacgggtgaaatcttgccccggtatgcacagtagctgggtgatagcctccctctccggttgtgctcacatagttggccctcctccaggatcagggggtggtccaggaactgataaaaggaaactactggccccttaa

SEQ ID NO: 28077 - DNA, 417 bp, Glycine max
  Peptide Sequence Number=SeqID_119762
atggaggagggccaactgtgcgagcacaccagagagggaggctatcacgcagctactatgcataccggggcaaatttcacccgggccgctgcaaagagacgaggatcgcacccacaagacacccagtggagccggaaaagtccaacagggccttggggtttccagctctggttacgggcctctatcagtcctacagggtgcccgtacccccccggcaagggatcgcgcctgcaagacacccagtggacccgaagaagtccaacagggtcttggagttgtcaagctctaattacgggtctctgtcagttctacggagtacctgtcacctccagcaagggcatcaggccccctactaatcgagctttcatcaagaagtactgcgtctccaggcaggcgcagggcgaaacaccacagtag

SEQ ID NO: 28078 - DNA, 294 bp, Glycine max
  Peptide Sequence Number=SeqID_119763
atggtgttgtggagaggaaaaatagatcccttgaagcaggaaaaggattatgctcttgaagatgacatcaaggctgaagaacttgaacaaagcaaagagatctctaagaaaatgcctaaagaattacctatagaatggagaactcagaaagatctctctttggataacataattggagaaatctcaaagggtgtctctattcgttctagagtcaaaattctatgtaacaacatggcttttgtttctcaagttgaaccaagaaacatcaatgaagccttgtgtgatgaacactga

SEQ ID NO: 28079 - DNA, 768 bp, Glycine max
  Peptide Sequence Number=SeqID_119764
atgctctcactcgaacccttcacagaagatcagggtcggtcggcggtgcaacccacaggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgagcacgccaagggcgcgcgctgccatcacaatcgcgatgatgacgtctccacgagcatatcacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccgtttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggcaggcgtgccctcggcctaatggcttcgggcgcaacttgcgttcaaagactcgatggttcacgggattaa

SEQ ID NO: 28080 - DNA, 179 bp, Glycine max
  Peptide Sequence Number=SeqID_119765
atggcaggacctggtagggatcagaaccatgatgtcctagactgcatcacaactgtgctggaaactctagtgcaggaacgtgatgcggagccgacagagtatcgcgcactcatggctttccgtacgaaccacccgccgaagttcagtggggactatgatccagaaggtgctaagttatg

SEQ ID NO: 28081 - DNA, 607 bp, Glycine max
  Peptide Sequence Number=SeqID_119766
aaatgctctcggtaacggaagcttcgagcacactctagacctcttcgcaaagatcccaacgggtgaatctttacccgcttactcaagatactgcaggatgcctactgacatcagggaaattgaggctgctctgtgcatacccggccgagggtttattttaaatgctgaaggtcaccctgggaagatccttagaaaagatctaaccactcttgctcaggtctggagtgttccctcatactccaacctcgctccgacttcccacgcctcggatttgactgtggatagagctaggttaatctttggcctagttactcagctggacatcaatgtcggagctctcatctctggaaagatcatttcaatggcccagtctaactcctctagactcgagttccctgctcatatcacaactttatgtaggtcaagaggagttgtttccgacagcttagcctttgaacttttaagcctggtcattaatttggcctacataaggaaaaactattggaacccggatgatccaacagttattattaggggggccagaagaccaagggcaaggccagttgagcttccttctacatcagcagctctcctccagcacatatga

SEQ ID NO: 28082 - DNA, 544 bp, Glycine max
  Peptide Sequence Number=SeqID_119767
gacaatgtagaggctaacttagattgggaaataagggtagaacaacaacttaaaaggaagtctacttcaaaatcttatggctctcactcttatccaaagaaagaccaaggtcaaggcatcttaggggtgacaccttgtaagcccaaagatgataaggggaagacaatagaaaagcaatcccttaaggctagtatgcaagagaagactagctccatgaagtgctttaaatgtcttggaagaggacacattacttctcaatgccccaccaaaaaaaccatgattatgaggggccaagacatttacagtagccaagatgaggctactactttaccttcctctagtgaagagtgtaaggagacacttgttagcattgccacacctcttgggcttgagtttattcctcaagtaaaggagttgttggatgcgggggttcccatgaaccttaagagaataaaggtcattcctgagtggcctactccaccaacaccactcattgagttggtgagaaaccatgttccttcatgggaagatgcccaggaaatgg

SEQ ID NO: 28083 - DNA, 435 bp, Glycine max
  Peptide Sequence Number=SeqID_119768
atgggcccagttttgtcagacccccagagatccctcgatgtgtggaaaaaagcacaggccatccaaaagcaaaacaccgcccctcacgtgttgtctcgtgggggttatgactatttagaacagaagctgatggttgagaagacaaagaaaaaactagaggaaactgctcagtccggaagcactgagggtgtcattaaccctccatctcccatcagacgacacgtgaagtggaagatggcccgcaccaagaaaactaggctgatgtcgtctgaggttgcaaaggaaatcactgagaagattgattctttggaggagcaggcgtcacaaggttcgtttgtccctcatggacgtcaggatgtccttactgctgccattgggcgaccagaacaccctggccgtgtgcgtgctgctggagccggtgttaccatcaagtaa

SEQ ID NO: 28084 - DNA, 333 bp, Glycine max
  Peptide Sequence Number=SeqID_119769
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtccacgacggccagtgccaagcttgcatgcctgcaggtcgactctagaggatcccattaa

SEQ ID NO: 28085 - DNA, 171 bp, Glycine max
  Peptide Sequence Number=SeqID_119770
atggagtctcacacttccctgaaaagagttttgagatgtgggaagcatcatccaccttgtggcatgatagagtctacacctctttgggttctaggaagcccaaggacaaagtccatactaatgtctacccaaggtgcagatgggatgggtaagggtgtgtatagcccatga

SEQ ID NO: 28086 - DNA, 255 bp, Glycine max
  Peptide Sequence Number=SeqID_119771
atggctgttagttgggagttgctaggcgcacccagcaacattgctggtgcacccaataattatgtgaatgggctaaattgcccttctattaaaattagaaaaaaacacgcgcacccaacagttccacctttccgcctttattcatctttcttcattttgtgcgttccttcttcctccgtgcctacaaggttgctactgccatttccgttcattttgggagatttattggtgccgttgctgcgtttccgccgttga

SEQ ID NO: 28087 - DNA, 501 bp, Glycine max
  Peptide Sequence Number=SeqID_119772
atggtggtcatagttcgaccggagagggtgctacgccaatttgggtacattcagagcatccctccaccgcctgttagtgctttgttgtcatatgatgatatagatgacatgtggatgcatttctcggaccacgtatctgcagattacatggagtggtttttccagatatctcactcattcatgataccgacccaggcaggtgaccagcctagacatgcacctaccccagaccatggggactacatgcagccggacatcccacaggttccagtggcatttgacccccctcgacatgcagtggatgattacgaaggctatgaggtgatcgcagaaaggttggagcgtgtgctcaaccttaggatgatcattgtagggacaaagttacatgatatcatgcaagattgcctgaggatcgccaggggggtgccagcgcagatggaagtgttagggctcgacaaagatggcgcacagagcattgatggtgttttttatgttttgtag

SEQ ID NO: 28088 - DNA, 711 bp, Glycine max
  Peptide Sequence Number=SeqID_119773
gaaagaaagcctcaagaggctaacattaacctcccatacttccatgggaaggacaatgtagaggctaacttagattgggaaattagggtagagcaacaacttaaaagaaagtctacttcaaaatcttatggctctcactcttatccaaagaaagaccaaggtcaaggcatcttaggggtgacaacttctaagcccaaagatgataaggggaagacaatagaaaagcaaccccttaaggctagtatgcaagagaagactagctccatgaagggctttaaatgtcttggaagaggacacattacctctcaatgtcccaccaagaaaaccatgattatgaggggccaagacatttatagtagccaagatgaggctactacttcaccttcctctagtgaaagtgaagaagcaaaagggaaagaatctattgaagagatctaccctcaagaagaaggacaacctttaatggttaaggaggagtgtaaggagacacttgtttgcattgccacacctcttaggcttgagtttattcctcaagtaaatgagttgttggatgagggtttggttcgcaagagcttaaatgatgtaagctccattggagcttgtaggcctaggatcttcttcatcaatggattcctttacatcttagaagatgaatggcaacggaatggagaaggaagagagagaggagatgccacttcaaggagaagatga

SEQ ID NO: 28089 - DNA, 378 bp, Glycine max
  Peptide Sequence Number=SeqID_119774
tcgggaaacctgtcgtgccagctgcattaatgaatcggccaacgcgcggggagaaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccggattagcagagcgaggtatgtaggcggtgctacagagttcttgaagtggtggcctaactacggctacactagaagaacagtatttggtatctgcgctctgctgaagccagttaccttcggaaaaagagttg

SEQ ID NO: 28090 - DNA, 702 bp, Glycine max
  Peptide Sequence Number=SeqID_119775
atgacccaagagatggtagcccgcggagacaccttacggttatccgcacctcgtcattcagtgaccccaagtgtgattgatgagcaaaggccagtgtggtcatttgcaccctttccggagatgtcagcatcttccggtggagactttttcaagtctcacaagttatccagaactacgagcaagagccttgcttttgtcggctgccccacaatttctgtcatactgaccctgaggtcatgcgacatgcggagacaaaatttgagacaaaatttggtcattctgcaccctttgccatcaagaggcggcgggcccgatgacatgcggagacaaaatttggtcattccgcacccctttgccattcagacacagtcgtgtccgatggcacgcagagacaaaatttggtcattctgcacccttttgtcatccaaaggcggcgggcccgatgacatgcggagacaaaatttggtcattccgcaccccttttccattcagacacaggcgtgtccgatggcacgcagagacaaaatggggtcattctgcaccctttgtcatccagaggcggcgggcccgatgacatgcggagaccaaatgtggtcattccgcacctcttggccattcagacacagtcgtgtccgatggcacgcagagacaaaatgtggtcatgctgcaccctttgtcatccagaggcggcaggcccgatga

SEQ ID NO: 28091 - DNA, 159 bp, Glycine max
  Peptide Sequence Number=SeqID_119776
atgtcgcggaacttcacggattgcctaacgatgggtgtcaagttcctcaaagtggtcaagcgagggtcgcatcccacatacagatggtccccggacgaaattagggcacagaatgaccataatttgtctctgcgtgccatcggacacgatcgggcctag

SEQ ID NO: 28092 - DNA, 1071 bp, Glycine max
  Peptide Sequence Number=SeqID_119777
atggcagagccatcgaagaagagaaagggatcatcctccaccgccgctgctgctgcccatcgccgccacggaccatccgaagcacccacaacacctattcatccctctttatcatctccaagatcatccacatcgttttcatctgatgatcagcgtctacggtacctttctcaattttcttctaggatcatcttagaccttaagtacctagacgtagagttctttaatgatgaaacgtttgattgctatcaagtgtttcaaaattctggccttgttgatttcatgtcattaaaattgccaaattatcctgaacttgtaaaggtcttctacttcaatttaaaaattcaggatggcattatttcctctgaggtgcatggtatacctatgatcattgatcagtccttattcttttctttaactcatttacccagtcaatgtgcaccttttgagggcaccattgttgatgactggaagtttgattattctagtcatgatactcgccgtatggtctgcaatgaccaggctgaaatgaccggtagattgttggccgggtcattcacatttgataatcgcatcatgcactatataattgttagaattttgcttccccgctcttcaaatttagcacaagcctctgaggatgatttgattctgatgtgggcttttctcaccggtcgtcagatcgactgggcccatttggttcggtaccacatgcatatggcattacgggccaatgcacctctaccttatccacagttgataactttgtttttgcgtcattttcaaattccgcttgatgatgagccatttgttcaagtcaagcgttcctttgcaattggtgctggtgttgtgacttcctttggttaccgtatggatcggaatggtcaatggctgaagaaagacgcactccctcctcaagatgagcatactccttcacctcctcctcggcgtgaagattcagcactcctgaatgaagtccttaccgaattacgaggtcttcgtccttatgttggtgaacatttcgactcattggatacacgctttgccagcatggatattcgcctcacacaa

SEQ ID NO: 28093 - DNA, 417 bp, Glycine max
  Peptide Sequence Number=SeqID_119778
atgacaaggagtaaaaggtttgtagaggttgaggatgaggataatgttgtgcatgagaagaaaattgctgacaagaaaagtactgatggcaagaaaaatgaggtaagaggtgaaagtaatcaagaaaaagaggaacaaataatggtcaagaataaagaattgaaggaccaagaaaaagaaaaagaaatagaaaaggaaaaagtgaaaaagaagaaaaaaataataagaatgcaaagaagagtaggattgaaaaagctgtggatgaaggaaaacatcatagtggaaggaaattgtagtgctgtgatccagaagatccttccacccaagcatacagatccagggagtgtaactattccttgttcaattggggaagtcaatgtgcgaaaagctcttattgacctggtagccaagtattaa

SEQ ID NO: 28094 - DNA, 99 bp, Glycine max
  Peptide Sequence Number=SeqID_119779
atggagtcggaggaaaaactggaagaatctcagggaaccactagagatgccgctatcgctgtcaaaagagacgtgactccgcataaaggtaagggatga

SEQ ID NO: 28095 - DNA, 120 bp, Glycine max
  Peptide Sequence Number=SeqID_119780
atggaagctcttcgcgaatttaaatggctaaaggcccaagtggagaaggacgaaggcccaagtggagaacgacaccgcccccgagtggagaaggatgaaggcccaagtggagaaggatga

SEQ ID NO: 28096 - DNA, 614 bp, Glycine max
  Peptide Sequence Number=SeqID_119781
cggggcgaaggcgggggggcagtagggagaagagtaggaaaagaggtagagcacaagggggcaggggggagaaaaccagaaaacgggggaaagcgtggggtacaaagaagaagaagaagggcaaagagaggcataggcggggaaaggaggggaggaaaggggcaagaggagggaaaagcaaaacaaagccgggcggggagagacgcggcagggcggagcaagacaaccaggtagaagagggaggacggggagaaaaacggaaaaaccaaggggaaaataggcaaaaacgaggggaagagggacagcgggggaggggaggcagaaacaagcacggggggaaaggtaggggacgcggcacaggggaaggggaagggcaacgggcaaaggcacgaggaagcgaggaccaaaacaggggaagcgaggacaacggggggaaagcaaggggaacaggggaaaggcaggggaaaacgggggcaaagccagggggcgagggggaagcgaggacaacaagcggggaagcgaggaccagagaggaaaacgcggggggaaacagggggggagaaaaagccaggggcgacggaaggggggagataccggggctagacggagcggga

SEQ ID NO: 28097 - DNA, 258 bp, Glycine max
  Peptide Sequence Number=SeqID_119782
atggtgaaagaaagtgaagatgatgtaccatcaagtggagaacaacttagaaggtcacaaagagggagacaagtaccacaaacactcaaagagtatgaattgtatcctgatacagtaatcactgcagaaggggattttgtgcactttgctctacttgctgaatcagaaccaatgagtcatgatgaagcctcacaaagttcacattggagaacagctatggaagaagaattgaaatcaattaaaaagaaccagacttag

SEQ ID NO: 28098 - DNA, 519 bp, Glycine max
  Peptide Sequence Number=SeqID_119783
atgtccaccttatcacgtgccacaatccccaaatatgttcttaatttcttcttcctgtggggaccgtcggccttcccggtaacaggatcaacatgcaccactggtctctcaacaccaggtggtctagtggacaacgatcatagacgtgaggctttgcgtgtccgcttcatggcagatgtcgaagccgatgcgtccgaagtaggaggaggaggaggaggaggagtggaggcaggtattaatgcctcaacaatatcccaaactcaggcagacctcaagaaatcactgcaggagcagctatggagtgcagcccttgcctatgaatctatgttgaggcaaaaatccagagtgaagtggttaagagaaggggacagaaattcatcctatttccacagaatcatcaatcatagaaggagggttaatgctcttcaaggtctgtgtattgatggaggatggatccatgaccctaacagtgtcaagattgcagttcttcagcactttaaagaaagattctcaaagtag

SEQ ID NO: 28099 - DNA, 423 bp, Glycine max
  Peptide Sequence Number=SeqID_119784
atgggttcttcacctgcctccactcctcctcctcctcctcctcctacttcggacgcatcggcttcgacatctgccatgaagcggacacgcaaagcctcactggtgcatgttgatcctgttaccgggaaggccgacggtccccacaggaagaagaaattaagaacatatttggggattgtggcacgtgataaggtggacatcacctacgagaactggaagaaggtccctactactcagaaggacctgatttgggaggatattcgggcagaatttgatatcccagaggcttctgacaacctcacgaggaaatgggcccttgcagccaatcaggacggtgtcgaggacactgtctgtgacaaatacggcatcagcaaggaaaagtgggtccagttttaccagactcgcagagacccttcttgggag

SEQ ID NO: 28100 - DNA, 349 bp, Glycine max
  Peptide Sequence Number=SeqID_119785
atgttgaagaacggtcgagaatcttcgcgtaattactcacggaaacgttacggaagcgcctcggcttggattttcttcacggaaataattttcctcagcaatttcgagagagggagaagtgccaagaaggctgaaccctttttcttcttcactcctccccttatttatagcaaaataggggaggagcttgccacccagctcgcccaggcgagctcagctcaccctggcgagcaaggttgcttcctccaaaagcaacagccttctggaggaaggatctggaaggccaagtgggccagattgctatttgtacccccctttttactatatgcaccacccttctatttttttg

SEQ ID NO: 28101 - DNA, 423 bp, Glycine max
  Peptide Sequence Number=SeqID_119786
atggaggagaaggaaaagaaacaattggaggaagctgttaaatctagaagcactgacaccgtcattgatcctccatctcccatcagacgacacatgaagttgaagatggcctgcaccaagaaaactgggaaaatgacatttgaggcaacaaagcaaattgctaacaagattgattccttggaggagcaggcctcagagggttcctttgttgcccatgaacgtcaagatgcattgacttcttccattgggcgactagaacaccctagtcgtgtgtgtgctgctggagtcggtgtcacaatcaaacaatactttggaccggctccaaggacctcccgcatgtcttcatccatggctctagaagtcctggagtacctgacgcaatacacagggaccagctggaggagtcaatcacagaaaaagtga

SEQ ID NO: 28102 - DNA, 399 bp, Glycine max
  Peptide Sequence Number=SeqID_119787
atggttaggaccagaggattaggtcgtgccttaggtcacgttactggcagaggagatcgtgatgattccgatgatgctccacaacgtcaacgacataccgcatccgcacggaggcagcgagtacctgtgactacggcgcacgatgagccagtgctccctacgccagatgtagaggctgacgtagttccggatgacccgatggcaccagctgatgtagaggacactgggacagacattcctgcagacataggcacccaggctgctgaggatgaacatgagggattttcggggggtccgagcgacccatccgtgctgacccagtatgcggatcatgttgcttgcggtgtatggacgagagaggagcgtcctgagttgaagttatcctctcatgggaggaag

SEQ ID NO: 28103 - DNA, 295 bp, Glycine max
  Peptide Sequence Number=SeqID_119788
cggttatgcgagacagagaccaacatgttagctatcgtcagcgaataccaagaagagctaaatctagccactgcccacgagcataaagtggcagacgagtatgcccgagtgtacgcggaaaaggaggctagaggaagggtgatcgacgcgttacatcaagaggcaaaaatgtggatgaaccgatttgcccttaccttgaacgggagtcaagagcttccccgactactagccaaggccaaggcaatggaggacatctactccgcccccgaggagatccacggacttctcagctatt

SEQ ID NO: 28104 - DNA, 545 bp, Glycine max
  Peptide Sequence Number=SeqID_119789
tacttggaaggcaaggcaagggatatggcgaatcaagaggagtgggtcccgtttgcagatatactagctttgctaatctttggggttgtcctctttccaaacgtggacggtttggtggacctagccgcaattgatgctttccttgcatatcaccatagcaaggagagcccggtggtagctatgttggtggacttatttgatacatttgaccgaaggtgcgagaagaacagtgcacggattgtctgctgcttacctgctctttctgtatggctggggagcactgacgtaagagagcctctcgccattccttgtgagagatttcggtgcgcaatgtctcaagattgtacaaagagtccacaaggcgtgggaaagcccgatgaagtagtccaagctcaaaaatcagagctaggaaaggcaagactcgccaaagaaaagttcaagtcagctgctacaagcatccggaaagagtgtgccgagttacgacaggaaaatgcgactaccgcaaaagcccttgaacaagaaaccaaaagggctcgcaaggaaga

SEQ ID NO: 28105 - DNA, 249 bp, Glycine max
  Peptide Sequence Number=SeqID_119790
atgggtggtggtgcatggccgttcttagttggtggagcgatttgtctgatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgagcggttcgctgcccgcgacgttgtgagaagtccactgaaccttatcatttag

SEQ ID NO: 28106 - DNA, 219 bp, Glycine max
  Peptide Sequence Number=SeqID_119791
atggctgagataaaagaggtgcaagagcaaatgaaggccaatacggaggccttgaaggatcaaatggcctccatgatggaggccatgttaagattgaagcgaatgatggaaagcaattcggtcgtagttgctgccactagcgccgccgccaaggcagatcctacccatccattcgccataaaccaagtgaaccaactgatcccgtacatgatggattga

SEQ ID NO: 28107 - DNA, 552 bp, Glycine max
  Peptide Sequence Number=SeqID_119792
atggatgcaagaggtgcgcttagcgggatgagctcttgctcagcttgcatgtataactcatccttcttccatattcttcctcgtgctcagtcgcaagaatgctttggtgaccccaattcaagaatgcttcaaagtgtccaaaaagcatggaatgcggtgcaaagaaaggacaagaagcttagaggaagcagcaatgggatcattggtggctatcacatgtggctgaaggctcagacgcaagagataacttggttcccaaagctaggggtttcaagtgaggaagagactgaggtccctgaggaaagcgaagaggtgcaagccttaaaagtggaactggaaagaacgcaagtagtcaaggaaaagttcaagacggcagccatcagagtcagaaaggaatgtgacgagctgagggatgtcaacacaactacagccacaacattggaacgagaaacaaagagggcccgaaaagaggaatggggccgaaacaagttccgaggggctttatggggcagcaatagcgaactcaagctccaaagggctaagagggactag

SEQ ID NO: 28108 - DNA, 102 bp, Glycine max
  Peptide Sequence Number=SeqID_119793
atggcgtatgggaggtatttgactgctcgtgtggcctttggtagaggtcccagtatgtctattccccacatggcaaagggccaaggggatcacaaactgtga

SEQ ID NO: 28109 - DNA, 477 bp, Glycine max
  Peptide Sequence Number=SeqID_119794
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccgagcgaccttgctattcgaccaggcaactggcgaaaaccaaggaagtga

SEQ ID NO: 28110 - DNA, 917 bp, Glycine max
  Peptide Sequence Number=SeqID_119795
ggttgaaagccgtcgccttcagaggactgcacgccctcgccatcaaagggctacacgccctcgccttcagaggactccatgtcctcgccatcagagggttacacgtcctcatcttcagaggactacacgtcctcacctttagaggactacacgtcctcgcctttagagggttgcacgccctcgcctttagaggactacatgtcctcgccatcagagggctgcatgccctcaccttcagaggactacacatcctcacctttgaaggactacacgtcctcgccttcagaggattacacgtcctcgccttcagagggctacatgccctcaccttcagaggactacacatcctctccttcagagggctgcacaccctcgccttcaaagggttgcacgtcctcaccttcagagggctgcacgccctcgccttcagagggttgcacgccctcgccttcatagggcgacacgttctcgactttagagggctacatgccctcacctttagagggctatgtgtcctcactttcatagtttccctttatcaattccttggccaccctactgatctcggaggagggtccactgtgcaagcacaaccagagagggaggctatcgtgcaactactatgcatactggggcaagatttcgtccttaccgtcggccctggggtttccagctctggttacgggcctctgtcaatcctacaggggatcgcaccggcaagatacccagtggacccggagaagtccaacagggtcctggggtttccagctctgattacgagcctctatcagttctacggagtacctgtcccccccagcaaggtcatcaagcctcctactaaccgagctttcatcaaggagtactgcacccccaggcaggcgcagggcgagacactgcagcagccaggggatggctag

SEQ ID NO: 28111 - DNA, 366 bp, Glycine max
  Peptide Sequence Number=SeqID_119796
atgaattgcattttcgttcatgcgtcctccattttcgagtttggagccatgcgtagtgattgcttagtgcaattatccattctcaatctttttcggagtcccatgaattgcgttttcgttcaagcgtcctccacccacgagtttggagccatgcgtagtgattgcttactgcaattctccattctcaaccctttttcggagcccatgaattgcgttttcattcatgcgtcctccacccatgagtttggaaccatgcttagtgattgcttagtgcaattctccattctcaaccctttttcgaacccccatgaattgcgttttcgttcatgcctcctccatccacgagtttggagccatgcgttgtga

SEQ ID NO: 28112 - DNA, 582 bp, Glycine max
  Peptide Sequence Number=SeqID_119797
atggctcccgaagaactcgagcagctgactcaacaaatcagggaccagctggaggagtccatcacagaaaaagtgactcggcagctgatgttatccttcagccagatgcagtcccaactgcaatcacagatccaatcacaaggacttgcactacctctggagcctgaggttggtccctcagctgcttgtgtcagcacaaaagggagttgtgttgatcgctcaccgaccgatctagacatgggtgactcagacaaattcgggttgtatattgaagaaaatccttcttgcctggttgctctaggaagagtttatgagggatccacagtggttcacaacatccctttgttgcatggccaagtaaaggttggtgctgaggaggttaaagatgcagaggctctcgttcctgtacccactgacaaggttattttagtggggcagacaattaacaccttccttgcttggccaacacatctcgtgaagcgtttatcagaacaggcagctgtgtctctagcaaaacctccagataggccagatcatgaggtcgaggatcccttatatttgatgacattgaccatcccatag

SEQ ID NO: 28113 - DNA, 318 bp, Glycine max
  Peptide Sequence Number=SeqID_119798
atgacagatcttgtgagcgcggaagatgacacagcaaaaaagaatgtttatacggataaccactcgggtatttccgcccgtcagcgtgactcaaatgtcagtatgacagatcttgtgagcgcggaagatgacacatcaaaaaagaatgtttatacggataaccactcgggtatttccgcccgtcagcgtgactcaaatgtcagtatgacagatcttacatcaaaaaagaatgtttgtacggataaccactcgggtatttccgcccgtcagcgtgactcaaatgtgagtatgacagaacttgtgagcgcggatgatgac

SEQ ID NO: 28114 - DNA, 576 bp, Glycine max
  Peptide Sequence Number=SeqID_119799
atggttatgggagattcatcagcagactctctttccccggtaaacgcattgtttttcactccaaaaagcatatgctgctctaaatcagtggaatatttgtctcttgctaaagcatgtttgcgttttagtggagaaaacaccgagactttttcaagtctcacaagttatccagaactacgtaggtctgagttcctcattggaggatacgtaggagcaagagcctcgcttttgtcgaccacaccgccttttgtcgccatgactcaagagctggtagcccgcggagataccttatggttattcgcacccttttgtcatccagaggcggcgggcccggtgacaagcagagaccaagtttggtcattctgcacccatgatacgcggagataccttacggttatccgcacccctttgccattcagacacagtcgtgtccgatggcacgcagagaccaagtttggtcattctgcacccatgatacgcggagataccttacggttatccgcacccctttgccattcagacacagtcgtgtccgatggcatgcagagaccaagtttggtcattctgcacccatga

SEQ ID NO: 28115 - DNA, 1529 bp, Glycine max
  Peptide Sequence Number=SeqID_119800
gtgtgttcgctggattcgcgcatcagcaggccgtaaatcaggccgccgaccatcgaatcaccggcgcccacggtgctgaccacctcacaggacggcggtttggcgatccaggcaccggaggcgttaacccacagcgcgccttccgcgccgagggagatcaccacgtgggcgatgccctgctcgcgcagcgcatgcgcggcctcgaccacgtccgccagcgccggcagcgggcggccggcccagatctccagctcgcggcggttcggcttcaccagccacggcgaggccttcaacccagcgaccagcgcttcgcggctgctgtcgaaaatgatgcacggacacttggcgcgcagctgggtcatccagtcggtaaaggcatcgggatcgacgccggccggcaggctgccgctcaccgccaccatgtcaaactggcccagccagctcagcgagtcgctgacgaagcgatcccagtcctgcggcgtcacttcaaaaccggagaaattgaaatcggtgacttcgccgtctttttccgtcagcttgacgttgatgcgggtgcggcccggcactacctggaagcggttggcgatccccagatcgctgaacagcagctggaaaccgtcctgattgtctttgcccaggaagccgccgacggtgacgtcgatgcccaaatccttcaacaccttggcgacgttgatgcccttaccggcggcgtgcaggccggcggtttttacccggttgacttccccgcgttcgatctgcgggcaaaaccccaccagatcgtgatgcccttttttcacgcccagcgccaccaccttcatcaggctgcgcccgttggccggcttgccgctgccgtccaggttggtgacggtgatgtcactgttgaaacttttgatcacgttgaccagcgccgtgcccggccgtgcgtgcaggccgtgctcgttgcggatcacgaactcggcgctcagtacgctgctctcctcggccacttcgctggtcagcagcgccagcaccccggcggcatccgccttcagcaggcgttcagctttgtgggccagcagcaggtcgctgagcgccaccggctcgccgtcttccacgaaagcctgcgccgggcggctgacggtggccgcgctggccaggttgccttcaacgctgtcgctcagccagatgccctgccccaggttcagcggcttgcgggtaatggcatcgctgacgaactgcgcgttgaccgcgccggccttttgcagccggccggcgttcagcgcctgcagcgtcatcaggctgtcggccgcgacgtcgagcgcaatcagcgaaacgtcgaactggaattcggcgctctgctgctcgcccatcagcaggccgcgcagctcttccgcggaggtggttttcgccagccgctccgccacgccgtcatcgctcagcacgtgagtaagctggcgcagcagcgccaaatgctcgtcggaacgggcggcgatgccgatcgccacataggcggtctggccttcgccccaggcgatgccctgcggaactga

SEQ ID NO: 28116 - DNA, 77 bp, Glycine max
  Peptide Sequence Number=SeqID_119801
atggctccacctaaagaaagtgcggccatcatttaccacaatggtcacattgtagatgacccagttcaaggatcgat

SEQ ID NO: 28117 - DNA, 231 bp, Glycine max
  Peptide Sequence Number=SeqID_119802
atgggaaagctagaagatgcctcagaagatcgaggttcttcttctggagttgttgctggttttaagtcctgcaaaaattttctaattctctatgcgttgcgcctcctgcaagtagcgttaatctccaaattgatggggatcaaatcacatgcagtagatcttctctgcatacaagagaaacaaaacaacaattatccagttcaaaagaacaataaaatgtgcaataactaa

SEQ ID NO: 28118 - DNA, 312 bp, Glycine max
  Peptide Sequence Number=SeqID_119803
atgcacatcaggcagcagacgcaccgccaccacctcggcaggccgatccaggtgggccactgggcgtggagtgttatctatagcatttggctcgccagcaagcggccaaccaccatgggcaggtgcagatacatgagtgtctctaccggttcagcctcagtcagcaggggcagggtcgcatggcctggagactggcccgatgccctggcaggggaggagcctgcaggatcccccggtgaggcagatgaatcccgtatggaggaagatatgactaacctgctcggtttcttgggagggagcggagccgtgtga

SEQ ID NO: 28119 - DNA, 276 bp, Glycine max
  Peptide Sequence Number=SeqID_119804
atggttgcttctggaggaagcaacctagctcgcctgggcaagctaggtggcaagctcctcccctattttgctataaatagtgggaggagtgaagaaggaaagggttcagccttcttgacacttcatattcacttaaaattactgaggaaaattgtttacgtgaagaaaatccaagccgaggcacttccgaacgtttccgtgggtgatttcgcgaagattttcagccgttcttcgtcattcatcgtttgttcttcattgttcttcgatcttcaaccg

SEQ ID NO: 28120 - DNA, 240 bp, Glycine max
  Peptide Sequence Number=SeqID_119805
atgctacaatgcgaagggttttgctctaatctcagatattattttgaaattcccaaaggtgaaaatgttcggaattgggttgagaatgtggtactcaaatttcacgacgatccaacggtgaacgagtccaagatcttcatttttctaagacaggtttggtggtctatgggaaaaagaaagggttttgagaggagaaggggaaaaacgaaaatgaggcccaaaaagaggcacctgacttaa

SEQ ID NO: 28121 - DNA, 502 bp, Glycine max
  Peptide Sequence Number=SeqID_119806
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatgcatgcaagcttggcactggccgtcgtttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 28122 - DNA, 549 bp, Glycine max
  Peptide Sequence Number=SeqID_119807
atgtcaccttatatatctgcaaagcgtaaggcaagtgagggaaaacaattcttaattgttggtacaaaaaaaaaagcagcggattcagtagcacgggctgcaataagagctcggtgtcattatgttaataaaaagtggctcggcggtatgttaacgaattggtatactacagaaacacgacttcaaaagttcagggacttgagaatgcaacaaaagacggggagactcaatagttttccaaaaagagatgccgctatattgaagagacatttagctcatttggaaacatatcttggcggcattaaatatatgacggggttacctgatattgtaataatcgtcgatcaacaagaagaatatacggctcttcgagaatgtataactttggaaattccaacaatttgtttaatcgatacaaattgtgacccggacctcgccgatatttcaattccagctaatgatgatgctatagcctcaattcgattaattcttaacaaattagtatttgcaatttgtgagggccgttctagctatatacgaaattcttga

SEQ ID NO: 28123 - DNA, 750 bp, Glycine max
  Peptide Sequence Number=SeqID_119808
atggtaccaactattgaagagtttgaggagatattaggatgccctcttggggggagaaaaccgtatcttttctccgactttcttccttccttgagcaagattgcagttgtgattggagattcagcaaaagagttggatcgcatgaaacaaactcgcaatggaatagtgggcctggcacggaaatacttggaaagcaaggcaagggatatggcgagccaagagaagtggggcccgtttgcggatattttagctttgctgatttttggggttgccctctttccgaacgttgatggtttggtagacttagccgccattgatgctttcctcgcatatcaccatagcaaggaaagtccagtggtggctatcttggcagatttgtttgacacctttcccccgcgcggtgtgaaaaaaatagtgcacggattgtctgttgtttacccgctctctgtgtatggtcgatttcacacctattccaacaagacacgagacacccgtgtccgcttcaaagttatcgctcatgcgccgaaaaggaagagtcgattgggaccaacatttggctgggatagggggcagcgatcaattggtttcctcgttggaaggaaggcaaggaaggagttcttttctcgtgggagcgtcaacagaagaaagtctctcgcctttccttgtgagggatctaggcgcgtgtcataccctaatttcgtccggggacctttgcttgatgacatgcgacctttctttggtccttgtgag

SEQ ID NO: 28124 - DNA, 339 bp, Glycine max
  Peptide Sequence Number=SeqID_119809
atgagtcttcattcttcatctagtgttaatggtgagggttctactcctaaggaccccttgtataagatattagatgagttgagatcccttaagttgtggaaagtaaaacaagagagaaaagaaaaagcgaagagagaaaagttccattggctacccttagctttcaagggtatgccctctattggtggacttcccttgttagggaatgaaggattcatgggaatcctccagcagagtattggaatgatcttaagagtgcccttaggaagaggcgcatttcctcctactatgaaagggagcttatggacaagctccaaaggcttagacaagggagtatga

SEQ ID NO: 28125 - DNA, 252 bp, Glycine max
  Peptide Sequence Number=SeqID_119810
atgggtaaagcagaggaggtgcaagagaaggtgaaggccgacatggaggccatgatgagcatgaagaagataatggaagccaatgcggttacaattgccgctaccagcactgttgctaaggtgaacccgatgcccccatctggcctcaaccaaatgaatcatccaaccttagatattgtaggcaaagatttgggaagtagggacgaccctcataatgtgcaaaatcaaaacaagcacgccttcccaccataa

SEQ ID NO: 28126 - DNA, 311 bp, Glycine max
  Peptide Sequence Number=SeqID_119811
atgccttatttgcaagacccgataccgtcaattcttacgattgcatgggaacaggttcatcttcgaagtatttttcccttccaatatttttctattggagcttctctgattccttttattgaacataatgatgccaatcgagctttaatgagttctaatatgcaacgtcaagcagttccgctttctcagtccgaaaaatgcattgttggaactggattggaacgccaagtagctttagattcaggggtttccgctatagcgacacgaggaaacatcatttataccaatactgacaggatattttttatttg

SEQ ID NO: 28127 - DNA, 213 bp, Glycine max
  Peptide Sequence Number=SeqID_119812
atgccacatcctatcagagcgttgtgtctcgacatccttcagcacaagggagaccagtcagggtcacagtgttttgcgagaatgctccaaccatatgggatcaacataggcttaaaggagcactcaaaccgtgtgacccccaaggcctacactccgaagagtatgtcagggcctctcactcctgattcaggtccaacccagaaaacattttaa

SEQ ID NO: 28128 - DNA, 360 bp, Glycine max
  misc_feature (78)..(78): n is a, c, g, or t
  Peptide Sequence Number=SeqID_119813
tccctgtcgggtttcgccacctctgacttgagcgtcgatttttgtgatgctcgtcagggggccggagcctatggaaanacgccagcaacgcggcctttttacgctgataccgctcgccgcagccgaacgaccgagcgcagcgagtcagtgagcgaggaagcggaagagcgcccaatacgcaaaccgcctctccccgcgcgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 28129 - DNA, 252 bp, Glycine max
  Peptide Sequence Number=SeqID_119814
atgcttagactaaatgggcctaagtggctatgttggaagccagacccaattgttagtggagacgtcatggcccatattcaagagaaaaagctgaagttaatgcgtatcaaaagggggttgagtgggatgaaggaaaccaacttaactaacactactacactaatgcaacaacctctagcacaagttgatggagtacaagcctcagtaacactagacaatgaagatggacgtgaaggaattagatggtcttaa

SEQ ID NO: 28130 - DNA, 186 bp, Glycine max
  Peptide Sequence Number=SeqID_119815
atggcacatcagcgacgcgagggcttatgggtgcgtcttccaagggaggaaggcacgcgaagtcgccaccaacgtttattcgaggaaaacgtcggaaaaaccgaaatgtgtggtctacgaactttgagtgtgaaaggttcgggaattgtttttacacacggggaagggtgtttccctcgctcctag

SEQ ID NO: 28131 - DNA, 306 bp, Glycine max
  Peptide Sequence Number=SeqID_119816
atgttttcttggttttggatagttcatgatgtttggatgttgtggaagcttggaggaattgatggggacccggtgttgagaggaacgaggataagggctacgtgggagtacgtgagctcagttgaaggtgggcaactggggatggtggatttatgtgtgatttgtggatgtggagagtcgacttgcaccatcgcccaatcgctacctagtaccacatatgacggagtggtacctggagatatgtcgcgggggtcaggagaccttggggacgtcaggtggggtgcttttgcccaaaaccaagcttga

SEQ ID NO: 28132 - DNA, 464 bp, Glycine max
  Peptide Sequence Number=SeqID_119817
atggcggaggtctccatggaggccattgcctccctcgcccaatattatgaccagcctttgaggtgcttcacctttggggacttccaattaacacccgtggtggaagagtttgaagagatcttgggatgccctatgggaggaaggaaatcgaaagacgccataactaagtgcgccccaaggcatccctattgcaccagatgcaaatctaggacgatgggtgacctagaggaagtacaggaacagatgaaagccgacatgtcggctttgaaagaacaaatgggttccatgatggatgccatgctgggaatgaaacaacaaatggagagtaacgcggccaccgccgccgctattagttcggttgccgaggcatacccgactctcccgactgttgcacaccaccctattccaaacatggtgggacgagagagaagcacaccggggcatatcagcaacccccgtctgag

SEQ ID NO: 28133 - DNA, 474 bp, Glycine max
  Peptide Sequence Number=SeqID_119818
atgacaattgaagagtctatacatgtttcctttgatgagtctaatgccattcttccaaggaaggattttttagatgatatttcagattccttagaagatatacatattcatggaaatgactctaaagaaaaagatgaaggaagcaatgaagattctcaagataatggagttagagcaaataatgaacttccaagagaatggaaagcctcaagagatcatcccctcgacaacattattggtgatatatcaaaagggaaggcggttgcttctggaggaagcaaccctgctcgcctgggcgagctgggcggcaaccacctcccctattttgctataaataggggaggaaggcaagaaggaagggccgaggcgcttccgaaacgtttccgtaacgttttccgtgaagaatttcgcaaaggtttcaaccgttcttcgacgttcttcattcgttcttcatcgttcttcgatcttcaacgg

SEQ ID NO: 28134 - DNA, 558 bp, Glycine max
  Peptide Sequence Number=SeqID_119819
atgaggggagcgccaacagaagaaagtctctcgcctttccttgtgatggatttaggcgtgcaaagtctcaaggtgatacaaagagtccacaaggcgtggagaagtctgttgagaaaagacaaggagcttagaggcatccgtaatggcgtcatcggtgttatcgatgaggagaacttcgaagctccggaggaagatgaggaagtccaagctctaaaattagagctagggaaggcaagactcgccaaagaaaaattcaagtcagctgctacacacatccggaaggagtgcaccgaattacgagaggaaaacgcgaccactgcaagagcccttgaacaagaaaccaaaagggcccgcaaggaggaacatggccgagagaaattccgaggagctttgtggggtagcaacaatgagctcaagctccgaagagaggaaagagaccggtcacaggtgcacgacatgatcttaaaagaagagttagctgcttgcgcaaggtccaagaggagtttggctcaacacttggaagccacggagcaaagcatgcgggcgatcatagggtag

SEQ ID NO: 28135 - DNA, 339 bp, Glycine max
  Peptide Sequence Number=SeqID_119820
atgacggtgaaaacctctgacacatgcagctcccggagacggtcacagcttgtctgtaagcggatgccgggagcagacaagcccgtcagggcgcgtcagcggatgcgtaaggagaaaataccgcatcacgcgccattcgccattcaggctgcgcaactgttgggaagggcgatcggtgcgggcctcttcgctattacgccagctggcgaaagggggatgtgctgcaaggcgattaagttggtcgggaaacctgtcgtgccagctgcattaatgaatcggccaacgcgcggggagaggcggtttgcgtattgggcgctcttccgcttcctcgctcactga

SEQ ID NO: 28136 - DNA, 258 bp, Glycine max
  Peptide Sequence Number=SeqID_119821
atgtcgccacacgggggcgacatggatgggggtgaaaaaaggaaagagagggatggggtttctcttgcttttggcatagcgggccccggcgggaggcccgcacgacgggctattagctcagtggtagagcgcgcccctgataattgcgtcgttgtgcctggactgtttaggtttggcctcaatggaaaaaacggagcacctaacaacgtatcttcacagaccaagaactacgagatcgcccctttcattctggggtga

SEQ ID NO: 28137 - DNA, 309 bp, Glycine max
  Peptide Sequence Number=SeqID_119822
tcaagctcccttctgcctttgcactcgagggccaatctccgtctggcccgaggaaacctttgcacgcctccgttaccttttgggaggcctacgccccatagaaactgtctacctgagactgtccctcggcccgtaggtcctggcacaaagttacggccgccgttcaccggggcttcggtcgtcggctcccctgtcatcagtcgcccgggcctggtcactgcgaccccctttgtgaggaggcaccccttctcccgaagttacggggctattttgccgagttccttagagagagttgtctcgcgcctctag

SEQ ID NO: 28138 - DNA, 429 bp, Glycine max
  Peptide Sequence Number=SeqID_119823
atgacagtcaccgctttaggagcattgtgcaccagcagcgcttcgaagccatcaagggatggtcgtttctccgggaagcgacgcgtccagctcagggacgacgagtatactgatttccaggaggaaatagggcgccggcggtgggcaccactggttactcccatggccaagtttgatccagaaatagtccttgagttttatgccaatgcttggccaatagaggagggcgtgcgtgacatgagatcctgggtaaaggggtcagtggatcccgttcgatgccgacgctatcagccagctcctgggatatccgatggattttgcccggactgctgccggaagacgggtgcggatcatgcgcaccaacatgaccaccctgactcagatatggatgactctgctgctcagcaacatcctgcccaccgatcataa

SEQ ID NO: 28139 - DNA, 433 bp, Glycine max
  Peptide Sequence Number=SeqID_119824
gtcggaacaggagagcgcacgagggagcttccagggggaaacgcctggtatctttatagtcctgtcgggtttcgccacctctgacttgagcgtcgatttttgtgatgctcgtcagggggccggagcctatggaaaaacgccagcaacgcggcctttttacggttcctggccttttgctggccttttgctcacatggttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctctggaaccgtgtagagttcttcgtttag

SEQ ID NO: 28140 - DNA, 394 bp, Glycine max
  Peptide Sequence Number=SeqID_119825
atgattatgaggggccaagacatttatagtagccaagataaggctactacttcaccttcctctagtgaaaatgaagaagcaaaaggggaagaatctagtgaagaaatctacccccaagaagaaggacaatcattagtggttaaagagaagtgtaaggaggtaagtgtttcctccaagaggttagctaaaatggaaactcattttacaataaagacaaacattaaagaaaatttccctcttagacaacctccacatcttctcctttgtaaaaagacacttgttagcactgccacacctcttaggcttgaggttattcctcaagtaaaggagttattggatgagggtttagttcataagagcttaaatccttgtgcttttttggtgcccaaaatag

SEQ ID NO: 28141 - DNA, 369 bp, Glycine max
  Peptide Sequence Number=SeqID_119826
atgggtaatgtagaggaggcgcaagagcagatgaaggccgacatggaggccgtgaaagagcgaatggccacaatgatggatgccttgatgagcatgaagaagataatggaagccaatgcagttacagttgctgctaccagcgctgttgctaaggtgaacccgatgcccccatctggcctcaaccaaatgaatcatccaacctcagctatggtaggcaaagatttgggaagtacgggcggaccccattatgcgcaaattcaaaacatgcacgccttctcgccatatggctcgactcccaaggaggatgtcaataactccgatcccatactcattgaaagtcgacaacctcatcatgcacatgtctcttaa

SEQ ID NO: 28142 - DNA, 636 bp, Glycine max
  Peptide Sequence Number=SeqID_119827
aggaaaatgcggctactgcaagagcccttgaacaagaaaccaagagggcccgcaaggaagagcatggccgagataaattccgaggagctttgtggggtagcaacaatgagctcaagctccggagagaggaaagagaccagtcacgagtacatggcatgatcttaaaggaagagttagttgcttgctcaagatccaagaggagtttggctcaacacttagaagccatggagcgaagcatgctagctatcataggacagtacaaggaagagttaaaccagtctttgacccatgaacaaaaactagtagaggatttcgcacaagcgtacgccgaaaaggaagcaagagggagagtgattgatgcattgcatcaagaagcaaccatgtggatggataggtatagtcctcaagcctacccttatggtttgactctggacttcactccccataccgctccagacgatttgagccaagcccctaccttcgaggggcaaatccctccttatgccgactatcgtctgcaagaagatgatgaaggagatgcccatctaggccctctacttcccctcaaggatccgggcccccatgaattgccccaagcaaacatagtccaccatgtcccgtctctacccgtcacct

SEQ ID NO: 28143 - DNA, 824 bp, Glycine max
  Peptide Sequence Number=SeqID_119828
atgatcgtacgtcctcatcaacactggtttctccggttgtttgactggcatggctcagtgctgtctcgcattgcgttccgcctgtcgcttaacctgctgatgtcagtgatcgccattctgggttatccctggtattccacgctcggcattcacctgaccaccgcgccgttcagcctgattggcgtgtcgatagctatctttcttggctttcgcaataacgccagctacgcgcgctttatcgaggcgcgcacgctgtggggcaatatgcacattactcagcgctcgctgctgcgccaggtgaaaacgctgcgcggactgcgtgcggaacaggtgcaggagtttatcgggctgcagctggcatttagctggagcctgaaacaccggctgcgtaaaaccgatgcccagcccgatctgcagcggctgctgccgcccgcgtggcacgccgcggtgctcggccatccgatgccgacctcgcaaatcatgttatgcatgggcgaatggctggcgcagcggcgtgatgagggattagtgacggatatcgtctggcagagtattgatgacaacctcaatcatctgtcggcgtatctgggtggctgcgaccggctggccagcacaccgattcccttcgcctacagcctgattctgcaccgcacggtgtatctgttctgcaccctgctgccgttcgcgctggtggccgatttgcacctgatgacgccgctggtgtcggtgtttatttcgtatacctttttgtcgctggagtcgctggcggaggagctggaagatccgttcggcaccgcgcccaatcacctgccgctggatgcgct

SEQ ID NO: 28144 - DNA, 204 bp, Glycine max
  Peptide Sequence Number=SeqID_119829
atgctggtgcgcatgatccacactcgtctttttgcagcggcacgggtgaaatcttgccccggtatgcatagtagatgcgtgatagtctccctctctggatgtgctcgcatagtgtggatatggagcacactgaaaatgaggacgcgtagccctctaaaggcgagggcgtgcagtcctctgatggcgaggacatatagcctctaa

SEQ ID NO: 28145 - DNA, 897 bp, Glycine max
  Peptide Sequence Number=SeqID_119830
acggccaccgcggcgcggtgccgtggtttaccgggctgtccggctcgggcaaatccaccgtcgccggcgcgctggagcaggcgctgcacgggctcggcgtcagcacctatctgctggacggcgataacatcggcgcgagaacattcgccgagtgggggaagtggccaaactgatggtggatgccgggctggtggtgctgaccgcgttcatttcgccgcaccgcgccgagcggcagatggtgcgcgagatgctcggcgacgatcgctttatcgaagtgttcccccgacacgccgttggcgatctgcgaggcgcgcgatccgaagggattgtataaaaaagcgcgcgccggcgagctgcgcaatttcaccggcatcgacgcgacgtgttgcgtggtcaggctattatcaaaccctgaattcaaaaaaagcgtgtggcgtttttcgccatgcgctttttactctaagccgccgcagagcgagccgaataaccagggatcactatgcaaaatgtcacgcctatcttgatcgactccaagcagtcaaaacaggagagagaggagccttcttattctttcctgggcggcgtcagcggctttgttttctactggctggcgttcgcgttgccgttcctggtttacggttccaacacgctgtttttcctgctctatacctggccgttcttcctggcgctgatgccgctgtcggtgctgatcggcatcaccctcagcatgctgttgcgcggtcgtctgattttgacgctgctgctgaccggcgccatcgtgctgtgcctgttctggctggtgttcagcttcctgaccgggtggtgagagagcgggcgccgatggccggcgcccgaaggattgcaaagcggtgccgaaggttacaaaactttgcttag

SEQ ID NO: 28146 - DNA, 471 bp, Glycine max
  Peptide Sequence Number=SeqID_119831
atgctttgtggtacaagtagagggtacatctacttgggtttgactgagaacaagagagggtacatctcttgtggatcagttctagtggagggtacatccactagggtttcaaagagaacaagggagggccactcgatccaacaggggggtgcagatgaccatgattggtctctgcgtgtcaacaggctcacttgcctttggttgacgaaggcacggataaccatgaggtgtctccacgtgccatcagacttgccgtctttggatgatgaaggtgcggataaccatgaggggggtgcagatgaccatgattggtctctgcggtccaacaggctcgcttgcctttggttgatgaaggcacggataaccatgaggtgtctccacgtgccatcagacttgccgtctttggatgatgaaggtgcggataaccatgaggtgtctccgtgtgtcattggacttgccgtctcaaaatag

SEQ ID NO: 28147 - DNA, 621 bp, Glycine max
  Peptide Sequence Number=SeqID_119832
atggacatgaatctgggatacctcatctcccaccagatttctatcattgcccaacatgactcctctaggcttgtatttccagccttaatcacaactttgtgtaaagctagaggagtctcatcagattctagatctttggagagtcttagccctgccattaacttggcatatataaagaagaactgttggaatctagatgacccaacagtgacattcagagggccaaggaaggccaggggtaagagatctgaggctccccctacttcagcagcaccaaatgcttctgctctttcttcatctactttaccagatccttcagtaccatccacttcgactccacaacttccacagtttccagttcagctcctagcttcttctgctcctgcatcatatttcttgtttactccagagatgcttcactccatgatgcagagcctccacagaggacaggttattcttatgcaaagatttcagagtctaggcatgccttctattatgcctatggaggatttccatgcacaggtgccctggccaggagtccaaccttctccttttagagggggtggggcctgcgcagcccaggaacctgactctgctgagccagtggaggagcacacatag

SEQ ID NO: 28148 - DNA, 137 bp, Glycine max
  Peptide Sequence Number=SeqID_119833
atgaaagtcggcgtcggccaggaaagacgaccatcgaggtctaaaaaagaagcttcaccggatgatgccgatcgaacatatcctaatcgacatcatccaactgttattcagggattgaatagaataaacaatggccg

SEQ ID NO: 28149 - DNA, 261 bp, Glycine max
  Peptide Sequence Number=SeqID_119834
atggcttattccctagtggatgacacctcctctcacctcttctcctttgtcttccgctgcatctccatggtggaaagtgggggggtaaaggacctcattgaagctcaaagatccagcctccatagaagccccacaagcaagcttccatcaagtggtaatcagagcacaagagcttcaaagtttccaccgattaaacttgctatagaagctagatttgattttctatggttcaaatttcttgttcttgttcttgaaccatga

SEQ ID NO: 28150 - DNA, 432 bp, Glycine max
  Peptide Sequence Number=SeqID_119835
atgccgggagcagacaagcccgtcagggcgcgtcagcgggtgtttggcgggtatcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccatcattgcatgccatggattttaaaaccagctactcaagctattatgcaaaaatgggattactcgggaaaatga

SEQ ID NO: 28151 - DNA, 499 bp, Glycine max
  Peptide Sequence Number=SeqID_119836
atggctactagtgatattgccatcttaagagacagagcccacatcccaaccaagaagagcctattggagcttacatcacaggatgcgttgttggcgcataacaagttgcaagatgtacaatctatgggggagcacatgactctggatgttgtatccctagtgaagaaccaattgttcatgaagtcaactacatggggaatcagcccagaaatactagaccagggtggaccgtccaataggcctcagcagcaagtgcctagtccctatgagcgtaccattaagctagaagagactctagctcagtttatgcaggtttcaatgtctaaccagaagagcatggagtcttccattaagaatctggaggtccaagtgggccagctcgcaaagcaattggcggataggtcgtcaggcagctttactagaaatattgagaagaattcgaaggaagaatgtaaagctgtaatggcaaggagcagaatggaaattcaagttgatgacg

SEQ ID NO: 28152 - DNA, 804 bp, Glycine max
  Peptide Sequence Number=SeqID_119837
gggaaggtgttcgccgggtggtatccgacggcggcggacgcggacgccctccggatcgaagcgcgggtgaacggcgcggatgccgtggtctgcaccgatcagcagctcgagttgttcgcggcatggaagaccgcagagcagaacgctgccgacgcggtgcgcgtgccgatcctcatgtaccaccagttcacgagcaagccggacggggagtcgggctggttgcgcggcaactacgcctacatcggcgacttcgacgcgcacatgaaccacatcgcgacgacggggttctacctgccgacgtgggacgagctcagcgcgttcatcgacggccggctgtcgctcccggcacggagcgtcgtgatcaccgatgacgacgccgaccagacgtggttcgatctcgccgtgcccgtgattgcgaagcaccggctgctggccacgtccttcatggtcacggcgtaccgctccgacccgccgccctcgatctacgtcctgcggcgctcgcacacgcacgacatgcaccaggccggcgacaacggcaagggacggatggtcaactggaccgccgagcagatcgcttcggacctcgcccgctccggggacgtcctcggcgtccgcgaggtgatcgcctatccgttcgggcacgtcaacgacaccgccaaacagggcgtcgcgcaggccggatacgagatggcccgcaccatcgagccggggtatgtgcagatcggcaccgacaagctcgccctccccgtcgtgcgcatcgactacgggatgggactggacgcgctggtgtcgcgcatcggctga

SEQ ID NO: 28153 - DNA, 357 bp, Glycine max
  Peptide Sequence Number=SeqID_119838
gtactagtaccctcaccttcagagggctacacgccctcgccatcagtggactgcacgccctcgccttcagaggactacacgtcctcacattcagaggactacacatcctcacctttagaggactacacgtcctcgccttcaaagtgctacatgccctcacctttagggggctacaggccctcaccttcagagtactacacgtcctcaccatcagagggctggacgccctcgccatcagaggactacacgtccttaggggcagagggctacgcgccctcaccttcagaggactacatgtcctcgccttcagaggactgcatgtcctcttcttcagaggactacatgtcctcaccttga

SEQ ID NO: 28154 - DNA, 127 bp, Glycine max
  Peptide Sequence Number=SeqID_119839
gtagtgggaaatgcaactatagaaaaacctagagaagaatggaatgatgatgaaagaagaattgaaaaatccgacaagaggaatctcaaagaaaagaaagaaaagaaaggatacatcaaatgtgaat

SEQ ID NO: 28155 - DNA, 369 bp, Glycine max
  Peptide Sequence Number=SeqID_119840
tactgcacgcagagacaggtccagggtgatgctccgcaggccgcagacgtgccgccacctcatcaggctggccgagatggatcatttgatacggagcagtatttacggcatttggttcgccagcaggcggccaaccaccgggcgcatgtacagacccatgattgtctttaccagttgagcctcagcctgcagagtcagggttttacttcttttccatgccctactccggatcagttcagggcagtggtcgcttggcccggagattggccagaggcaccagcagtggctcccgatgaggcagatgaggcccgcgaggacgaggagatgaccgatttgcttgatttcttgggagggagcggagccacatga

SEQ ID NO: 28156 - DNA, 483 bp, Glycine max
  Peptide Sequence Number=SeqID_119841
atggccacaatgatggaggccatgatgagcatgaagaagataatggaagccaatgcggttgcaattgccgctaccagcattgttgctaaggtgaacccgacgcccccatccggcatcaaccaaatgaatcatccaacctcagatatgcacgccttcccgccatatggcttgcctctcaactatacgccacccaatgtggcgtacactcccaataagaatgtcaataactccactcccatactcattaagagccaacaacctcaatctgatcatgcacatgtctctcgacccatggaggagacgcatgaaattccccaccacgatctagctgacttcgagccttggctcggatatgccactgaagggcaagcagttggtggtataccctttgaaaacactttggagggccctcagtttcgcccacaaccacaaccattgcattttgcggtgggaagagcccctcctgctatggccgaaaagtga

SEQ ID NO: 28157 - DNA, 243 bp, Glycine max
  Peptide Sequence Number=SeqID_119842
atggaagacctcataccggagcataatgaagagttgggggaatgcatccaacacctagattcctcaaaggaagtgctagaaaataaaatagaagatccaggaaccttgattaaagaaaaacctatcttagaattaaagcccttgcatcctcaccttaaatatgtctttttaaagggcgaggatgagaaactagccatcattagcagcacattgcacaaagaggaagaaaagagactaacgaag

SEQ ID NO: 28158 - DNA, 375 bp, Glycine max
  Peptide Sequence Number=SeqID_119843
atggtgggttacacaccttcaagttttacagatttggtcttcgccagcgaaaagatcgaagtgggtctgaaaagaggcaaatttaatcatcttgctttgatgaatgagaaaactggggcaaatgaagagggcgagaatgaaggagaaacccatgttgcaactgccattcctacatggccaaacttcccaccaatcccacaatgtcattactcagccaataacaacccttctccttacccaccacccagttatccacaaaggtcatccctaaatcaacaacaaaacccacctaccacacaaccaatgctaaacaccacctttatcacaagccaaaacaccaaccaagaaatgaattttgcagcgaaaagcctgtag

SEQ ID NO: 28159 - DNA, 279 bp, Glycine max
  Peptide Sequence Number=SeqID_119844
atgggattgcgcaaacagcactgcggaacactacggcattcgtcttggtgccgggctacgcgtctatgtcgatgcacagatgcagcgcctggtgctggagcgacactatccgaagtatggcctgtgtggcacacatcttccgttgaagtgtttgttaatgagggagaagcgtgcctcagcagccgtatttatcctgatgaagattgccgtgatctggcgctgtttgcctggacggggggagcatcactcatccatggcggggcctggcaactggagtaa

SEQ ID NO: 28160 - DNA, 558 bp, Glycine max
  Peptide Sequence Number=SeqID_119845
atggttaaggaggagtgtaaggaggtaagtgtttcctccaagaggttagctaagaaggaaagtcattttgcaataaagacaaacgttaaagaaacttcacctcttagacaacctccacatcttctccattgtaaaaagacacttgttagcacttccacacctcttgggcttaagattattcctcaagtaaaggagttgttggatgacggtttggttcataagagcttaaatccttgtgctttggtgcccaaaataggtattatgaggcaccaaatccctatgataggtggtctgatgaatgtgttgaatggtgcaaccctcttttgtaaaatcacccatgcatccaacatcttcatgattcacataagtagggactcattaggtagtgatcaatgggttcccacagaccctaagagaataaaggtcattcctgagtggcccactccaccaagtgttaagggaagaagtccagagtttcaagaacctctagatttgaggtcaaatccttttcaagggggaggggatgatgcaatcctaccccttaagggtattggatag

SEQ ID NO: 28161 - DNA, 777 bp, Glycine max
  Peptide Sequence Number=SeqID_119846
atggacctcatcaaggctgctggactactgaagacagtcaccaagttgggagactgttatgaaagcctagtcagggaattcattgtcaacattccctctgacataacaaacagaaaaggtgatgattatcagaaagtgtttgtcagaggaaaaccaactgaaggagtggtggatcttgctgtttctgagcatcaaattgccaaggaaatcactgccaaacaagtccagcattggccaaagaaagggaagctttctgcagggaagctgagtgtgaagtatgcaattctgcataggattggcgctgcaaactgggtacccaccaatcatacttccactgttgccacagaatcctttgctgttaaattacccattgccttcccaactgtattgtgtggcattatgttgagtcaacatcccaatattttaaactacactgactctgtgatgaagagagaatctcctctatccctgcattacaaactgtttgaggggacacatgtcccagacattgtctcgacatcagggaaagctgctgcttcaggtgctgtatccaaggatgccttgattgctgaactcaaggacacatgcaaggtgctggaggcaaccatcaaagccaccacagagaagaaaatggagctggaacggctgatcgaaagactcacagaaagtggcattgatgatggagaagcagctgaggaagaagaagaagctgctgaggaagaagaagatgcagcagaggatacagaatcagatgatgattctgatgccaccccatga

SEQ ID NO: 28162 - DNA, 231 bp, Glycine max
  Peptide Sequence Number=SeqID_119847
atggcagcggaatggagaaggaagagagagaggagatgccacttcaaggagaagatgagtctagaagaagctcaccaccataggaggccatggataagagcttggaggaagaaagagatgaatgaagagagaggaagagaagagcacgaaattttgtgctctaaaagagctctgaaatttgaacccactaatccaagatcaagtccaagattctccactaagtgtgcttag

SEQ ID NO: 28163 - DNA, 357 bp, Glycine max
  Peptide Sequence Number=SeqID_119848
atgagtgagatacgaaggtttggaggtttgggaatggaggaacgtcgcaagagaaaaggggctgcgcagggatgtctggaaaatgtgatatttatagagcaggacgcgtggaggaggcagcctactggtaatcgattacatgaatactgtaatcgattacaggccatatgttctggtgtaatcgattacagtattcatgtatacgatcaagaaggataccatagtcagataattgttgcttcatccataaaatctgtgcacaacaactgccggcagaaatatattccgcttcagcagtggacaaagcaacacttttttgtttcttactatgccatgagacaagagcggatccaatga

SEQ ID NO: 28164 - DNA, 474 bp, Glycine max
  misc_feature (419)..(419): n is a, c, g, or t
  Peptide Sequence Number=SeqID_119849
atggctgctagtgatcatgctatcttgtatgatagaactcatacccaccaagagaagcatgttggaactctcttcacaagatgcattgctgtagtatttatggaggagctcatgaatccggttgttgtataccctaagatgatgctgctaaagagttaccggcaaggagggagtttcaatcaaaatcaagggcaaggatggaggtcacatccaaggaatcagttcaacaaagatcaaggaggaccttccaacaaacctcctaatcaagggcctaacttgtatgagaggaccaccaagctggaagaaactttggctcagtttatgcaggtttcaatgtctaaccataaaagcactgagtcagccatcaagaacctggagatccaagtgggacagctagctaagcaaatagctgggaattnttctggaggttttggagctaacactgagaaaaatcccaaggaagaatgcaaggct

SEQ ID NO: 28165 - DNA, 1125 bp, Glycine max
  Peptide Sequence Number=SeqID_119850
atgttgttgggaaaaccttcacaacttctctttcttcttctccttgttttcatctttgaaattgcatcacattctaatgcataccctttatcaacacataagagatggattatagatgaagccacagggcaacgtgccaagttggtgtgtggcaactgggctggccacctcaaaccaatgatccctgagggtctagacagaaggccattgaaggacattgtttctgagcttgtggagcacaagttcagctgcgttcgcctcacctacgcaatctacatgtggacgcggtatggcaatggcaatgtgaacgccacctttgactctttggatgcacctgaggttgtggaaggcattgccaagaacaacccttctgtgttgagcatgacacatgttgaggtgtttgatgccgtggttcatgagcttggggctcagaatgtgaaggtgttgcttgataaccatgtgagttatccaaagtggcactttaatcctcaggaatgggtgcatggccttactttggcagccgagcacttcagtggaaatcatgctgtcgtggcaatgagtttgagaaatgaattgcatggtccacgccaaaatctacgagattggtacaggtacatgaaccaaggagcactagccatacacaaggcaaacccaaatgtgcttgtggttatctcaggtttgaactatgacactgagttgcagtttcttaaaagtaaaccattgaagataggcttaggtaagaaaatggtgtttgagacacatttgtattcatggtctggaattgggacactcaaattgaaacagatatggacaaaacaaccactgaataggatttgtgccaatagcattaagggaatagaccacagagctgggttccttaccgctggcaagaatgcaagtcctttgatctttacagagtttgggtttgatgagacaggttcttcagtggaagacaacaggttcttgacatgccttcaaacctatcttgttggaagagatttggactggggattgggggcatttcaaggtagctactatacttggcatcacctgagtaaccccaacttcactgacaagttccaacttctacaaaggaagaatcaagttattatatcgagttattaa

SEQ ID NO: 28166 - DNA, 1140 bp, Glycine max
  Peptide Sequence Number=SeqID_119851
atgggagaagctacagaaaggtatgcagttgtgacaggtgcaaacaaaggaattggattagagatagttagacaattagcttcagctggaatcaaggtggttctcacagcaagaaatgaagaaaggggtctcaaagcactggaaacagtcaaggactcaggtctatctcaccttgtactgtttcatcaagtggatgtggctgatgcaacaagtgtagcttctctggcagattttatcaaatctaaatttgggaaacttgatattctgattaacaatgcagggattagtggagttgtaattgatgacactgatttaatcactacagtcatcaagaatcgtggggctaaaccagaatatgatgggacaaagggagtaactcatacatatgagttagccgaagaatgcttgcaaataaattactatggcgctaaaaaaactacagaatcccttatgcccctcctccaattatctgattcgccaagaattgtgaatgtctcatcctctctgggacagttagagagtttgccaaaaggatcatgggccagaggagtcttcaatgatgttgataaccttactgcagagatagtggatgaaatattgaacaagtttctcagagatttcaaagaaggttcattggaaagtaaaggctggcctaagtatctgagtgcctatattgtctctaaagctgctatgaatgcctatactagaatccttgcaaagaaatacccttcattctgcatcaatagtgtttgccctggctacgtcaagacagatataactgccaacaccggcatcttaacagttgaagaaggtgctgctagtcctgtgaggttgcttcacagcacagctaaccaggttgctctcatgtcaccagcggaggtcgagttgccaggctcccaaatcaatcactcgctgccacagaagggcatgtcgtccaagtccaataggtgcaagcgatggagccaagaacacaggttgtttctgcttgggcttgagaaacatggaagcggagattggaaaaacatttcaagaatcattgaaacaagaaccccacttcaagttgctagtcatgcccaaaagtatttccttcgtcaggcattgggcgataaagccaaaagaagaagcattaatgacatatga

SEQ ID NO: 28167 - DNA, 1191 bp, Glycine max
  Peptide Sequence Number=SeqID_119852
atgcaatacaaattaacacgaagggatcacaactcaactccaagcaaggaaagacaccagagacagaaacaaagaaggatgagtaaggtgaagattttggttgtgggaggcacaggttacttgggtcagcatctgctacaagcctatgttcatgccaatgccaataatggaactccttttgctttcgatctcgctttcacccatcactcctctcctcctccccaacctctgttggatgccattcctttctctcttccttttcaagtggatttgaaaactggctttggatttgaagccatttccaacacttttggtcaggccaatgtagataacccagtctttttctgggttgacactgagtggcttacacctttgatttttgcctccctttcctctcaacttgatagccactcattaatcattcttcttgccatgcacaagtgtgagtatgatcatcctgatgtggttgtcaattgtgctgccatctcagttcctcgtgcttgtgaaattgatcctgctactgcacatgctattaatgtgccatcgtctctagtaaaatggttgcaaagctttgaaaagagaagtactcttctcattcatctctccacagatcaagtttatgaaggggagaagtccttttacaaggaagaagacattgctgttccagtaaatgtttatggaaaaactaaagtggcagcagagcagttcatttcagaaaattatccgaactttgcaattttgagaagcagtatcatctatgggccacaaacagtctcaccagttccaaaatctcttcctattcagtggattgatggtgcccttgctaaaggagaaaaagtggagttctttcatgatgagtttcgttgtccaatttatgtcaaggatcttgtaactatcatactaactttaactagccaatggatatcggagggcaagcaaatgcaattgttacttaatgttggtggagctgatagggtgtcacgtttacaaatggctgaggctgttgcagaatttagaggatatgatgcctcattaatcaaatcagtgtctgcctcatcggttgatcgaggggtgaagtccccagctgatatatctatggatatcactagattggttcaaaccctaagaattcatcctgtttcatttaaagatggagtgagattgacactcacaaccgaggctaggcaatga

SEQ ID NO: 28168 - DNA, 138 bp, Glycine max
  Peptide Sequence Number=SeqID_119853
atggcgggatgggaggggataggagagagagaggtgtcccgcccttggagatggcgggataggagagagggggtggtcccgcccttggagttggcgggacaggctttcatggcagcatgcgtatacacaaacacgtaa

SEQ ID NO: 28169 - DNA, 2010 bp, Glycine max
  Peptide Sequence Number=SeqID_119854
atggaagggttactgaattctttgcataaccaaagttgcttaaaaccctttggtttcactcccagacttggttataccttccccgtgatcacaagaactgggcatttaaatcgaaaacccgaatcctgcaccttgagaagtaactgtgcacaattaggtagagacaccagcactagctctagaggggctattgttgctgcattgtatagtaatgataaaggagagggttctaatacagactgggaatcggagttcctcggggaacttgatccgtttggttaccgagctcctaagaaaagggaaaaagaaaagaggtcaatgttgcttgaagccactgacggaatggattggtgtgtgagggcgagaaaggaagcactgaaatcaattgaagcaaggggcatggctcatctgatggaaaatatggttactgttaagaagaaaaagaagaaggataagaaaaagttggaaagcaagaagaaaatagttaagaaaattgagaaaatagaagatcttgactttagtttggaggaagacttgccacagcctatggaaactgagattgatgttggtgatttgaaaaggagagtgagtatatttaatgatggaatgtttatagaaaagaaggagaaaacaaaggaagaatttgtcaataggctttctcagttctctgggccatctgatcatagaaaagaaatcaacttgaacaaagcaattacagaagcacagactgcagatgatgtgttagaggttacttatgaaacaattgttgcagttgcaaaaggccttagtccctcacctctatccccattgaacattgccactgctcttcatcgcattgctaagaatatggagaaggtttctatgatgagaactcgaagattggcttttgctcgacaaagagagatgtctatgcttgtgagcattgccatgacagccttacctgaatgctcagctcaaggagtctctaacatatcttgggcattgtccaaaattggaggcgagctgctttatctttctgaaatggatagaattgcagaggttgcactgaccaaggttggggaattcaactctcaaaacattgctaatattgcaggtgcctttgctgcaatgcagcattctgctcctgatcttttctcagagttttcaaaaagggcttcagacataattcacactttccaagaacaagaacttgctcagcttttgtgggcttttgcttctctatatgagcctgctgaccctatatttgattctttagacatagtcttcaaagatcatagccaattgagaggttgcataggtgaaaagacatcaaataatcatgaacaaataagtgttgatagaagtggtgcctcaaatggatctcttggctctcctgtactaactttaactagggatcagcttgggactatagcttggtcctatgccgtctttggacaaatggctaggagtttcttctctcatgtctggaaaactctcagccattatgaggagcaaaggatttcagagctgtatagggaggatatcatgtttgcttctcaggttcatcttgtaaaccagtgcttgaagcttgaattcccacatcttcagttgtcattatgtggtgagcttgaggataaagttgctctttctggaaaaactaaaaggtttaatcagaaaataacttcatcatttcagaaagaggttggacaccttcttgttagcaccggccttgaatgggtcaaagaatttgttgtggatggttacactttggatgctgtgattgttgataagaagcttgctctggagattgatggtccaactcatttctcaagaaatactggtgtaccattaggacataccatgttaaaacgccgatacatcactgctgctggttggaaagtcgcatcaatatcctatcagaagtgggaggaacttcaaggagcattcgaacaagtagagtatcttagtaaccttctcaaaaatcatctagatgaagtatatgacgaaactacatccaccgaggtaaagtga

SEQ ID NO: 28170 - DNA, 600 bp, Glycine max
  Peptide Sequence Number=SeqID_119855
atggcgatacaagccttgcaagctaatgccgccaataccaatggcgggacatgtgccaacgtggacagtcccgtcattggctcttgcgatataccctccatgagcccatgccgccagtacgaatggcgggacatgccaacgagactagggcacgttattgctttgcaggagactagggcattgttgttgcattggttagggcaatcagaagcatgtagcaggagaaagagcacacgaaaattgaagaagaaagcaaaggatagcactgcaggaggagagaagcttagcaatttcggggaggaggaactcaaaaatgctcaacgttcaacaacacctaacgttcaaaaagcaacgttcaaaaatgcagcatgcaagcctagggttgaaacctaccccctgcaacactgcacccttgcaacactgcatgcaagcctagggcagaacttgtctcgccaatgggacaggcgagacctgctcacgggatgccaagtcagtagggttctcgctagcagcaatggtggttcctacgtggactacgtctcgcccgtcacaatggcggcatcaaaccagtttcctacgtggactgtgtctcgcttgtaa

SEQ ID NO: 28171 - DNA, 1086 bp, Glycine max
  Peptide Sequence Number=SeqID_119856
atggaacatgcagataaaggaaaagaatcatcaaatagtataaatgaagtagaagtcactaattctccaattatttgtggccttccagatgatatttctcttatgtgcctcgcaagaattccaagaaaatatcattctgtcatgaagtgtgtctcaaagagatggaggaacttgatttgcagtgaagaatggttctgttatcgccgaaagcacaaacttgatgaaacctggatttatgctttgtgcagggacaaatcaaatgagattttctgttatgtattggatccaaccttgtcaagaagatactggaagctcattgataaccttccacctcaaatctcgaaaagaaaaggcataggttttgaagctttgggaaataagctattcttattgggtggttgtagcgagtttctagattctactgatgaggtttattcatatgatgcttcctcaaactgttgggctcaagctacttccttgtcaactgctaggtacaactttggttgtgaagttttggataaaaaactatatgctatcgggggaggaggttcaaagtcaagttatcattcttgggagacttttgaccctttgacaaattgttggacatctcagacagatcctaaaattgttaatgaaattaaagattcagtggttcttgacgggaagatatacgtccgatgtagcagatatcctgtaactcctcatgtatttgctgttgtatatgaaccatcaagtggcacatgggagtatgcagatgatgacatggtttcaggatggactggtcctgcagttgctgttgatggtaccctttatgtcttggatcagagtgcaggaactaagttaatgatgtggcataaagagagacgcgagtggatactcgttggaaagctatcaccattgcctattagacaaccctgccagcttgttgcagttggtaaaagcattttcgttgttgggagagtgcttagcactgtggttgttgatgttgataatttggggaatgaggatcaggtgattgtgggttctgctatacctggattattatttgatgtcaatgtaacaagtgttaaatgcttgtcaaactga

SEQ ID NO: 28172 - DNA, 798 bp, Glycine max
  Peptide Sequence Number=SeqID_119857
atggctccacctaaagaaattgcgactgtcatttaccacaatggtcacattacagacgactcagttcagagatcagtgtacacatgtgcgaaccccatatttatttacccatcgtctccacaatcgtcatgtccacaattacaactaccccctccacaacaattaccgtacaacaacctggacctcaatgatccagtgtcttcatacaacaaccttgaaataaaagatgcattagacatttatacttcatacacacaactattatccaaaaatgattttttttatgcccaacaaacctcctttgaccaacaaaaccatccttcatcccaatttatgtcaccctcgcagcaaccacaaacacaaacatcaaatcgaaatgaacatctcatcgctaacgaagatcccattatactatttcatgaggaaaacaatgattttaatgaggatcaacagtgcaacaaaagacggggagactcaatagtttttccaaacagagatgtcgctatattgaagagacatttagctcagttggaaacatatcttggcagcattaaatatatgacaaggttacctgatattgtaataatcgtcgatcaacaagaagaatataaggctcttcgagaatgtataacttttgaaattccaacaatttttttaattgatacaaattgtgacccggacctcgccgatatttcaattccaactaatgatgatgctatagcctcaattcgattaattcttaacaaattagtatttgcaatttgtgagagtcattctagctatatacgaaattcttga

SEQ ID NO: 28173 - DNA, 1362 bp, Glycine max
  Peptide Sequence Number=SeqID_119858
atggacggcgacgacgagacctcgggtccgatgatcgacgaaatctacgccaacggcggtggcgtcggcgacgacggagacaagcggagccgccgcgcaatcatgagcggcgaccagctcgacatcgaggcgtacgcggcgctatactcggggcgcacgaagatcatgaggctcctcttcttcgccgacaagatgaacaacgcggcgacgcagctcgaggcgctgcgcatggcctacgacgagattaagaagggagagaacacgcagctgttcagggaggtcgtgcagaagatcgacgggaggctgggcccgaactacgacatggacgcggcatggtgcgacaccgtggatcggagagctgagcagaagaaggagaagctcgagaacgaactcaatgcctataggacaaacttgattaaggaaagcattaggatgggattcaatgattttggagacttttactatgctcatggtcaattgggggacgcttttaaaagttatgtccgtactcgggattattgcactacatcaaagcacattattcatatgtgtatgagtgcaattctggtcagcattgagatgggtcaattttctcatgttacaagctatgttagcaaggcagaacaggcaccagatgcccctgaagcagtaacagttgcaaagctacgatgtgctgcaggattggctaatctagaggccaaaaagtacaagcttgctgcccgaaaggttagcgggagcaattttgttttccgctgcaacctccctgttattgtttgcggcgctgcaatctctcctcaaggaattaggatttcaggagacaaattgggccattttctagaaacaggacctgaactgggaagtcactataatgacgtaattgcatctcaagatgttgcaacatatggaggactttgtgcacttgcaacatttgatcgggcagagttaaaggcaagtactccattatattgttacgatgacaattccaacttccgcaatttcttagagttagtacctgaagtaagggaactgataaatgatttttactcaagtcactatgcttcatgtctggaatacctcgggaacctcaaagcaaacctattgcttgatatacatttgcatgaccatgttgagacactttatgatcaaattcgtcacaaagcccttatccagtacacacacccatttgtgtctgttgatttgaacatgatggctaatgcattcaagacaactgttgctggacttgagaaagaactagaagcactgattactgataatcagatacagatcaaaggaatgccacctttcaaagggttctggaaactggaagggaatttgatcgtgatgttcgttccatgttactga

SEQ ID NO: 28174 - DNA, 225 bp, Glycine max
  Peptide Sequence Number=SeqID_119859
atgcacataacaaattgtaaatcaataaaaacaatagtggttaaggacagagaaggaggcaatgatgatgaagataacgatgaaaatggaggtaacggtgaaggtgatacagatgaagatgggaatgaagacggaaacttctgtaaacgtgatattaattctgtgatcatgcaacacaggcatcctgagttagtaaatatgatgacagattcccttgacttgtaa

SEQ ID NO: 28175 - DNA, 2592 bp, Glycine max
  Peptide Sequence Number=SeqID_119860
atggacaatatgagtttttcagaacatcctgagctacaacaagcctggcaagatggtcaaagcttaaaagaactggaagtgggagattgcaaaaatgtagaggtaatttttgagatggatgtcacagaggatgctggaacaacattccaattgcagaatttgtctttagaaaggctaccaaaacttatgcaggcgtggaaagggaatggtagaggaactcatagctttcaaaatttgcaagaagtgtttgttataggctgtcaaaggctgcaaaatgtgtttcccgctgccgtggccaaaaatcttaagaagcttcactcacttttcattatatcttgtcagaggttggaagaaattgttaaaaaggaagaagacgcagaagcagaagcagcagcagagtttgtgttcccttgtttaactacactgcatctttctaacctaccggaactcatttgcttttaccctgaaccattcactctgggatgccctgtgttagataaattacatgtgctagattgcccaaagttggagctatttgaaagtgctaacagacaacctgttttctcggatctaaaggtcatttccaaccttgagggattggcactcgaatggaaacacagttcggtgttaaattcaaagttagaatctggtgactaccccaacctcctcgagtatttaatttggattagactgtactttgatgttgatgatgatgggaaccctatttttcccattcaaacactccagaaggcatcccccaatttaaaagcaatgattataagttcttgccgttcccttgaggtattccgcactcaaatccctgaaattaataaaaacttgatgcttacacagttgtgtctcatcgatgtatggaagctcaagtctattgggtcaggcgaagcgcagtggttagacgagatttgtaagaagctcaacgaattagatgttagaggttgtcctcattttacagcattgctgcattctccttcttcagtaactttctccaatttgaaagaattgttcatattcaactgtcaaagactgaagtatttattcacatcctcggcagcaaaaaagttaagtcaacttgaggagatcatcgtctattattgtaaatcaataaaagaaatagtggcaaaagaggaagatgaaacagctttaggagatgtcatattaccgcagctacaccgcatatctctagcagacttgtcaagcttggaatgtttttattcgggcaatcaaactttgcagttaccctcgctgataaaagtgcacatagacaagtgccccaagatggaaattttctctcaaggatcgataggtccaaattcttgtagggaaattgtaactcgggtcgacccaaataatagaagtgtcgtcttcgacgatgaacttaactcttctgtcaaaaaggtgtttctacatcagaatcatatagttttcggggattctcatatgttgcaagagatgtggaattcagaaacactcccagattggtatttccgcaatttaacttccatggtcgtggaaggtatgggacctcaaggaagtctcagccatctggaacaacttcaattggaaaactgtgatgagttagcggcaattgttgcaaatgatgaagcagacaatgaagaagcaactaaagagattgttatattctccagcataacgtcgttgaggctatcggatttgccaaaactaagctgcatttatcctggaatgcagagtctagaatggcgtatgctaaaagaattacatgtcaaacattgccaaaagctgaagttttttgcatcagaatttcaaaattctccagatttaaatccagatggtgaagatagattttcaacagaccagcaagctattgtctcacttgaaaaggttactccctgcttggaagtaatgtcgctgggtaaggaagaagccatgatgattgagcaaggaaaacttgatattgagctcccgaaattaaactccctcaaattgcagtgctttcaggatgagcagggggacatatttccatttgtttttggtttgaaggattgtgatgggttgaagtacttgttcacattttcaactgccaaaacattggttgtactgaaggaaatttacataacaaaatgcaaatcactaaaaacaatagtggctaaggacggagaagaaggaggcgatgatgaagataatgatgtggaggaggaggaccaaggtgaaggaaatgaagacgaagatgaagatgaagatgaagaagaagatgaagatgaagaagaagctaatgctaaaggtgatggagatgaagatgaaaatgaaggtaataacgatgaaaatggaaatcaaggtgaagatgatattacattcaagaagcttgagagtttgactcttagctcgttaccaaaacttagaagcttctacacagggagttcctctttgaattttccatgcttgaaagtaatgtcgttcagcaaaccttgcagcacgaaactttttcgtctttttgacaatgtaccagaacaattgagagtgaaaatagatggaatctactctaaacgtgatatagattctgtcataatgcaacaagatgaagcagaggcaccctga

SEQ ID NO: 28176 - DNA, 792 bp, Glycine max
  Peptide Sequence Number=SeqID_119861
atggcactgggttctgatattgctaatacagtggattcaggcacagaggaaggggtggtggtgggcatgaacgaaggcgggccacgatgtaaactggccattgttagccatccactggaaccatgccaaggcacagccatccatgtagaaggaaacaatggagcaggggaaaattgtggtgggttcgtgtgtggggaggaagatgatggggatgaaggaagacggagcaaaagatccggcatggtgaggagaacgaacgagagcaccaatgttagggggtggaatactctggtttcgaggaccagaccctcctatgaagaagaaggagaagatagagacaactaccctgcagatggtcctataggcccacacggtgtcctcacacataatcacgcagtgtgtttgctgaattcctcatgtattccttgctgcacccctgttagtctatcaacttctgaaacgaggctaaagcaaatactgctagaggttgctgctcaagccatttcaagcctaatagtcctgtcccagaatcagatagaggttaaaatggatgatacaagtgtgccaaatctggtccagttgcttgattcaagcactcagaacactgcaaaaaagtatgcagtttcttgccttggatcacattctccgagtaagaaatgtaagaaactgatgatttcgtatggagcaatcaggtatctgaagaagcttacagagatggacatcccaggagctaagaagctacttgagcggttggaaagagggaaattgagaagcttgttcagcagaaagtag

SEQ ID NO: 28177 - DNA, 3045 bp, Glycine max
  Peptide Sequence Number=SeqID_119862
atgcagtttgttggaatttttgttcaagtgttgccacatctaaaatcggtgtgtctacatctaaagtcggggttgggatatctaaagctgctaccatatgaactttggcgttatgaaagcatagttaaagaattagacagaggttttaataatctgcagagagagagaaaaaggattggacataaagtaaaagaggaagaaaatcgatatgggagagctattgacgatgatgttattaaatggttacaagaggctgataagatcatttctgagtatgacgatttcaggctagatgaagacagtccatatgctgtgttttgcgatggttaccttcctaaaccatcgataaggtttcgtctaagcagaatagcagttgatcttgcaaggagaggtaatgtactgctgcagagcgcaaatcctgattggttgggccgatcttcgactgatgctgatttccaaagctttgcatcaagaaatcaaaccaagaagcgtattgtggatgcattggcagactcgaatgttggagtgattggagtttatgggtggagtggtgtgggcaagactagtttaatcaaagaagttgccaaggaagtaaaaggcaaaatgtttgatgtggtgattatggtgaacgtaagctttcctgaaatacgaaatattcaaggacaaattgctgacaggttggggatgatcttggaagaggaatctgagagtggaagagcagcccgcatacgggagagattgaaaaatcccaaggagaaaacccttataatcctagatgatatggaggtgaaacttgacttcggcatgctaggaattccatttgatgacactgtcggtagccagatgaataacaaaaagaaaaaccctttggcccaccacaaatatgcaatgaaaacagaagaatttgaagcttccagtttgatgaagatagaagaacctattgctagatacacaggatgcaaaattttgatgatttccgacagtgaacaacttttgatcagtcagatgggtgggaaaggaattcaaactttttctgtggaagcattaacagataaggaagcaaagaagatgtttatgaccatggctgaaataataccattaatggaaaagaaagcagagacgatgtttaagaccatggctgaaataatagcattaagagaaatggaagcagagacgatgtctaagatcatgactgagatgataggtgatgaaaattccaagtttgaaaaattggcagctcaaattgccaagaggtgtaaagggttgcccatgacaattgttacaactgcaaaggcattaaaaaataagagcctggtggtatgggagaaagcatatctagaccttggaaagcaaaacttaacagcaatgccagagttttctacaaagttgagttatgatcttctagaaaatgaggagctcaagcacactttcttaatttgtgcacgtatgggtcgcgatgcattaattactgacttggtgagatactgcattggtttgggtttccttcaaggaatttacactgtaagggaagctagagatagagtatatgcattggttggaaagttgaaagaattaagtttgttgtctgatagtttttcaattgatcatttcaccatgcatgatattatacgtgatgtggctttgtcaatagcatcccaggaaatgcatgcatttgcactgacaaagggaagactagatgaatggcccaaaaagcgtgaaaggtacactgcaatttccttacagcattgtgatgtgactgacattatgaagaagtttcctgaaagcatagactgttgtagacttagaatcttccatcttgacaacatgaatccacgtctggaaataccggacaacttttttaatggaatgaaagaactccgggtgttgatattgattggcattcatctattatccttaccttcgtcaattaaatgcttaaaagaactcagaatgttttgtttggagcgatgcaaactagctgagaatttatctattataggagagttggaggaattaagagttcttagtttatcaggatctgatattgaatgtttgcctattgaattgaggaagttagctaagctacaaatttttgacataagtaattgttttgaacttaaaaagattcctgctgatgtattgtcaagtttaactagtttggaagagttgtatgtggggaaaagcccgattcagtggaaggatgaagaaggacaaggaaaccaaaatggagatgtcagtctttctgaactgaggcaattgaatcagttaacggcactagacatacagatcccaaaaatgacccattttcataagaacttgttctttgaccagttgaatagttacaagatcatcattagagatttcaatgcatatccagcgtgggatttcaagatgttagagatgtgtgaagcatcaagatatttggcacttcagctagaaaacggctttgacattcgtaatcgaatggagatcaaattactattcaaaagagttgaaagtttgttgttgggacaactaaatgatgtcaaagatattttcaatgaactgaattatgaaggatttccctatctgaaatatttgtccattctaagtaactcaaaagttaagtccatcatcaattcagagaacccaacatatcctgagaaagcatttcccaaattagagtcattgtttctctatgatgtcagcaacatggaacatatatgccacggtcaacttacaaatgattcgttccgcaaactaaaaatcatcaggctcaagatctgtggtcaattaaagaatgtcttcttctcttctatgctcaaacatctttctgcccttgaaacaattgaagtttctgagtgtaactctttgaaggacattgttaccttggaaagcaataaagatcatattaagtttcctgaattgcgctctttgacgctacaatctttgtctgaatttgttggattctacacccttgatgcatcaatgcaacaacaagtgcctaactggaagccgggtgatcaactctttgatgaagaggtgtgctcaaaattgtcacgctga

SEQ ID NO: 28178 - DNA, 1050 bp, Glycine max
  Peptide Sequence Number=SeqID_119863
atgaaacctgttttctgtggaaacctggatttcgacgcgcgtcaatctgacgtggagaggctcttcagaagatacggcaaagttgatagagttgacatgaaatccgctggtcaattacttttcttactgggtattcttgcactgtggattctggttttgaatggcgcgtttgtgggatcgattgtatggagaaggaagattggatgtttcaaagatgtgttctgttgccatgaagacgtggaagttgagacggaagcgtcctattgggttgagtcacaaatatttgagaaaggaaaatcattcattgctttttcattcctcatgacttttgctcagtgttcaatttccaacatgtttcaacatagaaaccatgatgatttcgcaactgtggcagggtttgcttttgtctacatggaagatgaacgtgatgctgagtatgcaatcagaaggcttgatagaacagaatttggtagaaagggtcgccggattcgtgttgagtggactaagcaagaacgtgacagtagaagatcaggtggtgattccagaaaatcttcatctaattcaagaccatccaaaactttgtttgttataaattttgatcctgttcatgccaggacaagggatctggagagacattttgattcctatgggaaaatattaaatataaggatcagaaggaattttgcttttattcagtttgaatcccaagaggacgctactagagctttggaggccaccaacctgagcaagtttatggaccgtgttatcactgtggagtatgccattagagatgatgatgacagagacagaaggaatggatacagtcctgatagaagaggccatgactctcctgatgggagatatggtcgtggtagatcccctagtccttatcgtagaggtcggggtagcccagattatggtcatggatcaaatccatcttccagaccagatccaagaggaagccccaagtatgaacgagctgaaagcccaataaataatgggagatatgatagccgatctcccccaccccgagaaaggtcgcgatcttga

SEQ ID NO: 28179 - DNA, 147 bp, Glycine max
  Peptide Sequence Number=SeqID_119864
atggacattaacgtcattgggattccacctccgacaaagaagaatagtgcttccaattccatgaagcagaaaaaggcttcttcttcttcttatgtggtcgtgacatgcattttgtggagttcgagattgccggtttgcatgctatga

SEQ ID NO: 28180 - DNA, 1242 bp, Glycine max
  Peptide Sequence Number=SeqID_119865
atgagcacgcagctgaaaaggttcaactcaatggaacgcaggccaagaatgctgaaggacttcctcagcgagaatctaaactcgtgctcctcaagcggcttcaaatcacttccaagaaaaccaaccaacaacaacagcatgcacagcctcatcgaaatggaactcaaatcttcatcaccctttcaaacactcatgaacaccataagaagcatctctctcttcacctcaaaatcaccctccgtgctttctctaccgaggagcctctcacgcaagctatcatcttcaaggagaaaaacaagaacaagaagaagaaggagccatgtgtgcagcagcgatgtcaacatcacaacggtggtgaagatcaaggacatcatacggtggaagtcattcagggatatcgtggtggaaccttctcttccaccaccaccgttggatttcatggtggggtccaccaacaccacttgtagtagctgtagcagtggctctagttggactgagagtgatttttttttaacctcgtcctgggaagaaccacaaaacgacaacgttgaagcgggtaaaaggttttcatttttttcaccccttgttgtcggcaaggactccggggctacggacacttcaacttgccaagaagaacaacacagtccagtttcagttcttcacgttggagaagatgatttctcaccttttgatcaaagtcttgccaatattctaaggagaaaacagaagttcatacaaacagttcaaaaattggagagtcatgcaaaatttgaccttgcaaacttagaccaatgtctctcattggatgacaactctggctatgatgaagaatatgaagaagaagaagatgatgataatgatgacattgaagaacaagattggattgaggaaaaggcaaagcagctgctacattgtgtcaaagcaagagtttcagcacatggctgtatagactatttggatacacttctgttggattttttcagggaagaactaagtggaagtagaaaccaatacaagaatgaagaggagtttgagttggagacattgagaataactgaggattggataaatgggtcatttgcttttgatgcagggcatgctgacaaacatgcttacataaaggacatggagaggagagatcagtggagtaggttggaggaggatcaagaagaattggcctttgaaattgagacagctatattgcatagtttgattgctgatcttctggacctggatgcttaa

SEQ ID NO: 28181 - DNA, 573 bp, Glycine max
  Peptide Sequence Number=SeqID_119866
atggtagttagtatcgtacgattcacgataagtatcgcacgattcgataggattccagctgctaccgatgcgaatcggagtatcaaggatcacgacgacatcgtaaccgtgacaaatgaccaatgtctctcattggatgacaactctggctatgatgaagaatatgaagaagaagatgatgataataataatgacattgaagaacaagattggattgaggaaaaggcaaagcagctgctacattgtgtcaaagtaagaggttcagcacatggctgtatagactatttggatacacttctgttggattttttcagggaagaactaagtggaagtagaaaccaatacaagaatgaagaggggtttgagttggagacattgagaataactgaggattggataaatgggtcatttgcttttgatgcagggcatgctcacaaacatgcttacataaaggacatggagaggagagatcagtggagtaggtttgaggaggatcaagaagaattggcctttgaaattgagacagctatattgcatagtttgattgctgatcttcaggacctggatgcttaa

SEQ ID NO: 28182 - DNA, 84 bp, Glycine max
  Peptide Sequence Number=SeqID_119867
ggggtaccaaaggtggtgtccaaatttcacaataatctaacggttgacgagtcagagattatagttttacttggacatgtttag

SEQ ID NO: 28183 - DNA, 444 bp, Glycine max
  Peptide Sequence Number=SeqID_119868
atggatacctatggagtcgagcttgagctgagaaagctagaaggagaagtaaaggccatccatgagaatttgctctatcttaagggaagggaagctgaaatgaggactgtgagtgaaaaaacaaatggcagagtggcatggtttagcattatatccttggctatgtgcattgcagtttctgaagaagatgaaaaacttcttaggcatattactaagtacggtcatggtcatggacatggagctgagttccctaagcaagaagaccgagttagacagacaatgacaatggcgaacgacgacggagcttgcggcacaattcgaacctcacggcggagtgaaggaggtgacgacgaagcttgcggcagcgttcggaggtttccagaaaatgcctttactatgtcaagagaactcggacgtacgtacgtacacgagcagtcagcttag

SEQ ID NO: 28184 - DNA, 928 bp, Glycine max
  Peptide Sequence Number=SeqID_119869
atggactcaacaatgtcgacaaggacctttcacaccttgaccaatccaccatgccccggaatgatccacttgggtgatggggttgatgaagtattctactcagtccctaagggtaagggggaggggcattgtggcagaggaaacaacggaggccacaacaaatgccttcactcctccttcatcgagggcgtttcttgcaagtgccttgagttcatcgatgaaggaggaatgaatgaggacttcttctacaagcctcttgcttcagaagttgtagccttttctgaagctatcgaggcttataagagatgggtgaggcagaacaaagagtttgtgcactccatggagtctttggccaatggattgacatggcttcttcctgaacggttttctgaatcagagattggaccagaagcagtaacaactattctgggaatcatcacagctctcaatgaacatataattgatacagctcctaagcaaaatattacaggctctgtcgagccttattcatttccttatccattatgcttatctgcattaaaggatttggaaacattagttgaagttgtggcacaacaatactatggtgatgataagaaatggaatttccttgccattactgaagcaaccaaggtactggttcggttatctttgtttcggaagagtggatataagatgctgctacaaggaggggaaacacctaatgatgaggagtattcagatagttttacttcacaacatcatatgggcttaaagcccgatgtgcatcataggcctggttatatgaaaaacaatcttggtgcaaaaccaatgaatcaggaaggaagagcattatctgctttggttagatttggagaaaaagcaaaggggtcagatccagtgtggttacgcagggttgaacaccaacaagcaactatggagcctacaa

SEQ ID NO: 28185 - DNA, 399 bp, Glycine max
  Peptide Sequence Number=SeqID_119870
atggctccggctatcattgtgaatagtaggataggtcaaattattaccaattatacacagtccacaagatcaccgtcagcagtaatgcataagagccatgaagtaaaaattcaagctccatttgctgcttcattttcatctaggggtccaaatccaggatctcaacatattctcaagcctgatgttgcagctcctggcattaacatcttggcatcttatacacccaagaagtcaattactggtcagaaaggggatacccgatttttagaatttgcacttatgtctggaactactatgtcatgtcctcatgttgctggagtagcagcatatgtgaagtcatttcacccaaaatttcctgcggcaatcagatcagccattattaccacaggtgaaatttaa

SEQ ID NO: 28186 - DNA, 453 bp, Glycine max
  Peptide Sequence Number=SeqID_119871
catctgaagcaagaggcagaaaacatgatgaagaagattgaccttcttgaagctgcaaaacggaagttcttgggggaaggtttgggggcttgctccattgaggaactgcaacggatagaacaacagttggagaggagtttaagtaatgttagagcaagaaaggtccaggttttcaaggaacaaattgaacaactaaaagaaaagacacttatatatacagttgtgaccaattgtcaatacgaggaaaaagccctactagatgaaaatgccaagctcactgaaaatgccaggctctctgagaagcatgacatccatctacagccagcaacaaagaatcagaatgtgaatcaaccccaatgcaatgcagaaagtagttcaagttcagatgtggagaccgaattgttcattggacttcctgatacaagagcaagacacatctctcatcacgtctag

SEQ ID NO: 28187 - DNA, 684 bp, Glycine max
  Peptide Sequence Number=SeqID_119872
atggtgatgttttatggatgcaaactaagcatgtttcaaaacatatttgggatagggaagaagacagaaaattacacatcagacgagttgttcccacgtctccgtatggatggggcaccattaattggtccaccaaatcttgatttggctgatttttgtgaagaattgttaggagtcagaccacaagaaggtgaacttcaaggtagtgtgtgcagcacgtatgcatggggacctgccgtgcttgcttatttatatagagagatgtgcagcgccgccgattacatcttaatccaaatgtgggcatgggaacgatgcacaactttgtctccaaagaggactccttccgtaatagaaaataaaccactcggacacaggtggttgcgacgtggaaatcaacatattggcaatgatgatctgatagttttttgtcgcaagttggatatcatgaaacgacatgagtttctgtgtgagccttgcacaacaaatgttatgtcagcattgcctccaatttgtttggttggaagtgtagcgtggtgtgcggtgatgccactcatttgtttccatgttgttgagtggcaccaacccgatagaattttgagacaatttggaatgcaacaacctattctcgggtccttcgtaacccctgaatattcatggcataatactaaaaggcaaacaagatga

SEQ ID NO: 28188 - DNA, 96 bp, Glycine max
  Peptide Sequence Number=SeqID_119873
atggagggggtgggcaagacattatcttatggaaatggaagattagatgatggcaaggcattagctgaacttggttttgagatcggtgatcggtga

SEQ ID NO: 28189 - DNA, 704 bp, Glycine max
  Peptide Sequence Number=SeqID_119874
taatcagctttgtgtttcagcttaaaggcaagcgagtagggattgttggattgggaaaaattggcaaagaagttgctaaaaggcttgagccctttggttgcagaattatgtaccattcgagaaaccagaagccatttatctcgtaccctttttattctaaagttgttgagcttgctggtaatagtgatgtccttgtgctttgttgcccacttaacgagcaatcaaggcacttaatcaacagggaagtgatgttggcattggggaaagatggagctattgtcaacgttggacgtggagctctaattgatgaaaaggaattggtgcggtgtttgatggaagatgagataaggggtgctggcttggatgtgtttgagaatgagcctaatgttcccaacgagctctttccattggataatgtggtcctctccccacatgctgcttcattgacttcagatggtttcactgaagtatgtgaacttgcagctgaggctctagaattgttcttttcaaccttaagcggcactcgctgcttggtatcacaagaccacctcattcttaggttgatgactttacaagacaaccctttccaggatggggcatttgcattgctccctaaattcgtaagagcaagtgtacagcttttcatgttggtcttataccgtggctgtaagtatactagttgcccacctcatgagagcaaatga

SEQ ID NO: 28190 - DNA, 250 bp, Glycine max
  Peptide Sequence Number=SeqID_119875
caagcgagagaaggactggacgagaaggattggtaatgatcgccatttgatatgtatagaggatccttttgaaatatctcatgatctaggtcgagtggtagataaacatagcatcaaagttctcagggaagagtttgagcgtgctgctgaaattatgcagaatgatccaaatccatattttataggtgaggtaatggacactcagctggcaagaattttctgttacgttgaacgagctccaaggtattaa

SEQ ID NO: 28191 - DNA, 516 bp, Glycine max
  Peptide Sequence Number=SeqID_119876
atgaacaattgcttgttggcaaagtctatgaatacattagaggtgtcaagcctactgaaatctctccaagtttgggctcacattcgtgatttggctcctttccgcaggcgtttcacttctttacagcgcattactgattctttaattagggacagatccacatcagttgttcaaggaaaattacgttgtctggctatagcaattacagtctattgcatctggatgtctaggaacaagctaatttttgaagattatcaattttctgtaatagagttggcgagggagggggagaggaggtggaagagatgggagaaagagggtttggacatgcggaaggcgtggagccatagggaatcagagacagagctgaagtggcggaaccaggagttgcagtgtggcggggagagaggcggcaatggagagtgggagatgatggatgatattagggattcgagacagaaggattcggaagggaggattgtactacataggaacaaggttgtctttactaattag

SEQ ID NO: 28192 - DNA, 276 bp, Glycine max
  Peptide Sequence Number=SeqID_119877
atggaatatgccatgcattttctcatgggtctcaatgaagcttattcttctattaagggtcagattttgtccatggattcattcacttctatcaccaaggtgtttcctcttattgctcaagaagaaaagcagagggaaattggtgcttcagctaatgctgagtcttctcatgcctttgcagtcaagaatgatgctgggtcatacgaaagctcgatgctgcaaactgattggatacccaccaaattacaagaagaacaagcctttttcagcttgtaa

SEQ ID NO: 28193 - DNA, 1574 bp, Glycine max
  Peptide Sequence Number=SeqID_119878
atgaatcacaacaacagcaacaatagagcgaggtaccctcccgggatgggacttgtgcgcgggggtttcaatccgaacctgagccagaacccgaaccagaaccagaacccgagcctgaaccagaatcatcacgcgttccaggctcggccgccgtaccaccaacagcaacaggcgcaatatgtgcagaggcatttgttgcagcagcagcagcaacagcagcagtggctgagaagggatgccaacgccgtcgacgaggttgagaagaccgtgcagtctgaagccgtcgattcgagggctagggtcagtgttgaggtgttgttgttggtatgtttagtttatgttgtatggctttctgtaatgtgcttgcttggctgttcccaagattggaaagcaagactaaagattccaccagctgatactcgctacaagacagaggatgtaacggcaactaaaggaaatgagtttgaggattattttctgaagcgtgagctgctcatgggaatatatgagaagggttttgaaaggccttctcccatccaagaagaaagcattccaattgctcttactggtagtgacattcttgctagggctaaaaatggaactggcaaaacagctgcattttgcattcctgcattggaaaaaattgatcaggacaataatgttattcaagttgttatactggtcccaacccgagaattggcattgcaaacttctcaagtatgcaaagaacttggaaagcacttgaaaattcaagttatggttacaacaggtggtaccagcttgaaagatgatataatgcgcttatatcaaccagttcatttactagttggaacaccaggaagaatattagatcttgccaagaaaggtgtttgtattctgaaagattgcgctatgcttgttatggatgaggccgataagcttctgtccccagagtttcaaccatctatagagcagctgattcattttcttcctacaacccgtcaaatcttgatgttttcagccacatttcctgttactgtaaaggatttcaaagataggtatcttcaaaagccttatgtcatcaatcttatggatgagctaactctgaagggtattacacaattttatgcattcgtggaagagagacagaaagtccactgcctaaatactctattttccaagctgcaaataaaccagtctatcatcttctgcaattcagtgaatcgggttgaactccttgccaagaaaatcacagaacttgggtattcatgtttctacattcatgcaaagatgttgcaagaccatcgtaacagagtgtttcatgatttccgcaatggtgcatgtcgaaatcttgtttgtactgatctttttactagaggaatagacattcaagcagttaacgttgttattaattttgattttcccaagaatgcagagacttatttgcacagggttggtcgttctgggaggtttgggcaccttggtttagcagtgaacttgattacctatgaggatcgctttaatctgattgaacaagaacttggaactgaaataaagcagattcccccacaaattgatcaggcaatttattgtcg

SEQ ID NO: 28194 - DNA, 1383 bp, Glycine max
  Peptide Sequence Number=SeqID_119879
atggacaattcatccaactttgatgacaattctgatgtggggtaccaaccttcaccttcttctgtggatcaaaatgatcattcaatcactgaaaacgttggatactcccctttattcagtggggaatccttcgcgtattgtcggtctaattcggaggtctcaaacttctctgagcctattgatgacaatagctttgcaagtgaaccttcaccttctctatggacaccaatgaaacatggagctagtcaagctgctctttcaaggttaggagtgaagcagcacagacactcagtggatgagaaatctgatgaccttgacctcttagagacagagcttgatatgatgagggaaagattttcaaagcttctattgggggaagacatgtctggtggtgggaaaggtgtctgcactgcagttacaatatcaaattcaattaccaatctctacgcaactgcttttggacaaaatttaaagttggagcctctgaagcctgagaagaaggctatgtggagaagagaaatgaattgtcttctatctgtgtgtgattacatagtagaattttccccaactgcacaatatttagaagatggcacaattgtggagatgatgacaagcaaaccaagatcagatatttacatcaacctcccagctttgcagaagcttgacacaatgctcatagaaatattggatagtttccaggatactgaattttggtatgcggagcaagggagcatatcagggaattcaactcggtcacggggaggctcatttcgaaggattgttcagaggaaagatgagaagtggtggctgccggttccttgtgttcacactgggggcctctctgataagtcaaggaagcacttgaatgagaaaagagattgtgctaatcaaattcataaagctgcaatggctataaatagcagtgctcttgcagagatggatatcccagaaacatatatgtctaatcttcccaagaatgcattgagtagtatgttttcatgttttcacttatttttctcttctctaacattagagtggaagaacaagtctgggggacacaatttaccgctgcgaaaagcttgtctgagccactcaaaaacatcatggaacaaagttaaggatctcatggctgacactgaccgaagtgacaaaaactacatcttagctgagagagctgagactttgttgttttgcttgaagcaaagatatcctgaactttcacaaacatcattggacacatgcaaaattcaatacaaccaggatgtaggaaaagcgatattagaaagctactcaagagtattagaaggcttagcattcaacattgtagcttggattgaagatgttcttcttgctgataaatcaatgaggaaccaaaatgtatag

SEQ ID NO: 28195 - DNA, 1533 bp, Glycine max
  Peptide Sequence Number=SeqID_119880
atggaaaaggacaacgagacatatctgaagctcttttgggggcgttctaatcatgagaagccatgtttgctgtcaaagaagggcaaaagcacggcacttagcaccaccgtgattttgctcgtttgctttgtagccactttccttgttttgactatctggaatacgtccacatttgcagctctttccattccaatctcaatcatccccacaacaaaaccccaagaacaagaattcccacttagttgcacccaaaacgtgacacaaacatgctcaagagactaccctactatacacacccccaccaaccccacccgcacctgcccctcatattttagatggatccacgaagacctatggccatggagagagagggacagagggatcacaagggaaatgttggagggtgcaagaagaacagcacactttaggctagtgattgtggatgggaaattgtacgtggagaagtataagaaggctattcagacgagagatgtgtttactttgtggggcatattgcaactattgagaatgtaccctggtaaagtgcctgatttggaactattgtttgattgtgatgataggcccgttgtgtcaaaggagagatttaaaggcccaaatgctcccaccccacccttgtttaggtattgctcggatcagtggagcttggatattgtgttccctgattggtccttttggggatgggctgagataaatataaagccatggaaacatgtcctaaaagaaatcaaagaagggaacgaaaagaccaagtggaaggacagagtaccatacgcctattggaagggtaaccctcttgttagtccaactaggaaagaccttatgaagtgcaatgtcacagaaaaagatgactggaacactcacctatacatacaggattgggatcaagaatccagtaaagggtacaagaaatccaacttaggagaccaatgcacccataggtataaaatatacgtagaaggatgggcttggtccgtaagtgaaaagtacattttggcatgcgattctacgactctatatgttaggtctcggttccatgatttttttgtccgaggcatggtgccactagagcactattggccaattagagacaacagcaagtgcaaatctcttaagtttgcagtggaatggggcaacaacaacactgataaggcacaagcaataggggaagctggtagcaaattcattcatgaggacatggacatggactacgtatatgattacatgtttcatctacttaatgagtatgcaaaacttcaaaggttcaaaccaactatacctcaaaatgctgtggagtattgccccgaaacaatggcatgtggtgtagatggtatacaaaggaggttcatggaggactcaatggtgaagtctcctagtgattcaaatccatgcactcttcctcctccatatgagcctataaacctacaagactttctagagaagaaagctagttcaataaggcaggtagaaacttgggaagaccaatactgggagaaagaaaaagggggacaataa

SEQ ID NO: 28196 - DNA, 507 bp, Glycine max
  Peptide Sequence Number=SeqID_119881
atgggattcagtggaaacatgattgcgacatcattattttgcggagtccataataagataaaggcaatcatggctgtcttatgggccttgcaggtatgggccttgcggggggctgcactcaaaatttacactggtttcttaaaaactcacatgcagatggttaagttgtgtcattggagagatcgtttggcagaggccttgaaggaaatgcagtcagaaggaaaggcagatcgggtgttccacctaatctctgctagtaatggaaccatagagagagagaaagatgatcaacctgttatcaagctgaatgaaatattagctgtatgcctatcaatgttatcaatggcgaatgccgggatgtggtggaaggccaaaattcccccatatagacatgcaattgctgcctatggcgctgccatggtaggcctaccttcacaaattgcctatggtggttggcaaaaatctgccatgccattccggtatagcagccatggggccaccatttaa

SEQ ID NO: 28197 - DNA, 411 bp, Glycine max
  Peptide Sequence Number=SeqID_119882
atgaaagaaggaaaatttgtggatgacatgtttggaagacttcaagtgcttctgaatggacttgaagctctaggacaatccttctctaagtctcagataaacatgaagattatagacaactttcccaagatggctgagtctgatggttcaaataatagttttggaggatccacaaatgacgaagtgactctcatgtctagaaagttcaaacaaatgttgaaaaagaaagaaaagtttcagtgttcctccagaaggaaaaacaccatatttaagaagaaatgcaaggaagagaacaatgaaatcatctactttgaatgcagaaagcttggactcatgaaagctaagtgtccccaactaaagaaaaatagatattttggtgacaagaaaaagaaaagtttgatggtcacctag

SEQ ID NO: 28198 - DNA, 279 bp, Glycine max
  Peptide Sequence Number=SeqID_119883
atgagaaatgcttctcagtcaaacttcccttcctcgagtaccgatctacaagaacagatgagaaaccagatgaaagatccagccatgcggaagatgtcacttccgttgtctaagattgacttttcatattctcattgtattttcttttggcaagtagtacagatgttctcatcgggtaccgagctcgaattcgtaatcatggtcatagctgtttcctgtgtgaaattgttatccgctcacaattccacacaacatacgagccggaagcataaagtgtaa

SEQ ID NO: 28199 - DNA, 382 bp, Glycine max
  Peptide Sequence Number=SeqID_119884
agtttgatttggagatctgtgatcggagcggtgcacagaacctcgtggctgaccatctgagtaggattgagcgtgtgtttgaggactcacccattcaggatgattttccagatgaccatttgtacattcttgaccggttattaggagatgcattccagaccatgagattgactcagtcttgcaattctgtcattcttccgcaccaggtggccatcttggcatacagaggacagctcgcaaggtgcttgactgtggtttctataggcccaccattttcaaggatgtctggagaatttgtagcacttgtgagccttgtcagagagcaggcgactcaccttcatggaaacaacaaatgcctcaacaacccatgttattctgtgag

SEQ ID NO: 28200 - DNA, 345 bp, Glycine max
  Peptide Sequence Number=SeqID_119885
atgactattgaagaatctattcatgtttcctttgatgagtctaatgctatttctccgagaaaggatattttagatgatgttgcagaatctttagaaaaaatgcatattcatggacaagattccaaagggaaagggaaaggaagcaatgaagatcctccagaagaagccaaatcaactgatgaacttccaaaagaattgaaagcttcaaaagatcatccccttgacaatattattggtgatatctcaaaagggtgcttttctaaatggcttaatcaagaagaagtatatgttgaacaacctccaggttttgaaataagtcagataagccggggaattttcctctag

SEQ ID NO: 28201 - DNA, 297 bp, Glycine max
  Peptide Sequence Number=SeqID_119886
atggtcatggacatggctgacacatttggagaagattttggtattcatttcaaccaatggagttgcattaatgcagaaatttccacagaatcatcagtgtcaagattgcagttcttcagcactttaaagaaagattctcagagcagaatccttgcagaccaaccttggaagggatccagttctcttcccttgatcaaaggcagaaggaaagccttgttgatagactcactgagctggaaatcaagtctgcagtttgggcttgcaggggagataaaagtcctggcctggatggtttga

SEQ ID NO: 28202 - DNA, 204 bp, Glycine max
  Peptide Sequence Number=SeqID_119887
atgacgaagctcaaagtcagacacttcatatacaagatgatgatcagatcaagaatgagtcagatgaatcagacctcaggtcagaggaaattgattcaagaatcagtccaagatcagtccaagaatcagatcaagatcaagatcagatcaagatcagagagatcaatcaagatagtattaaaaagttttgtcaaaactgagtag

SEQ ID NO: 28203 - DNA, 176 bp, Glycine max
  Peptide Sequence Number=SeqID_119888
atgaagctcatgtcgtcttcaagacacgtgatgcgtgagtccatagcatcgaaacgatcaccggtgaaagcccgaagatacctaagctcagtgagaatgtcattcagtaaggaagatgaggaatcctattgcggtggtggggagggtgggcattcattaggaattggaggtggaag

SEQ ID NO: 28204 - DNA, 222 bp, Glycine max
  Peptide Sequence Number=SeqID_119889
atgggagcagatggaagggtgggtggtggagatgcgatgaacgtaggcatcgatggaggggtggttgaggaagccaatggcatggcaacggggtgcaacagggacgggtattgcatttcccaccccgcccccaactttgtaattgatccccgaccccgcccccgatccccgtcgggattaaaaatacgtacccatccccggacgggtattgtaacttattga

SEQ ID NO: 28205 - DNA, 937 bp, Glycine max
  Peptide Sequence Number=SeqID_119890
atgccccgagtcgccgtgtccgctgccaacgccctggttaccgccccccttccgccacagccggtgctgcaggccctgcttgagcgcctgcgcgaagggctgctgctgttcaccgacgacgggcaggtggccctggccaatccggctgcgcagaacctgctggccagtggtgagggtggcggtctgccaccaccgcagcgcctgcgtgaactgctgccgcccgatgccctggaacaggcgcgccagcatggtcactggaatggcagcctgccgctgggcgagggcgtggtcatcgcccatctgtatcaccacggcccggtgggccaggggcacttcctggcgttgttccgccatatcgaggggcaggaagactacgagcgcgagctgcagcagcgccatgccgagctgcgccaggcctacctgcgcctgaacggcacccaggagaagctgctgcagtcggaaaagatggcctcgatcggccagcttgctgccggcgtcgcgcacgagatcaacaacccgatcggctacgtgcactccaacctgggcagcctgcaggaatacctacgcagcctgttcacggtgatcgaagcctacgaacgcgccctgcgcgcgccggacccgaaggcgttgattccggaaatcgacgatatccgtgaccgtctggacatcgatttcatcagccgtgacctgccgcagctgatggctgaatcgcgcgaaggcatcgagcgggtcacccgcatcgtgcgtgacctgaaggacttctcgcctggaatcgaccatcaacatcatctggaacgagctgaagtacaaggtcaccctggtgcgggagttcggccagctaccgctggtggaatgcctgccgtcggagttgaaccaggtctacatgaacctgctgctcaacgccagccatgccatcgccgagcgcggcacgatcacg

SEQ ID NO: 28206 - DNA, 450 bp, Glycine max
  Peptide Sequence Number=SeqID_119891
atgacgagagcgtccattagttggttcctgcggtggaaagaaggaagggaagtagtattatgctcatgtgaaggatttccaaatgtccctttaatagggatgaggggttgtattaagtataatcctatgagaggtgcgccatcggaggaaaccatcacgcctttcatcgcacaagggttcaatgatgctaatacaaagatacttcagaggatccgtaacgcatggaataaagtgggaagaaaagataaagaacttagcagaagaagcaatggtgtcataggcggctatcacaaatggttgaaatctagaatgccagggataacttggctcccaaagctaaagggtctggatggggaagcggctaaagtgcttgaggagagtgaagaggtgcaagctgagctcgaaaagacaagagtagcgaaggagaagctgaaggtggtagtcacttga

SEQ ID NO: 28207 - DNA, 519 bp, Glycine max
  Peptide Sequence Number=SeqID_119892
atgatacgcggagataccttacggttattcgcacccttgtgtcatccagaggcggcgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaaaggcggcgggcccgatgatacgcggagataccttacggttattcgcacccttttgtcatccagaggcggcgggcccgatgacaagcagagaccaagtttggtcattctgcacccttgtatcatccagaggcggcgggcccaatgatacgcggagataccttacggcggcgggcccgatgacaagcagagaccaaatttggtcattctgcacccttgtatcatccagaggcggcgggcccgatgatacgcggaaatacccgagtggttatccgtataacattcttttgctatctgtaagacagaacgcttga

SEQ ID NO: 28208 - DNA, 414 bp, Glycine max
  Peptide Sequence Number=SeqID_119893
atgcgaacatgctttagtaaagagacaaaacttccaactgatcagagcaacatatgctttttggatgaaaaacaatgtgtctatcggggaaggagacatttcatttctaaacgaccatttagaggaaacactgggtccaacaaagataggaaaaaatcactcaaagtgtatcaatctaacacaatgcggggcgagaaagtcactagcgcacaggattttgtcggcaatcaaagggagaggaccactttagggaaaggattgacattctcaccctgggtcaaggtttatgataagttgggattttggctcaaggcttgtagaacagctggtcatgatatatgtcagggtttggccagcggttcggggataaaggggatgtcctacattattttcatgatacatatgcaacaatga

SEQ ID NO: 28209 - DNA, 219 bp, Glycine max
  Peptide Sequence Number=SeqID_119894
atgcctataggttggacctcccagaagagtggagctgatgctgacaaggaggaaccaacagatttgaggtcaaatcctcttcaagggggaggggatgatgcaatcctccctaggaagggaccagtcacctatgccatgagtagaaggctccaagaagattgggctagagttgctgaagaaggccctagggttctcatgaacaccagggtagatttctga

SEQ ID NO: 28210 - DNA, 421 bp, Glycine max
  Peptide Sequence Number=SeqID_119895
atggcggaaccatcaaagaagtgcaaaggttcttcaagtagaatccaatggcattctgaggctcaggatactccaattccttcctttatttcctcctcctcattgttctcattggaagaacaacgtatatggtacgcaaacctcttctcctctcattttatcatttaccctaagttcatagatatggatttcttttctgatgagagttttgaatgcattcaagcatttcaaaactcaaatctcattccctttatgtctctaaaattgcatgtgtattctgaattggtaaaagctttttattctaatcttgaaactcaagaaagtaccttgatttcagaggtctatgggataaagatggtcattgaccaatccctcttctatgatttgactcaattgtctaccgaaggtgtaccatttgaag

SEQ ID NO: 28211 - DNA, 348 bp, Glycine max
  Peptide Sequence Number=SeqID_119896
atggtgttgcttgtcaatgttatgattcaacaagcgatctcctcaaattcagccagcccgtatcaattagacttcacactttatgcttcggggtcatacaatgctcaatggaatgcccctgggcgcctgcgcgataagcacacgttgcgttcgagtcgtatcctcagaaaaatggaggttgaggaaccttggttggggctttttgctgcaaaattcctttttgttggtgtatttttggtttgtgctaaagggatggcctttgtggataactgggcagtgggtcaggaggagttttgttattggctgagtaatgacattgttgggttggtgggaaacttggccgtatag

SEQ ID NO: 28212 - DNA, 393 bp, Glycine max
  Peptide Sequence Number=SeqID_119897
atggcacgcagagacaaattatggtcattctgcacccttttgtcatccagaggtgtcgggcccgatgacatgcggagacaaaatttggtcattccgcacccctttgccattcagacacagttgtgtccgatggcacgcagagacaaattatggtcattctgcacccttttgtcatcaagaggcggcgagcccaatgacatgcggagacaaaatttggtcattccgcacccctttgccattcagacacagtcgtgtccgatggcacgcagagacaaattatggtcattctgcacccttttgctatccagaggcggcggacccgatgacacgcggagatttacatcatcttccgcacttacaagatctgtcatactgacttttgagtcacgctga

SEQ ID NO: 28213 - DNA, 720 bp, Glycine max
  Peptide Sequence Number=SeqID_119898
atggcctccgagatcatccgcgaaaagctgatgcgtttcctgggcgctgaactgccgtactccgtgaccgtcgaaattgaacgtttcgtgagtaacgaacgcggcggttacgacatcaacggcctgatcctcgtcgagcgtgaagggcagaagaagatggtaattggcaacaaaggcgccaaaatcaaaaccatcggcatcgaagcgcgcaaagacatgcaagagatgtttgaagcgccggtgcacctcgaactgtgggtcaaacgcgcctttgtcctgcatagccgaccgtggagcgaaaccagtctgatgctggacgtcttcacggaagagtccggtcgcgtgcgcctggttgccaaaggcgcacgctccaaacgctctaatctcaagggcgccttacagccctttacccccttactggttcgcttcggcggccgcggcgaagtcaaaacgcttcgcagcgcggaaaccgtctcgctggcgctgccgctcagcggtatcacgctatacagcggtctttacgttaacgaactcatctcccgcgtgctcgagcacgaaacgcgcttctctgaactctttttcgactacctgcattgcattcaggcgcttgccggggccatcggttcgccggagcccgcgctgcggcgctttgagctggcgctactcgggcacatgggctatggcgttgatttcctccactgcgccggcagcggcgacccg

SEQ ID NO: 28214 - DNA, 429 bp, Glycine max
  misc_feature (44)..(44): n is a, c, g, or t
  Peptide Sequence Number=SeqID_119899
atggtgaaagttggaacctcttacgtgccgatcaacgtctcatnttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcccccaagactagttcccaagcaaggactagcaacattaaatgcttcaaatgtcttggcagag

SEQ ID NO: 28215 - DNA, 224 bp, Glycine max
  Peptide Sequence Number=SeqID_119900
acattattgtgcctaggaagcttctgccagagaggaacgtggtggtctattatacaaaatttgatgagttcaaggaggaacttgaaagacaccactgggacgaggagttgactgactttggggatggcaacattgatgttgccattgtgaaggaattatacgccaacctctatgaccccaaggacaaatcacctaagcaggtgagggtgaggtcatcagattaa

SEQ ID NO: 28216 - DNA, 1062 bp, Glycine max
  Peptide Sequence Number=SeqID_119901
gaaatggccccgaggaagcttgcctcaaagaggtccaggaaggacaaggcggccgaaggaactagttccgctcctgagtatgacagtcaccgctttaggagcgctgtacaccagcagcgcttcgaggccatcaagggatggtcgtttctccgggagcgacgcgtccagctaagggacgacgagtatactgatttccaggaggaaatagggcgccggcggtggacatcactggttactcccatggtcaagttcgatccagaaatagtccttgagttttatgctaatgcctggccaacagaggagggtgtgcgtgacatgagatcctgggtaaggggtcagtggatcccgtttgatgccgacgctatcggccagctcctgggatatccgttagtgctggaagagggccaggaatgtcgagtatggccagaggaggaaccggattttgcccggactgctgcagggaggcgggtgcgaatcatgcgcaccaacatgaccaccctgacccagatatggatgacgttgctcctcagcaacatcctgcccaccgatcataattccgacctccccatgccaaagtgtcagctggtgtacgccatcctgacacggatgagcatccatgtggctcagttgatcactgatgccatctatatttttgcaggtatggcgcccactaggcaccctttggacccagataagtccaacagggccctgggattccccgcactgatcacaggactctgccagtcgttcggggtccccgttgcacctgccaaggtgattcggccgcccatcacccgggcttttattgagaaatactgtacccagagacaggctcaaggtgatgctccacaggccgcaggcgcgcccccaccacctcatcaggctggccaggctggggcatttgacatggagcagtatttacggcatttggttcgccagcaggcggccaaccaccaagcacatgtacggacccatgattgtctgtaccagatgagccttagcatgcagagccagggcttcgcttctttttcatgccctactccagaccagttcagggcagag

SEQ ID NO: 28217 - DNA, 147 bp, Glycine max
  Peptide Sequence Number=SeqID_119902
atgatagacaccttagagccctacaatggggcaatgagaggcaccatgcatgagcctcaagtgaacctaggggcagatcaaaattcctcacccggttttgtcccaaaatccaaactacaaaaaggatctagtcaagatttgaaatga

SEQ ID NO: 28218 - DNA, 245 bp, Glycine max
  Peptide Sequence Number=SeqID_119903
tgcgtggcgagaaagtcgctagcgcacaggattttgtcggcaatcaaagggagaggaccactttaggtcgtgggcgaggattgacattctcaccctgggtcaaggtttatgataagttgggattttggctcaaggcttgtagaacggctggtcatgatacatgtcaggatttggccagcgattcggggataaaggggatgtacccacattattcccatgatacacatgcaacaaatgatgaatag

SEQ ID NO: 28219 - DNA, 699 bp, Glycine max
  Peptide Sequence Number=SeqID_119904
atgcctaatcaactcaaaagctaccttattatagcagcactctcagccctttatttgaattcttctgcccagcacatcaacatttaccataaggattggatcgattttaacaaaaatgggaaaaaggatatttatgaagaccccaaacaggacatagccagccgtgtggaagatctgttgcgtcaaatgactgttcaagaaaaggccaatcagacagtcacactctatggctacggaagggtcttgaaagatgaacagcctacagcggcttgggatcaggagatctggaaatatggcttggccaatatcgacgaaatgttaaatagcttagcttataacaaatctgcaaaaagttcattttcatacccctttagccgccatgcgcaagcactaaataatgttcaaaaatggtttgtggaaaatacaaggcttggtattcccgtggactttacaaacgaaggtattcatggactcaaccacgatcgggctacttccttaccagcaccaatcaatattggaagtacatggaatacgtcgctggtgcgtaaagctggcgatgtaattggcaaggaagccaaatatctgggctataccaatgtctatacgcctattcttgatgtttctagagatccacgctggggaagagtggttgaaacctatggcgaagatccatttcatatcgccgagatggggaaacag

SEQ ID NO: 28220 - DNA, 411 bp, Glycine max
  Peptide Sequence Number=SeqID_119905
atgcagtcacaaggactcgcactgccttctgaacttgaggttggtccttcagttgatcgtgtcagcacaaagaagagttgtgttgatccttcagggaacaatccagacacgggttactcaggcaaatgcgggttgtacatcaaagaaaaccctccccgcctggttgccctaggaagagtttatgagggatccacaatcgtttacaacattcctttgttgcatgatcaagtcaaggttggtgttgaggaggttagagatgcagatactcccattcctgtacccactgaagagggagctgtgggactcgtgaaacctgtagataggtcggatcatgaggtcgatgatcccctatgtctaatgacattgatcatcccacagctttttctgaagccattgcaggtatatgactga

SEQ ID NO: 28221 - DNA, 727 bp, Glycine max
  Peptide Sequence Number=SeqID_119906
gaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccactcggctgtgaaatacttgcagcttgctaataagctcttctcgcaagctgagctttttcatttctgtgcaagcattctggaacttgtaatcccagtttacaaaagcaggagggcttatggacagttggctaaatgtcacacattacttactaatatctatgaatcaattcttgaacaggaatctagtccaattcctttcacaaatgcaacgtactacagggttggattttatggtgttagatttgggaaacttgataaaaaggagtatgtatatcgtgagcctcgtgatgtacgtctaggtgacataatggaaaaacttagtcacacatacgagtctagaatggatggtaatcacactttgcatattattccagattctagacaagtgaaggcagaggagttgcagcctggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 28222 - DNA, 786 bp, Glycine max
  Peptide Sequence Number=SeqID_119907
atggaatctgccaatgaaattttaggtttcgatatgttatcccttatgtttaatgggacagaagaagatctaaagaaaaccgaggttactcagccttctatttttatacattctgtagctgctttaaaagctgtaaatggacttggtgctgaaatggtagccggtcactctttaggagaattttcagcattggtcgctaatggagttctgtcttttgatgacggtcttaaattagtttctgaacgagcaaaagcaatgcaggaagcttgtgatattaatccaagctcaatggctgcaattttaggattggaagatgctaaagttgaagaaatttgcgcacagatcaatgggattgttgttcctgcaaattataattgtcctggacaacttgtaatttcaggagaaactgctgctgtggaagaagcttgtattaaattgaaagaagcaggagcaaaaagagcattattgctacctgttaatggggcttttcattctccattgatgcaacctgcacaagaaagattggccgctgctattgaacaaactaaattcagaaaagcaacgattccagtttatcagaatattaccacgactgcagttacaaatcctgacgaaattaagaaaaacctgattgctcagttaacaggtcctgtaaaatggacacaatctgttcagaatatgattaaagacggagcatctaactttgtagaagttggaccaggaaaaactttacagggattgatcaagaaaattgatagttctgtagacgttgcttcggcaatctaa

SEQ ID NO: 28223 - DNA, 159 bp, Glycine max
  Peptide Sequence Number=SeqID_119908
tcaatgtatcaccatgaagtgacagtcatattgttgataaaaggctttaaacacactgtggctaatttctgtatggtttttttagggctatcatttactactgctaattggcattgctgtggaagcgctttgattatatctttgaagcctcaaagtcag

SEQ ID NO: 28224 - DNA, 235 bp, Glycine max
  Peptide Sequence Number=SeqID_119909
atggccggagcgcggctggctggcggaaatcacccacagcgaacgttccaccggcggtgcgccgctgaacgtcctgctgacgctggcaaaaatgcacgttggcctgccgctgcaggcggtgggcctgattggcgaagacagcgacggagactacattctggcgatgctcgaccagtatcacgtcaaccgccagcgcgtgcagcgcaccacctttgccccgacctccatgtcgcag

SEQ ID NO: 28225 - DNA, 297 bp, Glycine max
  Peptide Sequence Number=SeqID_119910
atgtcactagaggttcatgcacgatgcccctcgttgccccagtgtaaggatttgaggtaccaatcattgttgttcgtcatgacgttggtagcaggaacctattgggtgagaacttctaacctgcccctaggttcgtttgagggctctaaggtatccatcgttgttttgttttcacaaccttgtagcaagggagaacgaaagaagcagttgattcttgcaaaaagaattttccaaggacgagaaatggttgaaggatttttttcagttgatggattaagtcaaatgactcctatgtag

SEQ ID NO: 28226 - DNA, 48 bp, Glycine max
  Peptide Sequence Number=SeqID_119911
atggagaattgcactaagcaatcagtacgcatggctccaaactcgaag

SEQ ID NO: 28227 - DNA, 110 bp, Glycine max
  Peptide Sequence Number=SeqID_119912
gatccccaatcagtatactcgtcgtccctgagctggacgcgtcgctcccggagaaacgaccatcccttgatggcttcgaagcgctgctggtgtacaacgctcctaaagcg

SEQ ID NO: 28228 - DNA, 177 bp, Glycine max
  Peptide Sequence Number=SeqID_119913
atgaggatctcaagaaagctcataaagttcactaggttgattttgtcctggaaaccacttcctctggtagtgtataagatgcctctgtttgtgaggaagtcaaggcactactggatgaaaaggactcagatctctggatggaatgtcagcatgacaaaaagatggcttttgatttga

SEQ ID NO: 28229 - DNA, 378 bp, Glycine max
  Peptide Sequence Number=SeqID_119914
atgggtgccttgatcactaacgatggctctagggactccaaacctgcaaaacagattagatctaacaaaatctacaacaaccttagcatcgttagttttggtgggtttttaagcaatcctaccctccaagggtattggatagaagactccaagaggcttgggccagagctactaatgaaggccctaggctccttcttccatggcttattccctagtggatggcgcctcctctcacctcttctcctttgtcttccactgcatctccatggtggaaaatcaccattaaaggacctcattgatgctcaaagatccaacatccatagaagccccacaagcaagcttccatcaggtttggcttccacccattttgagacataa

SEQ ID NO: 28230 - DNA, 339 bp, Glycine max
  Peptide Sequence Number=SeqID_119915
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttatacaaaattgtcaaagctggatcagggaggagccatacggtggttgttacggaggatggaaattccctagcatttggatggaacaaacatggacagctaggttctggttctgtgagaaatggtatgcttgttttcagtgtatctgtaaaaatcggcaatttctgctaa

SEQ ID NO: 28231 - DNA, 144 bp, Glycine max
  Peptide Sequence Number=SeqID_119916
atggccagcagcggggcaacagacgcaccgccatcacctctagagttcacctctgctcatccacaaaaaggtttgagtattgcctacaccacatggccgaccaataggcgaccaagtccaaagccaaaggtaggacgcacctag

SEQ ID NO: 28232 - DNA, 51 bp, Glycine max
  Peptide Sequence Number=SeqID_119917
cctcgagggtccgtcccatccctggaaaatgctatgaggtgttgggaaatg

SEQ ID NO: 28233 - DNA, 954 bp, Glycine max
  Peptide Sequence Number=SeqID_119918
atggaaatcaaggacgtgcgcctggtctacgcgcccccgggcagcgtcggcaagttcggcggcgacgtcgacaactggatgtggccgcgccacaccggcgatttctcgttctaccgcgcctacgtgggcaaggacggcaagccggccgccttcgccgccgacaacgtgccgtaccagcccaagcacttcctgaagttcgccgaccagccgctgggcgccgacgacttcgtgatggtggctggctacccgggccgcaccaatcgctatgcactggccggtgagttcaacgaaaccgccagcttcacctacccgaccatcgccaagcactacaacgcggtgctgaagatgatcgccgacgccggcaaggccgacgccgacgtcaaggtgaagtacgccgccaccgccgccagcatgaacaacgtggccaagaactacctgggccagctggaaggcttcaagcgcatcgacgccgctggtcagaagcaggctgaagaagccgccgtgctggcgtggctgaagaagcagggcgctgccggcaagccggcgctggccgcacacgcgcagctgctcaagcatctggataccagcaagtcgacccgcgaacgcgacctgttcgtcggccagttcaacaacacctcggccgtggcgctgctcgatgcggtcaaggccaagcgttacggtggcctggaagacaagcgcattggttcggtgccggtgaacttcctgtccaacctggacatcaccggtggcaactcgggttcgccggtgctggacgccaacggcaagctggttggcctggcattcgacggcaactgggaatcggtcagctccaactgggtgttcgatccggtgatgacccgcatgatcgccgtcgacagccgctacatgcagtggatcatgcaggaagtggcgccggcgccgcagctgctgaaggaactgaacctggcgaaataa

SEQ ID NO: 28234 - DNA, 480 bp, Glycine max
  Peptide Sequence Number=SeqID_119919
ggtggcacgcttcaccttaagaggactacacatcctcgccatcagagggttgtacaccctcacctttagaggactacacgtcctcacgactgcacgtcccctcgagccctccttcagagggctacacgccctcgcctttagaggactagacctctctcagaggactagaatcctcgccatcagaggactagaagtcctcgccatcagagggctgcacgcccttacctttgagaggactacacgtcctcgctatttagaggactgcacaggactacacgtcctcgcctttagagaacttcacgtcctagagggctgcacgctcttcagaggactacacgtcctcgtcattgagggctgcacgccctcaccttcagaggactacacgtcctcgcctttagagaactgcacgccctcgtcttcagaggactacacgttctccccatcagagggctgcacgccctcaccttcagaggactacac

SEQ ID NO: 28235 - DNA, 627 bp, Glycine max
  Peptide Sequence Number=SeqID_119920
atggtagaatcagtcggggcactgagaggcggtggtttaccctgtggcggatgtcagcggttcgagtccgcttatctccaactcgtgaacttagtcgatacaaagctatatgatagcacttccatttttccgattcggcagtttgatctatgctatgatttatcattcatggacgttgataagatccttccatctagcagcaccttaggatggcatagccttaaagttaatggcgatgttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaccagaggaaaagaaagcaaaagcgattcccgtagtagcggtgagcgaaatgggagcagcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaatga

SEQ ID NO: 28236 - DNA, 198 bp, Glycine max
  Peptide Sequence Number=SeqID_119921
atgcggtcgggcaagtatgccccatcgtctagtggttcaggacatctctctttcaaggaggcagcggggattcgacttcccctgggggtagggtgctacgaaaggagttcaattggtcaggcccgccctgtcaaggcggaagctgcgggttcgagccccgaatcagtcccgatggatccaaaagaaatgaagttttaa

SEQ ID NO: 28237 - DNA, 918 bp, Glycine max
  Peptide Sequence Number=SeqID_119922
cccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgtgcgtgcacgcaaagggtcgtcgatgggtccagaactgaccggctcgcacgtgattggtctcgagcgtggctcatccaccattttatcacggcgaagtcggccatgaacccagattcaaccaaccacgaggcgggtgctcgcgggaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggtagatga

SEQ ID NO: 28238 - DNA, 429 bp, Glycine max
  Peptide Sequence Number=SeqID_119923
acacttgttagcactgccacacctcttgggcttgaggttattcctcaagtgaaggagttgttggatgagggggttcccacggaccctgagagaataaaggtcactcctgattggcccactccaccaacaccactcattgagttggtgaggaaccatgttccctcatgggaagatgtccatgaaaggggtgttgagggaaagagcccagagtataaagaacctcgggatttgaggtcaaatcctttccaaggtggaggggatgatgcaatcctaccccctaaggctctagcttctcaactcaaggaggtgagcttagctattagagagcttctcaaggaagttttctcaaagaagcttctcaaggaagttttctcaaagaagcttgtcaaggaagttttctcaagaaagcttctcaaggaagctacctag

SEQ ID NO: 28239 - DNA, 453 bp, Glycine max
  Peptide Sequence Number=SeqID_119924
atgtcttcgtacgtcattgggagtggggtgaattccggaaatggcctcggagggaaattccttgtcgtgttggaattaccggccgggcgagtcgtgtttggagttggaacttggggagcttccctctgggtgagtgccttaggctgcacgggtgttgaactagaggcgttcccgagtgtctactatcatggtgatcatctctctctcaaccatgggaggagctacttatgccgccaaatccctccaccgctgcgcatattctttaaaggtttcaccctctttcttgaacatattctgcagttgagtgcggtcgggagccatatcagaattgtactgatactgcctttggaaggcagtaatcagatccttccaagtacggatacgggaagcttccaaattagtgtaccacactatcgcggcttcggccaagctatcttgaaagaagtgtattaa

SEQ ID NO: 28240 - DNA, 669 bp, Glycine max
  Peptide Sequence Number=SeqID_119925
atggatgagaagacaaagaaaaaattggaggaagctgatcaatccggaagcactgaggccgtgattgaccctccatctcccatcagacgacacgttaagtggaagatggcccgcaccaagaaaactggacagatgacgtctgaggcaacaaaggaaattgctaagaagattgattctttggaggagcaggtgtcacagggttcctttgtcccctatggacgtcaagatctcctgactgttgcaattgggcaaccagaacaccctgaccgtgttcgtactgctggaattggtgtgaccataaagcaatactttggatcggctccacaaacctcccgcacttcttcctccatggctcccgaagaactagagcaactgactcaacaaatcaggggccagctggaggagttgatcacagaaaaagtgactcggcagctaatatgcaatcacagggacttgcactacctccggagcctgaggttggtccctcagctactcgtgtcagcacaaatgggagttgtgttgatccctcagcgatcgatccagacacgggtgactcagacaaatacaggttgtacatcaaagaaaatccttcccgcctggttgccctatgaagagtttatgagggatccacagccattcacaacatctctttgttgcatggccaagtga

SEQ ID NO: 28241 - DNA, 723 bp, Glycine max
  Peptide Sequence Number=SeqID_119926
atgaacagccgtctcatcagtggagtgttgcgcacgctgactaccagcaaacagggcggtcccacaggaatgatggcactcatgacttcgagccacaccatgatctttcggcgtcctgaacaggatgaagtattttcggaggcagtcaacctggtgtttgccggaccgggtagcgtagctgcggctctaacagccatggtctaccaattgggaacacaggaaggtcaactatggcaggagaagctacgaaaggaggctgatgtcgaagcactaccattctccctcgagcttcaagcggttgttaaagagactctgcgtcattgcgcctcttttccgacagcttttcctcgagtcatcagacgcggtgccgaaactatagtatccactcttccagctccactccccatcggtaccacagtgtcggcaaattcctatgttttaggccggtcgcgtaaaatttggggccacgatgctgatcaatggcttccacagcgatggctaggggacgagtcacaacgtcgggagattgaagccaaactggtggctttcagcaaagggtcgcgaggctgcgttggtaaagaattggcctggctagtccttgcaaaggcagtcatggccatcattcgacgctggaagtttgtgagcgtaggggagcttcgggggaagagttatctggaaatgcagtatgacgattgttggattgagtatgaagaattagcgtga

SEQ ID NO: 28242 - DNA, 222 bp, Glycine max
  Peptide Sequence Number=SeqID_119927
atggagataaaggagcaagttagcataggacaccagaattggggtgagttctacaggctttttgctgcaaaattccttccttggttggtgttttggtttgtgctaaaggtggtgtttagcattggttgtgtggaatggcagccacaacatgggttccttcctcattctcaccctcttcatttgccccagttttctcattcgtccaagcagcaagcaggataa

SEQ ID NO: 28243 - DNA, 531 bp, Glycine max
  Peptide Sequence Number=SeqID_119928
atggggacaaatcaaaacggaaaaagattctatcaagtcaagattaagggcctagatgtcaccaaccttaacgagttgggacggttgatgggacccctccaaaggcaagccttccacaaagtgtatggaaagattttagatttgaccacaatggaggtatttacagaagccattgtatccctcgcccaatactatgaccagccgttgagatgcttcacgtttggggacttccaaatagtaccgactgttgaagaatttgaggagatattaggatgccctcttgggggaagaaaaccgtatcttttctctgggtttcttccctccttgagcaagattgcagctgtggtcggagatttggcgagagagttggatcgtatgatgcaaactcgaaacggcgtagtgagcctaccgcataaatacttggaaggcaaggtgatgcaatcctaccccgcaagggcattggatagaagactccaagtagattgggctagagatccaagggaaggccttagggttctcatgagccttagg

SEQ ID NO: 28244 - DNA, 466 bp, Glycine max
  Peptide Sequence Number=SeqID_119929
atggaaagaaaaacaagagagaaaagagtggaagaaataagtcaagatgaaagagacaaaataagagaggaagaaagaaggaaaatactaaaagagttaagaaaagaaaaacatgcctcctatggtagtcataactcgtgcaagagcctaagtgaagaactccgtgactattatgaaggaagacataggtcacatcttagacctcactcccataggagagaaaaggaaagaaagcctcaagaggctaacactaacctcccatactttcatgggaagtacaatgtagaggctaacttagattgggaaataaggatagaacaacaacttaaaaggaagtctacttcaaaatcttatggctctcactcttatccaaagaaagaccaaggtcaaggcatcttaggggtgacaccttctaagcccaaagatgataaggggaagataatagaaaagcaaccccttaaggcta

SEQ ID NO: 28245 - DNA, 261 bp, Glycine max
  Peptide Sequence Number=SeqID_119930
atgaaatggaacttcaacgtctcaacccaaaatgaagagactgacaaaaggaaaagaagcatagcattcaaagcctcctgctcaatgcaagaagaagaagaatctgatgatgaagaggacttttcactctttgtgaagaagtttcataaattcgtcaaaaatagaagaatagagagacgccataacttcaacaatgggaagagatctcaagaaggttccccaacacttaaattctataagtgtaatcgacccgtcacataa

SEQ ID NO: 28246 - DNA, 486 bp, Glycine max
  Peptide Sequence Number=SeqID_119931
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaacccggaaagacatgcaaaagcaccactggcagcagccactggtaattgatttagaggagttagtcttgagtcatgcgccggttaaggctaaactgaaaggacagttttgtgactgcgctcctccagccagtacctcgtcaagagtgtag

SEQ ID NO: 28247 - DNA, 71 bp, Glycine max
  Peptide Sequence Number=SeqID_119932
ttgtcgaggaacgcctacaaagcgttgggaaggctagtggtggtaccattggtatccttgaggatatatag

SEQ ID NO: 28248 - DNA, 153 bp, Glycine max
  Peptide Sequence Number=SeqID_119933
atgtctgaagaagttgatatgaatgaacaaaatgaagacaaagctagtgtgaatgaagaacatgttgattgttctgatgtgttcaatacttctcaggagtggttagtatatggccaaaaagaaagatttggtaagaacagttactggcagtag

SEQ ID NO: 28249 - DNA, 477 bp, Glycine max
  Peptide Sequence Number=SeqID_119934
atggatttacaggtcgttccaacactggatacgttacgtcaatggctcgatgatgcgggtattacgttctttgaatgtgattcctgccaggcgctgcatctgcctcatatgcagaatttcgacggcatttttgacgccaaaatcgatctcattaacgacgtgatcctcttctccgcgctggccgaagtgaagccgtctgcgctgctggcgctggcctcggacctgtcagcgatcaacgccagttctttgacggtgaaagcatttctcgacatacaggatgataatctgccaaaactggtcgtttgccagtctttattctccggtgccgggctgtcgttcaagcagttcgcctggtttatgcgcttgagcgaagagcaaatttccatggtcatgatggaagccagtgcacaccatcttctgtacagcgcggaagatgatgcagagaataatgatgcatctcccaattttcttcactaa

SEQ ID NO: 28250 - DNA, 539 bp, Glycine max
  Peptide Sequence Number=SeqID_119935
atgggggataagcttcatcgtcgagagggaaacagcccggatcaccagctaaggcccctaaatgaccgctcagtgataaaggagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggggctacagcgctgaagtaatccatgccatactccaggaaaagctcgaacgaccttcaacaaatgggtacctgtacccgaaaccgacacagtgccggaaggtcaaggaagttggtgacctgatgacaggggagccgacgaccgaagccccggtgaacggcggccgtaactataacggtcctaaggtagcgaaattccttgtcgg

SEQ ID NO: 28251 - DNA, 120 bp, Glycine max
  Peptide Sequence Number=SeqID_119936
gaaaaggaaggaggtgcttgccacccagctcgcctagacgagctaggttgcttcctccagaaggcgatcctggaaggcccaagtgggcctggttgctatttgcacccccctatttactaa

SEQ ID NO: 28252 - DNA, 210 bp, Glycine max
  Peptide Sequence Number=SeqID_119937
atggggactaagatgaagcgatgtccgtttgaagccttaggctcgatggttctgatcacgtctatgcccgacatggagaatggccaaggtgctgccgagacgtttaacgatacaggcttaccacgacatctgaattcgatgtacgacaaatcttcgtgcatgcttagttggaacatggacgctagattggcaagtgcgtcgactatctga

SEQ ID NO: 28253 - DNA, 348 bp, Glycine max
  Peptide Sequence Number=SeqID_119938
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggtaacgccagggttttcccagtcacgacgttgtaaacgacggccagtgccaagcttgcatgcctgcaggtcgactctagaggatcccccactatttggcaagatttag

SEQ ID NO: 28254 - DNA, 276 bp, Glycine max
  Peptide Sequence Number=SeqID_119939
atggttattggtgagagtttctcgttcgttgttgtgtcctctttggtggttggtcagcaagtggtgatcgtggcggtggctggtttggtcgatggaggtaaggtgtttgctacccgtgatgatgttctagaatgggctcgatctgttgcttatgaaattggatttgtggcgataattatgaggttagacacaaataatggtattagaggaaggaccttatttgttttaattggttgtgaaaggagtggtcaatatagggccaagaagaaggatttg

SEQ ID NO: 28255 - DNA, 405 bp, Glycine max
  Peptide Sequence Number=SeqID_119940
atgaccaagcaacaaagatctacaaagtgtgatccctcatactgggagtatgttgatgcattacattttatgcataatattgctgccctcttaggtatgggtgaagattcatggtcattggtgcacaaccatttgcataaagaacttacaaaatggtctgatgactatatcaacttggttaccatggacaagtggatgaatataactgacatgggatatgtcattgtatcaaggtataatgtgatccttgtttctctttcactccaacaaagcatgatattttttcctcttagaagtcaaccaccaacagattcttttgagcatcacgtgatatgtatcggtcatgtgtatgataatcattttgttcaggtatttctaagagactgttgtcgttattgccagtag

SEQ ID NO: 28256 - DNA, 1101 bp, Glycine max
  Peptide Sequence Number=SeqID_119941
atggatcatgcgtatgatgaggtccatgaacaacctgaagaagcagctgctgatgatgtgctgactaatgccgaggattttccaggcgaaccccacaacacatcagtgttgcaagattatgtttatcatgtggtcacgaaagtttggaatggagaggaacgtcttgagctgaaattattctcccaaggaagaaaggtcgagaaatttggcaggcctgcccctgagatcgaagacttagtggctgccacaggattaagtcctctgatcacatgttcactgaacactagtgatcagggacttatgtctgctttcatggagaggtggcataaggaaactagtagtttccatctgccatctcttcatgtggatgatacagtcttgctcttagtggaattgcttgaagtaagtgttgaagaggcacaagttgagatagtacagtgccatggggcatattcccacacatgcccatgtggtattcttggatgcattgcccgaccggtgcatataaatgacaatctaaatgatgcgtcaaagagcatggccagacagcttgcaagatgtatcacacttttacagtgttggatctacgagcactttccctctgttggttgtgttgttgctgctgatgattatgatgagaggaaaccacgtgcctatcgttggaagtctaggaaggcattactagtatcaatgtatcataagcggttggctagattgacgtctgatgttgtatgttggattccgtatgaccattcctccgcccctgctgctccttctctcagtatagaagacattgatgatagatggattcagttttccgaatacattgcaccgcaccatgacacatttgttgaaccagatgttactcagcatccagtggtgacaatggctatgaatgaagcatctgaagatgcacatgttgatgaggcttgccaagcaatagctgaaaggttggagcggttgctcaacctaaggatagtcactgaaggcacaaagacatacaatgtcatggaagactgcctaaggattgctagaggtgtgactgcggatcgcaatgtatatgtgcggttgcaacgaaggtggcacattgaagtcacatga

SEQ ID NO: 28257 - DNA, 234 bp, Glycine max
  Peptide Sequence Number=SeqID_119942
atgagaaagcgccacgcttcccgaagggagaaaggcggacaggtatccggggggcggagcctatggaaaaacgccagcaacgcggcctttttacggttcctggccttttgctggccttttgctcacatgttctttcctgcgttatcccctgattctgtggataaccgtataccgcctttgagtgagctgataccgctcgccgcagccgaacgaccgagcgcagcgagtcagtga

SEQ ID NO: 28258 - DNA, 333 bp, Glycine max
  Peptide Sequence Number=SeqID_119943
atggcgatctatacttcagttctaaaaacacaggatgtaaaaaaagcaaaagatcttactatggtgatgcagaatcccgtatcctcatcactgatgttaaaacttaatccagccctgaaagaaaacagtgttactgtgactgttttcaatatgactggacaatctgttattactacgcagtaccgtagagaaatcaatgttacgactttatcttccggaagctatatcgccgtggtttcggatggagtgctttctgagaaaaaacctgcagaaatcagtgtcaagggatattcaaaaccggatgtactgcagctccggcttaacggaaaaccg

SEQ ID NO: 28259 - DNA, 171 bp, Glycine max
  Peptide Sequence Number=SeqID_119944
atggggtggttttataacgttccgatctacggtccctcggagcgaggggttaggcaggcgagcagtataagcccttctccggcctgggaaaagcagcgaactctagaagctagggcgttgttcacctttggacacgaacactattccgttctcagcgtaaacccgccttag

SEQ ID NO: 28260 - DNA, 375 bp, Glycine max
  Peptide Sequence Number=SeqID_119945
atgggagactcggacaaatgtgagttgtatgtcgatgacaatcctccccaattggttgctcttgaaagagtttatgacgggtcgacgactatccaaaacgttcctttaggaaatgatcaagtgaaggataaacaagtagctgagggaccggtgaaacctgtagatatgtcggatcctgacatcgatcccctctacctgatgacattgaccattccgcaacttttcctcaagccattgcaggtgttgtgggatgctagtatgtttggggtgtatagtgatatcttcccattgtacataaagcatgaaaatctttttgaaatagctcatggttgtcaatgtctgagcatctctgttatacagttgtggattttgtaa

SEQ ID NO: 28261 - DNA, 120 bp, Glycine max
  Peptide Sequence Number=SeqID_119946
atgaagaaacaacaatggaagagaagaggaagacaaaggagaagaggtgagaggaggcgccatccacagggaataagccatgggagaaggagcttcaccacaaagatgaggcttggataa

SEQ ID NO: 28262 - DNA, 145 bp, Glycine max
  Peptide Sequence Number=SeqID_119947
atggaggagttggttacaaaacacaactctcccaaaataacgccaacgtcatcacgttggctcggcggctcctcaccagaatcttactccctacaccctgccactgttattctgctcccacgaacaaggttcgtgatcatcacag

SEQ ID NO: 28263 - DNA, 219 bp, Glycine max
  Peptide Sequence Number=SeqID_119948
atgacgccatatgaagcatggttcaacagaaaaccaacagttgatcattttaaaattcaaagcagctcatcatttctagagatgtcatctttgacgaaggagcaagctggaaatggagtactgaagtcaatgagacgcaagaagcaaccaatccaagcccgtgcacactaccaccatcaccaacacaacatgaccaacatcaccagcaagaagaagtag

SEQ ID NO: 28264 - DNA, 1039 bp, Glycine max
  Peptide Sequence Number=SeqID_119949
ggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggtctcgtagggagcgtgcgtgcacgcaaagggtcgtcgatgggtccagaactgaccggctcgcacgtgattggtctcgagcgtggctcaatccaccattttatcacggcgaagtcgtgccatgcaacccagatttcaaccaaccacgaggcgggtgctcgcgggaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggtagatga

SEQ ID NO: 28265 - DNA, 330 bp, Glycine max
  Peptide Sequence Number=SeqID_119950
atggatgataacactgagatggaagtgaatgagcctgagacaaacacgacaactcagaacatgtcttcgacaaaggaaaatggacagaggaagagaagtagagagggtgacaaaagaattggggttgctgccaagctttcctcacaattagatcgtattattcaaacatttgaatctagtgtatctgctcaagacccaactagcattactgcatgtgtagtaaaattgaaagatctaccaagacttgagtgtgggagatgtcttcatcattatcatcaaatgactcttcatctggcgatgacgatcacattacgaagaacaaagtgttga

SEQ ID NO: 28266 - DNA, 836 bp, Glycine max
  Peptide Sequence Number=SeqID_119951
atgtggatggatcggtttgctcttaccttgaacgggagtcaagaacttccccgcttgttagccaaggccaaggcgatggcagacacctactccgcccccgaagagattcatgggcttctcggctattggaaaaacaccataactaaacgcgccacaaggcatccctattgcaccagatccaaatctagaacgatgggtgatcaagaggagacacaggaacagatgaaagccgacatgtcggctctgaaagaacaaatggcctccatgatggaggccatgttaagtatgaagcagctcatagagaagaacgcggccactgctgccgctgtcagttcggctgccgaagcagacccgactctcttggcaactgcgcaccatcctccctcgaacatagtaggacggggaagggacacactggggcacgatggcagccctcacctgggatacaaccgagcggcttacccttatggattgtcgcccaactactcaccacccgtcttgcaagaagatgcgggccacattgcttctcctgtccttgaaagagagcctcctcaacagcccgacgaagtccacaaagactctcaagactatgctcgaagggatgtcgagttctatcccccgatccccgaagggccggcaccaggcacgttgcttcaacccaacatcgcggcatcaccaatagttttgtccacggaaggaccgccctcagcaactgaagaaaggaggaagctcaatctccttgaggaaagattgagggtcgtggaaggatttggggactatgcgttcgcagacatgacggatctttgcttagtacccgatgttgttattcccccgaa

SEQ ID NO: 28267 - DNA, 118 bp, Glycine max
  Peptide Sequence Number=SeqID_119952
gggatgtcctatagccaatgtgtggagggcaatagaaataattggaaaccttaatgtgatgctaagtgtagagagtgagagagagaatgggaacttagtaactcatgaaagacattga

SEQ ID NO: 28268 - DNA, 349 bp, Glycine max
  Peptide Sequence Number=SeqID_119953
ggatcgcgactgcaagacacctagtggacccgaagaaggccaacagtgtcttggagttgccagctctaaatacgggtctctatcagttcaagggagtgcctgttgcccccagcagggtcatcaggccccctaccaatcgagttttcatctagaagtgttgcgcccccaggcaggcgcagggcgagacaccacagcagcattgggatggacggtagcgggcaatagacacaccgccatcaccactaaagttcacctcagctcatccataaaaaggatgcacctagttgctcatgatcctggggatttaaataaaacaagcgcaagctcggaaggtagagagataccttag

SEQ ID NO: 28269 - DNA, 252 bp, Glycine max
  Peptide Sequence Number=SeqID_119954
atgacccctatagcccagtctaacacttctagacttggagccagaggggttgtctctgatagcctcacttttgagtgccttagcccgatcattaacttggcctacatcaagaagaactgttggaaccccaaggatctaacagtttctatccgagggatttggagagcgagggctaggccagctgagctcccttccacttctgcggctcctactctagcatccacgtcagcagctccttctgttccagcctag

SEQ ID NO: 28270 - DNA, 157 bp, Glycine max
  Peptide Sequence Number=SeqID_119955
atgacgtctcaggcagcaaaggaaattgttaagaagattgattcattggaggagcaggtgtcacagggttcctttgtcccccatggacgtcaagatctcttgactgctgccattgggcgactagaacacattggtcgtgtgcgtgttgctggagccg

SEQ ID NO: 28271 - DNA, 156 bp, Glycine max
  Peptide Sequence Number=SeqID_119956
atggaccctaagagaataaaggtcattcctgaatggcctactccaccatgtgttgaggaaagaatccctgagtttcaagaacatatggatttgatgtcaaatccttttcaagggagagggaatgatgcaatcctaccccacaagggcatcggatag

SEQ ID NO: 28272 - DNA, 297 bp, Glycine max
  Peptide Sequence Number=SeqID_119957
atgtttttcttacttatcaccatagcaaggaaagtccggtcattgctgttttggccgatgcttatgacaccttcgaccggagatgcgagaagagcagtgcgaggattgtttgttgcacacctgctctttatgtatggttggtctctcacatttttcgtcatgaaagttaactcgtctatcccctacaaggtcaccgcatgtgtaccgagaaagggaaagcaaattgggagcagctcttggcaggtttgcacacttgagctaacacctccatctagatggacacttcaaatacactag

SEQ ID NO: 28273 - DNA, 534 bp, Glycine max
  Peptide Sequence Number=SeqID_119958
atggagagtctcatccctgccactaaattggcatatgtgaagaagaactattgcaatcttgatgatctaacagtgactttcagagggcctcacaaggccaaggggaagaggtcagagactctcccattttctgagattcccctatcagcagctccttccattacaacttcatcttcttctgccctatctccatctgctccagcttcatctttaccagcaccagcttcagctcccactcctttgctagtggcttggccaggagtccaaccttctccttctagagagggtgaggcctccacagcccaagagcctgtgccagcagaggagcctgtgcaagacgcagaggatgagcttgagaaagcagtagctcaagagccaacttctccagttcaaatctctccagcacccattcctaaggattcccaaccatctgcaccagcatcggagccagcgcaacctattgttcaggatccacctgctgctccagtgttggatcttaatgagcatgcagaggatcacccgcaggaggattga

SEQ ID NO: 28274 - DNA, 414 bp, Glycine max
  Peptide Sequence Number=SeqID_119959
atggataaggcgcacgcggtcgggcaacttacgggggttcgtgcacacagcagcttcggaggaccgaaggagctaaccgtttttgcacaacatgggggatcatgtaactcgcctacagtgaaccgacgacgaagcggacaccacgatcctgtagcaagggtcggaacaacgatgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgaacggggagtcaggcaactaa

SEQ ID NO: 28275 - DNA, 303 bp, Glycine max
  Peptide Sequence Number=SeqID_119960
atgcaagagaaaaatgaagatgaagaatcagaagatgaagaagacttctcactcttcgtaaagaagttcaaaaatttgtcaagaagaaaagaatcgagaggcgtcaaaacttcaacaatggaaaaagatctcaagaagattctcaaattcttagatgctacaaatgcaaccaacttagtcacatcaaagcaaattgtccctcaaatgaggaatggcctgaaaagagtgataagaaaagagaaggagatcaaccttctaaccaaggactatgagagcgatgtgaacatctctcaagaagattaa

SEQ ID NO: 28276 - DNA, 237 bp, Glycine max
  misc_feature (158)..(158): n is a, c, g, or t
  Peptide Sequence Number=SeqID_119961
atgaggttccgtaatattccgaaagccataaaaggggatgattacgtaatctgtaagaaaaagaatcagcaaaaaaaggcagggggtgtatttagtaaacaaaggatgcaaatagcaaccaagcccacttgggccttccatgatgttcctccagaagncggtgccttctggaggaagcaacctagcttgcctgggcgagcaaggtggcaagttcctccctcattttcctataaatag

SEQ ID NO: 28277 - DNA, 634 bp, Glycine max
  Peptide Sequence Number=SeqID_119962
gggcccgttcccaatccgtccgccgaccggcacgcgacgaccccgctctcgccgcggaagcagctcgagcagtccaccgacagccgacgggttcgggactgggacccccgtgcccagccctcagagccaatccttttcccgaggttacggatccattttgccgacttcccttgcctacattgttccatcgaccagaggctgttcaccttggagacctgatgcggttatgagtacgaccgggcgtgggaggcactcggtcctccggattttcaagggccgccgggggcgcaccggacaccacgcgacgtgcgaaaagataactctttccggggcccccgccgacgtctccggactccctaacgttgccgtcagccgccacgtcccgatctgcaccgacgaccgctccgcccgggctcgcgccctgggttttgcagcgaccgccgcgccctcctactcatcggggcttggtccttgccccgacgcccgggttagcgcgcagttgggcaccgtaacccagcttccggttcatcccgcatcgccagttctgcttaccaaaaatggcccacttggagctctcgattccatggcgcggctcaacagagcagccgcaccgtcctacctatttaaagtttga

SEQ ID NO: 28278 - DNA, 237 bp, Glycine max
  Peptide Sequence Number=SeqID_119963
atggttcagtttaggaatcagtgccacaaaggaagcattacttcctctaggaaagctgccatgggcatagaactcatctacaaaccttctaaactctggtctcatgatatcccaaaattttttgataaagttgaagttaaggccatctggcccagggcatttgtcacctccacaattccacacaacttctttgagctcaagaattgcagtccccctccttcagccaagatatcctag

SEQ ID NO: 28279 - DNA, 1158 bp, Glycine max
  Peptide Sequence Number=SeqID_119964
atgcaagttgtggtcagggatccggcgagaggattggaccgcgtgaagcaaactcgaaacggcatagtgggcctaccacagaagtacttagaaggcaaggcgatggatatggtgaatcaagaggagtgggtcccgtttatggatgtattagcattgctaatctttggggttgtcctctttccaaacgtagatggtttggtggacctggcagcgatcgacgcttttctcgcctatcataaccacaaggaaagcccgattgtcgctatgctagccgacctatatgacaccttcgaccgaagatgtgaaaagagcaatacaaggattgtttgttgtactctagctctttatgtacggttggtttcacacctttttcgccaagaggtaaggcatgcttgcccgctagaaggtcaccgttcatgcacagagaaaggaggtgcaaattgggaccaactcttagcaaacaaagaaggagcgtctatcaactggttccctcgatggaaagaaggaagaaccggagttcttgtctcttgcggaggatttctgaatgttcccctgatagggacaaggggttgcatcgattacaatcccattcttgcgataaggcaacttggctacctgatgagaggggcaccactagaggaagagctcgcacttgtcatttcacgagggttcaatgagaccaatgtggagacgcttcggaaggtccgcaaagcatgggaagtggtacaaaagaaggacaaagagctgagaggcagtaacaatgggccaattggtggctactgtgagtggttgaaagcccatgtgcaaggtttggattggctcccaagtctgagaaccgctaaaagggaggaagttgaggcaccggaggaagacgaagacgtgcaagctcttaggacagaactcaagcaagctcaagtagtgaaagaaaggttcaaatcagcggctcttaagatccgaaaagagaatgccgaactaagagatataaatatagcaaccaccaaagccttggaacaagagaccaagagggctcgtagggaagagcacggccggaacaagttccgaggggctctgtggggcagtaacagcgagcttaagctccggagagaggaaagggaccaatcacgagtagacagtttgatcttgaaagatgagttgaag

SEQ ID NO: 28280 - DNA, 207 bp, Glycine max
  Peptide Sequence Number=SeqID_119965
atgcagctcccggagacggtcacagcttgtctgatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 28281 - DNA, 165 bp, Glycine max
  Peptide Sequence Number=SeqID_119966
atgaagcctttccttaaaacaaagtgtttccaagacatccaaggctcagatgtttgtaatcgattaccagcaacagaactcttgaaatttaaattcaaaagtcatgacccttcaaaatataactatgtagtcgattatcagaaacctgtaatcgattaccagtga

SEQ ID NO: 28282 - DNA, 450 bp, Glycine max
  Peptide Sequence Number=SeqID_119967
atggcgttccgtactgtattgtgtggcattatgttgagtcaacatcccaatatggtaaactacactgactctgtgatgaagagagaatcgcctctatccctgcattacaaattgtttgaggggacacatgtcccagacattgtctcgacatcagggaaagctgctgcttcaggtgctgtgtccaaggatgccttgattgctgaactcaaggacacatgcaaggtgctggaagcaaccatcaaagccaccacagaaaagaagatggagctagaacggctgatcacaaggctctcagaaagtggcattgatgatgaagaagcagctgaagaagaggaagaggcagctgaggaagacaaagaagcagctgaagaagaagaagaagctgctgaggaagaggaagatacagcagaagagacagaatcagatgatgattctgaagccaccccatga

SEQ ID NO: 28283 - DNA, 339 bp, Glycine max
  Peptide Sequence Number=SeqID_119968
atgaactttcaagcgttggaggtggtgagcaacgcctatgtcaagctccccccggtgcaaccacgttcatccagtgtcgcgttgatggtagccggtgtgatgttagggcatgggtacgagcccaaaatgggtttgggtcaaaatggagatggcgtggcgagcttagtagagttcaaggagaaccgcggaaggttcaggctaggatataagcctacacgtgctgatgtaaggagaagtgccctagaaaggaagggtaggagcatgggctcactgcgaggaccacaagagaaagggactcccttaagtcacatcaacaagagttttgtcagctcgggttag

SEQ ID NO: 28284 - DNA, 153 bp, Glycine max
  Peptide Sequence Number=SeqID_119969
atgaaaattctaagttcgggagttgtatttacgcttaaggaagggcgaggaaaacagcttaaacgatcagttaaagctcgtcaaaaacggaaagaaaagaaaccgaaattgaccgaaataaaaatgaaagccaagaatcaagaaatgaattaa

SEQ ID NO: 28285 - DNA, 1350 bp, Glycine max
  Peptide Sequence Number=SeqID_119970
atggaggtacctagaagacaaggcgaggggtatggccaatcaaggagattgggtcccgtttatggatgtgttagctttgctaatttttggggtcgtcctctttccaaacgtggatggtgcaaaaagagtagcgcacggatcatctgttgcttgcccaccctctgtgtttggttggtttcgcacttgttccaacaagacacaagacatccatgtccgctcctgagccatcgctcgtgtactgaaaagaggagaatagattgggaccagcttttggccgggataggaggtagaacaatcagttggttcccccgatggaaggaaggaaaagaaggagtccttttctcatgtggaggatacccaaacattccgctggtaggaacgaggggttgtattaactacaatcccacgctcgctataagacaactagggtaccccatgaggggagcaccgacggaagaaagcatgtctcctttccttgtgagggatttctgcgcacaaaattccaagactatacaaagaatccataaggcatgggaaaccccgttaaggaaagatcaagaacttagaggcattcataatggcatcattggtggctaccatgaatggttgaaagttcatatacgaggtttagattggctcgccaagttaaaagtcgtcagcgaagagagttttgaagcaccggaagaggacgaagaagtccaagctctcaaaagcgagttaggaaaggcgaaacttgccaaagagaagttcaagttggccgctacacacatccggaaggagtatgccggattacgggaagagaatgcaattaccaccagagcccttgaacaagagaccaagagggctcgcaaggaagagtatggccggaataaatttcgcggagctctatggggtagcaatagtgaactcaagctgcgaagggaagagagggaccagtcgcgagcacatagcatggttctgaaagaggagttagttgcttgttcaaggtccaaaagaagcttgtctcagcgtttatgcgagacggagaccaacatgctagctatcatcgccaagtaccaagaagagttaggtctagccacggcctacgagcatagaatcgcggacgagtatgctcaagtatacgcggaaaaggaggctagaggaagggtgatcgactctttacaccaagaggcaaccatgtggatggatcggtttgctcttaccttgaatgggagtcaagaacttccccgcttgttagccaaggccaaagcgatggcagacacctactccgcccccgaagagattcatgggcctctcggctattgtcagcatatgatagacttaatggcccacataattagaaatcgttag

SEQ ID NO: 28286 - DNA, 234 bp, Glycine max
  Peptide Sequence Number=SeqID_119971
atgaccccttcgcagcaacatgatgccccaatggcaacacctaatgccccattaggtctgcaatgggatgtgttgatttgcgtcacgagttttctgcagaggctgagcaataagggtagagacagcgcgcaagaagaaatccggatcgtcaagctcaaaggtgggatcgaccatgtggcacatcctcgcaccatcacggacaccataatgactgatatttatgtctctatttga

SEQ ID NO: 28287 - DNA, 207 bp, Glycine max
  Peptide Sequence Number=SeqID_119972
atgtcggctgaaatatatcagtcggggctatttcacgaccgatgtcggctattgagtatcaattcaatccgtgaacgaagtggtgcgagatgtcgattaggaaatgttcgatcggcgtcatccgatgatgcttcttttttagaccccgatctttcatctttcgtggccaacgtcgcctgtcatttttttatcaatatcggtgaataa

SEQ ID NO: 28288 - DNA, 523 bp, Glycine max
  Peptide Sequence Number=SeqID_119973
atgatgcaatctcaaggacttgcactgcctcttgagcctctggttggtccctcaggtcctcgagtaagcacaaaggggagctatgttgatccctcaggaaatgatcctgagacgggtgactcagataggtgcggcttatacatcgaagcaaatcctgacctcctggttgccttggggagagtttatgagggatccactgttgttcataacactcttttgttgcctggccaagtaaaggtgggtgtggaggaggttaaagatgcagatgttctagttcctatacccattaatgaggtttccttagtggggcaggcaattgacaccttccttgcttggctgatacatctgatcaagtctttatcacaacaggttgatgatccgctttatctgatgacattgaccatcccagagcttttcttgaggccttaccaggttacatgggatgccaccatgttcggggtctttaatctagacttcccgctctacataaagcacgaagacctctctgaaatcgcacacggtg

SEQ ID NO: 28289 - DNA, 89 bp, Glycine max
  Peptide Sequence Number=SeqID_119974
cggaatggagaagaagaagagttgagaggagatgccacttcaaggagaagatgagtcaagaagaagctcaccaccctaggaagccataa

SEQ ID NO: 28290 - DNA, 288 bp, Glycine max
  Peptide Sequence Number=SeqID_119975
gtcgactctagaggatcccaccctgtcacctccagtaagggcatcaggccccctactaatcgagctttcatcaagaagtactgtgtctccaggcgggtgcagggcgaaacaccacagcagcctggcgatggccggcagcgggcaacagacgcactgccatcacctctagagttcacctctgctcatccacaaaaaggtttgagtattgcctacaccacatggccgaccaataggcgaccaagtccaaagccaaaggtagaaagataccttggatatgcatgtatatag

SEQ ID NO: 28291 - DNA, 168 bp, Glycine max
  Peptide Sequence Number=SeqID_119976
atggcaccagaggatatggaaaagactaccttcgtcacccctgtgggaacattttgttataagctgttcgaaaggcttaggaagtatgaattaagggaagttgctaggtttcatcgtaagccagaaagggatagaggtggaccccgaaaaggtgaaggccatccttga

SEQ ID NO: 28292 - DNA, 438 bp, Glycine max
  Peptide Sequence Number=SeqID_119977
atgatacgcggagataccttacggttattcgcacccttttgtcatccagaggcgtcgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaaaggcggcgggcccgatgatacgcggagataccttatggttattcgcacccttttgtcatccagaggcggcgggcccgatgacaagcagagaccaaatttggtcattctgcacccttgtatcatccagaggcggcgggcccgatgatacgcggaaatacccgagtggttatccgtataaacattcttttgctatctgtaagacagaacgcttgatagcatgcagagactga

SEQ ID NO: 28293 - DNA, 234 bp, Glycine max
  Peptide Sequence Number=SeqID_119978
atggtctccgtgaagttccgcggcatgccggaagtcgaaagggagcattgtcgcacaatctgtaaagttctgcaacattccagagaaaaagaatcagcaaaagaagcaataagggttgtatttagtaaaaaggggtgtgcaaatagcaaccagtcccacttgggccttccagggtgttccaacagaaggcggtgccttctggtggaagcaacccagctcgccttggcgagctga

SEQ ID NO: 28294 - DNA, 210 bp, Glycine max
  Peptide Sequence Number=SeqID_119979
atgaacgaagaacgggggaaagagggaggtggttgccgcccagctcgcctaagcgagctggctggaaggcccaagtgggcctgcttgctaacaatgggtgttaagtacttcgagcggtcaagcaaaggttgcaggccatcaaacaatggtccttggatgaaattagggtttgacagttgcccttctttacttatcttttattggagataa

SEQ ID NO: 28295 - DNA, 252 bp, Glycine max
  Peptide Sequence Number=SeqID_119980
atgtcaggatttacacgcgattctcctcaaatttcagccagcctgcatcaattataccttgcaccttacgcttcagggtcctacaatgttcaatggaacgccctggggcttctccataacaagcacacgttgcgttcgagtcgtattctcagaaaaatggaggttgaggaaccctggcaagggttatggctaccattgcattatcaagtagatatgggagcaagtcagcataggacaccggaattggggtga

SEQ ID NO: 28296 - DNA, 656 bp, Glycine max
  Peptide Sequence Number=SeqID_119981
aggatatcttggatgaaatacaacatgagatctccaaatgccaggtcgaagttgaagctgaagctgagtctcaaacctgcacttgcaacgtaccaaatttcttcaaatcttctcctgctagttcctttaacagggaaattaaatcaaggatagaacaggtccttgagaaccttgaaaatcttgctaggcaaagtggctatctaggtttgaaaaatgcaagtggtgttggatcaggatttggtggtgcagtatcacagcaatcacaatcaacatctttgcttgttgaaagtgttatttatggcagagatgatgacaaagaaatgatcgttaattggctcacatctgacattgacaattgtagcgaactatcaatactttctattgtgggcatgggtgggttggatgaatttgatgttttcaatgtaacaagaacaattcttgtggaagtcactaaatcaactgatgatagtagaaaccgagaaatggttcaggaaaggttgagattaaaattgacaggaaagagattttttcttgttttggatgatgtttggaacagaaatcaagagaaatggaaagatttgctaactcctcttaatgatggggctccagggagtaaaattgttgtcactacacgtgacaagaaagttgcttcaata

SEQ ID NO: 28297 - DNA, 743 bp, Glycine max
  misc_feature (250)..(250): n is a, c, g, or t
  Peptide Sequence Number=SeqID_119982
gccaagacttcagggaaaaaggtgcctggaaatgtccctgatgcaccattggacaaacatctctttccactccattggcaatgttgaaaagtggaaatatgtgtatcaacgcagacttgcggttgagagagaactgggaagagatgccttggattgcaaggagatcatggacctcatcaaggctgctggactgctgaagactgtcagcaagttgggagattgctatgaaggcttagtcagggaattcatngtcaacattccctctgacatatctaacagaaaaagtgatgagtatcaaaaggtgtttgtcagaggaaaagagaattccacatcttcgcacacaatactgaagccgtctcttcacccagcaaagaggaatcaacgagaagagttgaacgccacagaggagacccctgcaccacgggcaccagaacctgctccaggtgacctcattgacctagaagaggtagaatctgatgaggaacccattgccaacaagttggcacctggcattgcggaaagactacaaagcagaaaaggaaaaacccccattaagaggtctggacgaatcaagactatggcccagaagaaaagcactccaatcactcctacctcatccagacgaagcaaagtcgcaattcctctcaagaagaggaaagaaatttcctcatctgattctgatgatgatgtcgaactagatgtctcgacatcaaagaggaccaagacatcagggagagtgcctg

SEQ ID NO: 28298 - DNA, 534 bp, Glycine max
  Peptide Sequence Number=SeqID_119983
atgcaagggataacttggctcccgaagctaaaatgtccatgtagggaagaaactgaagtccctaatgagagcgaagaagtgcaagccttgaaagtagagcttgaaagaacaagagtggttaaggaaaagctaaaaatggcagtcaccagggtcaggaaagaatgtgatgagctaagggatgtcaacatgaccacagccgaagcgttagagcgagaaacaaagagagctcgaaaagaggaatggggccaaaacaagttccgaagggctttatggggcaacaacaacaaactcaagcttcaaagggccaaaaaagatgagtcaagggtggaaagtatgatattagaggataagttgagggcttgccaaaggtcgaagagaagtttgaccgaacagctaagtagtacggaagagaatatgttgacaatcatcgaccagtataaagagaagctaaacctagctgctagccataggcagagacttaaggatgagcatgcaaaggtatcgactctgcaagtggaaagggaagcgagatag

SEQ ID NO: 28299 - DNA, 315 bp, Glycine max
  Peptide Sequence Number=SeqID_119984
gggctggcgcgccagctggtctatgaagggctggactcgctgaatgagtttggctatgccgccgttgccgcgcattacgatctgcgctgccgctggccgggtaccgaatccgccttccagcgcctcaaaggagccgtctccggtaacgaggctctctttctggcgcttcgtcagctgtttaatccggcattccagcctgagcgccagcgacctgtcgccgacggcggcgtaaaaagccagctgaacggttcggacgagatagagaaaccagcacacggtaaacagattcagtatgttaaggtgaacgcaccatag

SEQ ID NO: 28300 - DNA, 309 bp, Glycine max
  Peptide Sequence Number=SeqID_119985
atggcacgcagagacaaaatttggtcattctgcacccttttgtcatccagaggcggcgggcctgatgacatgcggagacaaaatttggtcattccgcacccctttgccattcagacacagtcgtgtccgatggcacgcagagacaaaatttggtcattctacacccttttgtcatcaagaggcggcggtcccgatgacaagcagaggccaatgtggtcattctgcacccttcgtcaatcgcggccgacaagcccgttgacacgcggagatttacatcatcttccgcacttacaagatctgtcatactga

SEQ ID NO: 28301 - DNA, 441 bp, Glycine max
  Peptide Sequence Number=SeqID_119986
atgtcgggatttacacgcaattctcctcaaatttcagccagcccgcatcaattagaccttgcaccttatgcttcagagccctaccatgctcaatggaacgccccggggcttctccatgacaagcacacgttgcgtttgagtcgtattctcggagaaatggaggttgatgaaccttggctagggttatggctaccattgaatcatcaagtagatatgggatcaagtttagcatatgacaacggaatttggggtgaaccctacaggctttttgctgcaaaattcctttttgttgtggtctttcgtcattggaagtgcggtagacagactttgtggtttgatttagggatggcctttgtggataattgggtggtgggtaaggagaaggaatggcagtcacagcatgggcttctccctcattctcaccctcttcatttgccctag

SEQ ID NO: 28302 - DNA, 162 bp, Glycine max
  Peptide Sequence Number=SeqID_119987
atgaggttaagggctacgtgggagtacgtgagctcagttgaagaatggtacctagagatatgtcgcgggggtcaggagaccttggggatgtcaggtggggtgctattgcccaaaaccaagcttgaccaatcccgacccaacccgggcatagtcagtcagtga

SEQ ID NO: 28303 - DNA, 363 bp, Glycine max
  Peptide Sequence Number=SeqID_119988
atgagttatcacattgagggaacttcgaatggctaccggactatggaagatgaggaagctctcaaattaggagccctcttgggaaggcgagaaaccgtaaggggaagcttttcaatcagccgtcttccctccggaaagagtgcacctgagttggaaaacgacggccaaaagagggccatgaacaagaaactaaaaggcgcctcggaggaatatggccgaagaagattccgaggagcattgtggggagcaacaagagctcaagctggggaaagagacccgtttgcggcatataaaagaagagttagctgcgtgcgcaagatttttggggtgcctctttccgaggagtttggctacttggattag

SEQ ID NO: 28304 - DNA, 960 bp, Glycine max
  Peptide Sequence Number=SeqID_119989
atggaagccgaaatccagcccgggggtgaatgccacgtgctcggtttccaggaagtgcgcgcagaacgcctgcgcgtcgtcggtgaatgcgctcacatcggcgtacaggtagaacgcaccctgcggctcgacttcgatgcggaagcccagttcgcgcagtgcaggcagcaggaaatcgcggcgctggcggaacgcctcgcggcgttgctcgaagatcgccatcgattcctcgctgaaacaggcgagggcggcatgctgagcgatgctcgacgcgctgatgtacaggttctgtgccagcttctccagatcgggcacggccgccggcggtgccaccagccagcccagccgccagccggtcatgccgaagtacttggaaaaactgttcagcacgaacgcgctgtcatccacctgcagcacgctgggcgcatccaggccgtaggtcaggccgtgatagatctcgtccaccaccagatggccgccccgcgcgtgcagggcgaccagcgcgccgacgctgtcggcgttccagtgttgttccaccagcgatggagtcagctggtaggcggtttccggcccgaccggcaccagctgcgcaccgccttccaccaggcgcaggaagtggcggttgcacggataacctgggtcggccagcagccagtggcgaccaggatcgaccagcaggctgctggccagcagcagcgcaccggagccgccgggggtgaccaggatgcgttcgggatcgatgtccagcccgtagtggctgcgatagaaaccactgatggcctggcgcagggccggcaggccacgtgcggcggtgtagcgggtatggccggcggccagtgcggcctggccggcacgcacgaccggttcggccgtggtgcagtctggttcgccgatttccaggtggatcacatcgtggccggcctgttccagcgcctgtgcgcgggccagcagggacatcac

SEQ ID NO: 28305 - DNA, 472 bp, Glycine max
  misc_feature (445)..(445): n is a, c, g, or t
  Peptide Sequence Number=SeqID_119990
atgcgtaaagccatcctcaatcgcggtgtgtcggtgattgtgctgccgggcgacgtggcgctgcaggcggcgccggagaatgcgcgcagcgaatggtatccgccgcagctgccgcaggtggtgccgtcggtcagtgaactgacgcgcctcgcagaaacgctcaatgaagcgaaaaatatcaccctgatgtgcggcagcggctgcgccggtgcccatgcggaagtggtaaagctggccgaaacgctgaaagcaccggtggtgcacgccatgcgcggcaaagagcacctcgagtacgataacccgtacgacgtcggcatgaccgggctgatcggcttctcatccggctatcacgccatgatgaacgccgacacgctggtgctgctcggcacccagttcccttatcgcccgttctacccggcggacgcgcgcattattcagattggtntcaatccggccagcctcggcgcgcaca

SEQ ID NO: 28306 - DNA, 357 bp, Glycine max
  Peptide Sequence Number=SeqID_119991
atggtgaaagttggaacctcttacgtgccgatcaacgtctcatttttcgccaaaaagttggccccagggctttcccgtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 28307 - DNA, 348 bp, Glycine max
  Peptide Sequence Number=SeqID_119992
atgaatcggccaacgcgcggggagaggcggtttgcgtattgggcgctagcggagtgtatactggcttactatgttggcactgatgagggtgagaaaaaaggctgcaccggtgcgtcagcagaatatgtgatacaggatatattccgcttccctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctcttctgttcctgcctttcggttaccggtgtcattccgctg

SEQ ID NO: 28308 - DNA, 303 bp, Glycine max
  Peptide Sequence Number=SeqID_119993
atggatcgattattcacaatgatactggggtttacttccaaacttcgacttcggtgcccatttgagtaccaaacagctgtgattttctatccgagaaacaatttttggatgaaattcactaccggaagccattcacccatacagttattatgcactgttggaagaacaacagatggaataataaacttacttcaacgcactatgccctatactcatgacgcgatcctgtattacaacggggaaatggaacatgccaccacagaacaaatttgttggatgcgcgttcacatgaaaaaatcctaa

SEQ ID NO: 28309 - DNA, 357 bp, Glycine max
  misc_feature (129)..(129): n is a, c, g, or t
  Peptide Sequence Number=SeqID_119994
atggatagtttaatgtgctcatcggcgcctgaccctgagatgtggatcatccaaggcacattagcatggcgtacttctcctgtgagatccaatgtagatccaactttctcttcactcgtgggatccggncgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctgggggaccaggagattggatctagccataagaagaatagaatgcttggctga

SEQ ID NO: 28310 - DNA, 530 bp, Glycine max
  Peptide Sequence Number=SeqID_119995
atggctggcaatccatctgacttacaaacctttgatcctgagatagataggacatttcatagattagttaggcatcattttataccttttgatcatcctgagcattccattactggtgaatctgtgcattctgttattggtgattttgaacatcctgatttggagcattataattttgaggattctgattctgagcattctgattttgcacattctgagaacatggcacaacttccaccctgtgagaggactctaagggaaatggctgcacctgattttacctacgaaagcttgtgcatccaataccctgatgaggatgtcccatatgttctcaaaactggactgatacatttgcttccaaagtttcatggccttgcaggtgaagacccgcacaaacatttgaaggaatttcatattgtctgctccaccatgaaacccccagatgtccaagaggatcacatatttctgaaggcttttcctcattcattagagggagtggcaaaggattggctgtattaccttgctccaag

SEQ ID NO: 28311 - DNA, 105 bp, Glycine max
  Peptide Sequence Number=SeqID_119996
atgtatgacaaatgtaattttgagatcgacatgagacacctggagaaccctcatttcctagttaacaatgcattagaggaaaatgcaaggatcatgaatgagtga

SEQ ID NO: 28312 - DNA, 699 bp, Glycine max
  Peptide Sequence Number=SeqID_119997
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcaggcggggcgtaattttttaaggcagttatggtgcctagaatattttatctga

SEQ ID NO: 28313 - DNA, 318 bp, Glycine max
  Peptide Sequence Number=SeqID_119998
atggtcttggaagtccaaactcaggagcacaggtcgcttgagcaaatggaccaatggcttgcactcaattctggatttacatgcgattctcctcaaattttagccagcccgcatcaattagaccttgcaccttacgcttcaggcccctacaatgctcaatggaatgccccggggcttctccatgacaagcacacattgcgttcgagtcgtattctcggagaaatagaggttgatgagccttggttagggttatggctaccattgaattatctagtagatatgggagcaagtcagcataggacactggaattggggtga

SEQ ID NO: 28314 - DNA, 333 bp, Glycine max
  Peptide Sequence Number=SeqID_119999
ggatgctcttaaagcctcatcttcaatccaagaagaaagtgatatggaagattcaattgacttggatgaagatgaagaacttagtctctttgtcaaaagattcaacaaatttcttaggatgagagaaactcaaagaagacaaaacttcaaacctaaaagaaggattgaagaatcatctcaaactccaagatgctatgagtgcaatcaactcagacatctgagggttgattgtccaatctttaagaaaagaatggagaagttcaaaaacaagaacattggagaaaataaggcaaagaaggcctacatcacatgggatgataacgacttagaatc

SEQ ID NO: 28315 - DNA, 672 bp, Glycine max
  Peptide Sequence Number=SeqID_120000
atgaatagcgagattaataatcgtaacaaaatgcttttggtcaatgaagaagggaaacaatctaaaaagtcatggaaactgggcaaaaattgtggggtttcatttgaaggaaaagataaggtggtggaagaaaagatagaggaaatggagagaaaagataacctagaagtcacaaaggccaaagaaaagtttatgaagttaataaaggtggtcaatgaagattctcacacacaatataaagggcataatgagggaggtttgggaaggaggtggatgtgggaggacataaggagtaggaaagctaatagcaatatagctacttggtgtgtgattggagactttaattgtgttagaagatcttgcgaaagagttggtgtcggaggggaggatataaatgtaggtgaaaaagaagaattcaacaattacttggtagagatgagcctagaagacatgccttttatgggaaagaaaattcacatggtgaagaatagtgtggtggattggggacctaaatcatttaaggaatcagattgggctccacaatgcacaaggcaagataaaatgtcaaatgaagaattgaagctgcaggatccacgatgtcggatacaatgtccaggacatcctgcccgaaaatactggacacataaatctgttatatctttaacagattaa

SEQ ID NO: 28316 - DNA, 1056 bp, Glycine max
  Peptide Sequence Number=SeqID_120001
gagttctatgccaacctctacagtcctaagggaccttcaccaaaacaagttagaatacggggccacttgataaggattgatgcagacagcctcaatgcctttttagaaacacctgtggtgcttgctgagggtgaatctttacccgcttactcaagatattgcaggattcctactgacatcagggaaattgaggcttctctgtgcatactcggccgagggtttattttaaatgctgaaggtcaccctgggaagatcctcagaaaagatctaaccacccttgctcaggtctggagtgttctctcctactccaacctggctccgacttcccacaccttggatttgattgtggatagagctaggttaatctttggcctagttactcagctggacatgaatgtcggagctcttatctctggacagatcatttcaatggaccagtctaactcctctagactcagggggaccagaagaccaagggcaaggccagctaaggttcctgctacatcagcagctcctcctccatcacgtatgacagcagctccttctaccctacctcctacagattttcaacgtttcgaggccatgcttcggagcatacatcaggggcatattattttactgcaaagactacagctggtagcacctctagactccatcccgacggtagagcaatttaatgaatgggtagcttggctagggactcagcctccttttcacagagaagacgaagatcccgccactcaggtaccccatcagtcggaggatgagtcatcagaatcttccactcctgagcccttgatcaggaaaatgagggtagttgtaacccagaaagctgcagccacctctgaaaagtctcttgaagctactccagagcttccggcaccagtggcaaataccacttctccacagcaggcagtagacccttccacgcctgaggatcaaaccaccccagtcctatctctgaacacctctcctgtagctactccagtacttcatttgtcaaaagaggaggagggtcagacacaggacacccaggaccaatcacaggatatttaa

SEQ ID NO: 28317 - DNA, 627 bp, Glycine max
  Peptide Sequence Number=SeqID_120002
atggataatgtagagggcgtgcaggaacagatgaaggccgatctatcggccttaaaagatcaaatggcttccatctcggaggtcatgttaaaactccagaaaaccatagaggataaagccaccgcaaccgcctccagtacagttagggaagcgaagccggtgctacagcccgccttgaatccgggcctagacagaaacacggtcgtgttcggtcgaaggtatagtccgcaagcttatccttatggcctgcctccggacttcaccccccgtgccaccccgaaagatttaagccaagcccctacttttgaggggcaactcccaccttatgaagactatcccgggcaagacgatggggaaggagatacccatcttggccccctgctccacctcaaagatccatcctcgcatgaaccaccccagccgaacatagtccgccatatcccggcctcacccacacccgtaaaacaatttgttcccttcgcagaagataagggaaagattgaagcgcttgaagagaggttaagagcagtcgaaggcctcggcaattacccattctcggatttggcagatttatgtcttgtgcccaaacatcgttatccctcccaagttcaaagtaccagactttga

SEQ ID NO: 28318 - DNA, 372 bp, Glycine max
  Peptide Sequence Number=SeqID_120003
tgaaggtgcaaattgcaaagaagagcaagccaacaagaaaaggaaggaagtggtacttgaacccgatgatgatcctggacatttgagggcaaatgttttccaagaaggagggaatgatgagaatcctaaaactggccaaatacaggctaaaggtccaagtggagaaggacgaaggcccaagtggagaaggataaagcccccaagtaatcattgtggcgtctaccctgacttatcttccttcactggaagtggcgtctaccctgacttatcttccttcattggaagtggcgtcaaccaaatctccgtagcctgtatcaaacgatccgctccttgtggagctggtattgaagaggaggaaccaacagatttgag

SEQ ID NO: 28319 - DNA, 417 bp, Glycine max
  Peptide Sequence Number=SeqID_120004
atgtccagtgccaagattcaagctagttggtggccttgggaaaaacatatgacggaggctcgaccatacacaatgtggcttatgcagacgatgttcatgagggcaccaatccaactaaagacacttaagctgttggaccggtatatggacgaattgagtcaaagagacggtctaggatcggtgtatgaattccttgagccgcaggctatactgaacacaaatgatagacgtggacaatgtcaagaatacattgaaaaatggcttaaggaatcgaaccgacatgtctatctaggcgcttatttgaataaggcacattggcagcttattgttttgtgtcctactaaaaatattgtcgtctggttttgttctttgcgtagaaggccaaatgttcatataaaagctacaattaacaagtaa

SEQ ID NO: 28320 - DNA, 886 bp, Glycine max
  Peptide Sequence Number=SeqID_120005
ctactttacgccgcacgcgccgctgcagggcgcatcgctatggaatgcctggctgttctggttcaaaggggttctgcactgggactttggcgtctccagcatcaacggccagctgatttccgaacagctgaaggtggtcttccctgccacgatggaactgtgcattctggcgtttggttttgcgctgctggtcggcattcccgtggggatgattgccggaattatgcgtaataaatggccggacacgctcattagcgccctggcgctggtggggttctccattccggtgttctggctggcgttgctgtttaccctgttcttctcgttaacgctgggttggttgccggtctccggccgctttgatctgttgtacgaagtgaaaacggtgaccggcttcgcgctcatcgacgcctggctctctgattcgccgtggcgccatgagatgatcgtcagcgccgcgcggcatatggtgctgccggtgttaacgctggccgtcgcgccgaccaccgaagtgattcgcctgatgcgtatcagcaccagtgaagtctacgatactaactatgttaaagcggcggcgacccgcggcgttacccgcaggacgattctgcatcgtcacgtgttgcacaatgccctgccgccggtgatcccgcgcctgggattgcagttctccaccatgctaacgctggcaatgattaccgaaatggtcttcagctggccgggactggggcgctggctgatcaacgccatccgccaacaggattacgcagcgatttccgccggagtgatggtgatcggcgcgctggtcattatcgtcaatgtgatctcagatattttaggagccatggctaacccactgaaacataaggaatggtatgccctacgatag

SEQ ID NO: 28321 - DNA, 180 bp, Glycine max
  Peptide Sequence Number=SeqID_120006
atggggaagagaaagctggagttaggttttgaagaccagaaaattgatttcgacttgtttgtggaagacaagcctgcaccagaacataatttttgcttgcaggaacttgctattcctttcgctaagcccaagccttgcgctaagcgcatctttgttcatgcgttaagccacgagtcttga

SEQ ID NO: 28322 - DNA, 87 bp, Glycine max
  Peptide Sequence Number=SeqID_120007
atgaaggcccagatgcagagtgcactaccaagactactaattgttgctgaaggtccaaacaaacttgaaggcccaaatacactataa

SEQ ID NO: 28323 - DNA, 483 bp, Glycine max
  Peptide Sequence Number=SeqID_120008
atgggttctccacctgcctccactcctcctcctcctcctcctcctcctctctacttcggacgcatcggcttcgacgtctgccggaaggccgacggtccccacaagaagaaattgagaacatatttggggattgtggcacgtgataaggtggacatcacctacgagaactggaaggaggtccctactgctcagaaggacctgatttgggaggatattcaggatatgcgcatgaaggcacaggccatccagaagcagaatactgccccccacattttgtctcgtgggggttatgattatttggagcagaagctccaggctgagaagaccaagaagaagatgcaggaagctacacagtcaggaagcgttgatggcgtcatcaaccctccatccccggtcagacgccacgtgaagtggaagatggcccgcacgaagaagacaggggagatgacaactgaggccgcaaaggaaattgctgagaagatt

SEQ ID NO: 28324 - DNA, 159 bp, Glycine max
  Peptide Sequence Number=SeqID_120009
atggatgacgaagaacggttgaaaatcttcacggaatcacccacggaaatcaaaataggggaggagcttgccaccctgctcactcaagcgagccaggttgcttcctccagaagcaaccgccttctggaggaagaatctggaaggcccaagtgggtctga

SEQ ID NO: 28325 - DNA, 295 bp, Glycine max
  Peptide Sequence Number=SeqID_120010
atggtgataaatttgcaagtaggaataagaagtgtgtgtttatgggctacccatatgacaagaaaaaggtggaagttgtatgacttagaaacaaaagagattgttgtctctcgagatgtagaattcgttgagaccaagtatccttttactatggatgttactaccaaagaagatgttcttcctaaaaatgggagttgtgaagaaattgttagtgatgtgactgatggtgtagaagaaacggatcacacaggaggtactgaagaaagtggtgatataacaacgaatgatagatggg

SEQ ID NO: 28326 - DNA, 282 bp, Glycine max
  Peptide Sequence Number=SeqID_120011
atgggtgacccgctagtgttagaggagggccaggagtgcgagtttagtcagagaaggaaccgggccgatggatttgacgaggaggccattgcccagctgttatgcataccgggtcaggattttgcccggaccgctaccgggaggcgggtgcagatcatgcgcaccagtatgccacctaccaggcaccctctagacccagataagtctaacagggccctggggtttccagcgttgatcacgggtctctgcagttgtcttcagtcaggctcagcgcacgactga

SEQ ID NO: 28327 - DNA, 438 bp, Glycine max
  Peptide Sequence Number=SeqID_120012
atgtaccccccgacggcgcccaagccaacgccgttttcctatcaaagcaataaggccgttccatggaagtatacccctcccgcttttggagaaagagctgcaaccgaggttgactccttgtcagccaaagtgaccaacatcaccggccttagtggcgtaacccatagtggtcgggtgtttgctccccctcactcagcggaattaccctccaagggaaaagcaaccatgatccaagagcccgcagacgcggccaccccctcaaaagaagtggatcccctggtggtaaaaggagctgaaaagaaagaatgtcttcaaggaaaggcggtgaccttggaagaggctcatgagttccttcgtctcatccaacaatgtgagtttaaagtagttgagcaactgaataaaactccagcaatgatctctttgctcaactgctcataa

SEQ ID NO: 28328 - DNA, 581 bp, Glycine max
  Peptide Sequence Number=SeqID_120013
cggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctttgtctcgaatatttgtggccaacccggaaaagagaattaccataccggagattaaaatgcacccttggttcctcaagaatttgccactagaatttatggacgagagtgaaggggtgttgcaaaatgatgatgtgaatgacgactcatctgagactcaaagcattgaagaaatactgtccataattcaagaggctagggtaccgagctcgaattcgtaa

SEQ ID NO: 28329 - DNA, 300 bp, Glycine max
  Peptide Sequence Number=SeqID_120014
atggcgtttctcgatgattacccacagatgcagatcgaaatggtgttgaacgatcgcaatctcgatctgattgacgaaggattggatatcgcggtgcgcatcggtcatctgcaggactcttcccgcgtggcgcggcggctggggcaggtcagccgggtgacggtcgccagcccggcttacctggcgcgctgcggcgagccgcgctcgccggcgcaactggcggagcacgccaccatcgctggcacccagcggccgtcgctgcgcgaatggcgcttcggcccgcaggaaaacggcgagcgg

SEQ ID NO: 28330 - DNA, 363 bp, Glycine max
  Peptide Sequence Number=SeqID_120015
atggtggacacggcgtttctcctcaccggtcgtggtcagcatactcttgcggtgaatgaacggaatccggcaatgtggaaattgataatttcatttttcggaagagtctatggatcgattagacgagttggccatattcgtggcggtggtgcagcagggcagcctggcggcggccgggcgcaaactgcggcgctcggcgccggcgatcacccgggcgatcgccgcgctggaacagcggttcggcacccgactggtggaacgcaccacccggcggctggcgcctaccgaagcgggcgtgcgcctgctggagcgcgcgcaacagctgctgcaggattatcaggcggtggtgcaggataccgctga

SEQ ID NO: 28331 - DNA, 207 bp, Glycine max
  Peptide Sequence Number=SeqID_120016
atgaaaaacatggtggagtttgcaccttcaagctttgcggatttggtcttcgccagcaaaaggatcgaagtgggtctaaaaagaggcaaatttgatcatcctgctttgatgaatgagaaaactggggcaaatgaagaggataagaatgaggaaggaacccatgttgaggctgccattcctacatggtcaaatttcccatcagcctaa

SEQ ID NO: 28332 - DNA, 234 bp, Glycine max
  Peptide Sequence Number=SeqID_120017
atggttattgaagaatctatccatgttgcttttgatgaaactaaccctataaggccaagaaaggaaacacttgatgatgttacagattcactagaagacatgcacattaatgagaaagggtacaaaggcaaaggaaatggaaatgaagaagaccttcaaattgatgaaactaaaacaagtaaagatacagatcttccaaaagagtggacaacttcaagatatcaatcctcttga

SEQ ID NO: 28333 - DNA, 378 bp, Glycine max
  Peptide Sequence Number=SeqID_120018
atggctattaaactgattgcaattgatatggacggcacgctgttgctgccggaccataccatttctccggcggtgaaaaccgccatcgcggcagcgcgcgcccgcggcgttaacgtggtgctgacgactggccgcccttacgctggtgttcatagctacctgaaagagttgcacatggaacagccgggcgactactgcatcacctataacggtgcgctggttcagaaagccagcgacggcagcaccgtggcgcaaacggcgttaagctacgatgattatcgcttccttgagcaactctctcgcgacgtcggctcgcatttccacgcgctcgatcgtaatacgctttacaccgcgaaccgcgatatcagctactacacg

SEQ ID NO: 28334 - DNA, 351 bp, Glycine max
  Peptide Sequence Number=SeqID_120019
atgattatgagaggccaagacatttatagtagccaagatgaggctactatgtcaccttcctctagtgaaagtgaagaagcaaaaggggaagaatctagtgaagaaatctacccccatgaagaagaacaacctttaatggttaaggaggagtgtaaggaggtaagtgtctcctccaagagtgatcaaggggttcccacgggccctaagagaataaaagtcattcctgattggcccactccaccaagtgtcgagggaaggagcacagagtatgaagaacctcaggatttgaggtcaaatcctttccaacatggaggggatgatgcaatcctaccccccaagggtattggatag

SEQ ID NO: 28335 - DNA, 102 bp, Glycine max
  Peptide Sequence Number=SeqID_120020
aacttcattgtccaatgctctctcaaaagaatgtggttcagactttgtaaaggattttacaaagatagtggaaatctcaagtgggttgcttgagtactggat

SEQ ID NO: 28336 - DNA, 363 bp, Glycine max
  Peptide Sequence Number=SeqID_120021
atggaaaaatctcttttgattgtagaagaagcaaacttatcatccagatctttttctagaagagttagtgatgataaagctaacagaagtggaaggaagggtatggttcttccttttcaacctctatctctcacatttgatgagatcaaatattctttagacatgccacaggaaatgaaaaagcaaggagtttttgaggaacatcgagaacttttgaagggtgttagtggtgtctttagaccaagagtactaacagctctgatgggtgtaagtggtgccggtaagactacattaatggatgttacttttgaagttggcaagggagcaaatatatgctggtccattaggccaccactattctga

SEQ ID NO: 28337 - DNA, 156 bp, Glycine max
  Peptide Sequence Number=SeqID_120022
gcttgtagtgagcttcaaaacaaggaaagggaaacaatgctcaaaagggctatcaaaggaattaattcaagatatgcatgtgaattaggaagcatcaacaagaatcaagccaaggctattgtgcaagcaatcaatggggcaaaacacaccaaatga

SEQ ID NO: 28338 - DNA, 891 bp, Glycine max
  Peptide Sequence Number=SeqID_120023
tggcaccaaccggacagagtgttgagacaatttgggatgcaacaaccagttccagagtctccttcacaacccttaaacattcatggcataacattaaaagggaaacatgacgaaaattgggggcaattgttcgccccaatgatccagcagtggaataatcgccatgcatttagggtcgacgcttatccccgacaagaaggcttattgagttttaactcggactacatggtctggtataggcgaaagacaaagatgtttgttgacccagaaaatgcaaagacggctacattggctgaagttgcggagacattacaatacatggtgtctcctcaagggaggaatacatggacaattgatgatctcgtgccttatgtggaaaaaattacaattttatccgaagagcaagagagagtcactgagccagtgtcacatggtcccgcatcagagcgtcaatttcccgcacaacagtttcacatgcttcagtcaagtattgaaactcaggggatagacagaagaagggacactgttgaagcggaagaatattcccaacaaatggcggagcgtggccatggaatgtattacacgccacaaacatttgctgagtatccgacacagatgtatcagtatccttttcaggatcatcacactgatacttctgcaagccagcaatcgttcggtggttttgcggaaacacaagctcatttttcatggcccacaatgaccccttcacaacaatatcatggcccaattccaacacctaatgccccgctgacgaagaagaagcggggaggcatcggggcagaagaaatcctgatcgccaagctcgaagataggatcgaccatgtggcacatcctcacggcatcacggacaccaaaatgaatgatttgcat

SEQ ID NO: 28339 - DNA, 156 bp, Glycine max
  Peptide Sequence Number=SeqID_120024
atgttttgggacttaaggcttgtagtgagcttcaaaacaaggaaagggaaacaaggctcaaaagggctatcaaaggaattaattcaaggaagcataaacaagaatcaagccaaggctattgtgcaagcgggcaatgaggcaaaacacaccaaatga

SEQ ID NO: 28340 - DNA, 273 bp, Glycine max
  Peptide Sequence Number=SeqID_120025
atgttggggaattggttgtctgccactcctttcaagaagttcttatttgttgaagaaacaaataagattctggttctacttctacccattaataattcacaacaacaagtgctaatgcatggaactagtgttgagaggactgttgcatttggaaaaccatgtcctatgtctgaggtccctagaatggatatccgtctcacgcagcttgaagaggatgtgggttatattcgtcagagcttcgatcttccaccaccaccaccaccaccttcttag

SEQ ID NO: 28341 - DNA, 279 bp, Glycine max
  Peptide Sequence Number=SeqID_120026
atgtcatttcctactccttccttcttccaaaaccatttccaacgtcccaagattcttctccatcacccacagccaccagtagctaccacaaacagccatagctctccactgaaaccccacaccgagaggaacccttcaatcagagtggaatcttccaagcttgccttgttgtttcggttgagaacgaatcccattctaaccttcacggttttcttcaagcttgtctttgcatcttttctaattttggaaccaccattgtatgttttgcgcttcctttga

SEQ ID NO: 28342 - DNA, 216 bp, Glycine max
  Peptide Sequence Number=SeqID_120027
atgggggtgcaaatagcacccaggcccacttgggccctccggaatattcctccagaaggcggttgcttctggaggaagcaaccctgctcgcctgggcgagctgagctcgcctgggcgagctggggaggaaggcaagaaggaaggggttcagcccctttggcacttctctctctttcgaatttgcttggaaaaattgtttccgtgaagccaatctaa

SEQ ID NO: 28343 - DNA, 329 bp, Glycine max
  Peptide Sequence Number=SeqID_120028
ctcagttggaggtgggcaacaggggatggtgggtttatgcgcgcattgtggatgaggaaagcttgttgtgcaccatcgcccgaccgccacctagtaccacatgtgatggggtgaaacttcctgctttaattgttgaccacagagtggtacctggagatatgtcgcgggggtcaggagatcttggggacgttaggcgagctcctggcagtcaacagataaaaggaaaacaagaccacaaagcaaggaggcttgtggtggctggccagctgcttgaaaacgaggtcaggaagctagggaagcctctggtaatcgattaccaaggggtgtaa

SEQ ID NO: 28344 - DNA, 394 bp, Glycine max
  Peptide Sequence Number=SeqID_120029
acagcttggctaccccatgagaggagtgccatcagatgaaagcatcacgcctttcatcgcacggggtttcggtgaccacaacgcgagggtactccaaggagttcgcaaggcatgggatgcggctaatgggatcatcggtggctatcataagtggctgagagtccgaacacaaggattggattggctcccaaatctaaagactgtgagagacgatgaggttaaaacttcggaagaaagtgatgaggtacaagccctaaaggcagagcttgaaagagcccgggtagtcgaagagaagttcaaggcagcaatagtgagctcaagctctgaagaggtgaaaggaatcatcacgggtcaaaggcaagatcttgaaggacgagctaaaggcttgccttag

SEQ ID NO: 28345 - DNA, 267 bp, Glycine max
  Peptide Sequence Number=SeqID_120030
atgtttgtattcaacaatgatttgaaaggacttgacgatactcaacaaagtaaatccaagcctcctgctaggtggattactgttaaatgtaatagacaaaaaggaaacactgagtgtgggtattacgtcatgcactggatgtcaactataatcttaggaaatttccagaataattgggaaatgtatttcactgatcctagaccgttggaaccagagagattgaaggcgtttcgcatccagtgggcaaagtacctatttgaaagttaa

SEQ ID NO: 28346 - DNA, 255 bp, Glycine max
  Peptide Sequence Number=SeqID_120031
atgcacacacaaagtttcacaattccacaattctttaaaatcgacctaactcacaaaaactccccagtggagtcgccaactgtcgcaacatgcccttttgcgggcgagcgaggcgaggctcacgggtgtgctttccaaaggaggaaagatgcgcggagtcgccaccaacgtttatttgtggaaaacgtcggaaaaaccgaaggaaaccggtcaaaaatgaaaaattctaagtttgggagttatatttacgtttga

SEQ ID NO: 28347 - DNA, 63 bp, Glycine max
  Peptide Sequence Number=SeqID_120032
tcttctatccaatgccttttgggggtaggattgcatcagttgcatcagaatcaaatagcgcaa

SEQ ID NO: 28348 - DNA, 1048 bp, Glycine max
  Peptide Sequence Number=SeqID_120033
atgggaacaaatcaaaccggcaaaagattttatcaagtcaaggttaagggtctagatgtcaccagcctcaaggaattgggacgattgatggggcctctccaaaggcaagccttccgcaaagtgtacggaaagattctagatttgaccgcagcggaggtatttatcgaagctgtcgtatccctcacccaatactatgatcagccattgaggatgccctcttggggggagaaaaccgtatcttttctccgggtttcttccctccttgagcaagattgtagctgtggttggagattcggcaaaagagttggatcgcatgaagcaaactcgcaacggtgtagtaggcctgccacggaaatacttggaaggcaaggcaagagatatggcgagccaagagaagtggggcccatttgcggttatattagctttgttgattttttgggggttgtcctctttccgaacgtggacggtttggtggacttagctgccattgatgctttcctcgcatatcaccatagcaaggagagtccagtggtggctatcttggcagatttgtttgacacctttgaccggaggtgtgagaaaaatagtgcatggattgtctgttgtttacccgctctctgtgtgtggttggtttcacacctattccaacaagacacaagacacccgtgtccgcttcaaagttatcgctcatgcgccaaaaaaggaagagtcgattgggaccaacatttggctgggataggaggcagcgcaatcaattggtttcctcgatggaaggaaggcaaggagggagttcttttctcgtgtggggactaccctaatgttccattgatagggactaggggttgtattaattataatcccgcactcgccataagacagctagggtaccccatgaggggagcaccaacggaagggagtctctcacctttccttgtgaaagatttaggcgcgcaaggtctcaaggttatacaaagagtccacaaggcgtggagaagtccgttgaggaaatacaaggagcttagaggcatccgaaatggcgtcatcggtg

SEQ ID NO: 28349 - DNA, 381 bp, Glycine max
  Peptide Sequence Number=SeqID_120034
atgcatgctttgttagggtcattcaacagtgggaactggtctgattctaaagtccttggtagtacgggactaagttgttgtgctatcacgagggatcagggcacattagttcctttggacttagaactaaaagctacactaagaaggaacagggctaaaaggagaaggaaactgttgcaagacagaacaattgcgtccattcttgaggaggagactcatttttctgattcattatcacctgattcaccatcatcaagggaatccgctaatcaatattctgaagctattaccatggcagatgagcatgatcagaggactacccttgaggattattcaagtggctctgtaccacaatttttcactagcattgcacgtcctgaa

SEQ ID NO: 28350 - DNA, 198 bp, Glycine max
  Peptide Sequence Number=SeqID_120035
atgcacgaagtcgccaccaacgtttattcaaggaaaaatgtcggaaaaaccaaaacgtgtggtctacgaactttaatcgtgaaaggtttaggagttgtttttacgcacggggaagggtgtttccctcgctcctacgtatcctcaattgcgatgggaaatctgacctacgtagttcttttagaactaaacgttggttaa

SEQ ID NO: 28351 - DNA, 645 bp, Glycine max
  Peptide Sequence Number=SeqID_120036
atgggatcgagtcaaaagccttcgcttgaaaagaggttttatcaagtcaaaatcaagagcttagaggtcaccagtttacgaaagttggggcaattaatgggtcaacttcaacggcaagccttccgcaaagcctatggtaagatttgggacctagctagggtagaagtctccatggaaccaattgcatccctttcccagtattatgaccaacccctaaggtgcttcacatttgaggacttccagctagtgccgactgtgaaagagtttgaagaaatcctgggatgcccactgggaggaaggaagccatatcttttctctgggttctatccctccacgacaagagttgccaaggtggtgaaaatcttagcacaggaattagaccgccaaaggcaagtcgaaaatggggtggtcggaataccgagaaaatatttggagccgacctatatgacaccttcgaccaaagatgtgaagaaagcaatgcaaggattgtttgctgtactccagctctctatgtggggctggtttcacacctttttctccaagaaggtaggcccgtctatccgctacaaggttaccgctcgtgcgtcgaaaaaggaaaggcgaattgggaccaactcttggctagcatgggggggcgtctgttaa

SEQ ID NO: 28352 - DNA, 379 bp, Glycine max
  Peptide Sequence Number=SeqID_120037
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccag

SEQ ID NO: 28353 - DNA, 573 bp, Glycine max
  Peptide Sequence Number=SeqID_120038
atgaattccaacgtgggaagaaaccctccgatgaaggagcttctggagtttgccctaatcccgatgacatatggagacctgttgccatcactgatcgccaaccaattggcagtgtcagcagacaaggaaagtcccaagaagcccaagcctttggtgatacatttcaccagagatgctgctccccaaaatcgccgaggcccgtcgacgttgtcaggaagtaaaccggtccccttcccctataaaaacagcaaggcagtcccgtggaggtacactcctcagaagccgagcgagaggaaagagaaggccaccggcaatgactcactttccgccaaagtggccaatattatcgggctaagtggcgtgacccatagcggccgcatctttgcggcacctgacctgtcggtacaacccgcgaatgccaaaggaaaagcaaagatgatcgtggaagaggccaacgaagcagaccccaccttggacgaggatgttataatggggagatttgctgaaaaaggggaaggactcgacaaaaaagaggtatccttggaaaaaggccaacgagttcctcccgtataa

SEQ ID NO: 28354 - DNA, 433 bp, Glycine max
  Peptide Sequence Number=SeqID_120039
tgtgagactcgaggcttagcgcgacgtcgggaaactgttgatgcagcaacgtatagtttgcctccgatgccagaacgacaacatggaatgtattacacaccgccggcattcacccaagaaccgtctcagatgccgccgatgtattcatacccacatgattttcaaccagggtatagttttgcaggcatatttgggtcctctcctccttcaacaggaactccttcatttacccaaagtggtcaagtatcgaccccaaatgccccacttgctagtccgtggaatgtacctggagatatacccgacatggacgacttattaggggtcgatttacgtcatgatttctcgaacaagtggatgaaagggcaaatcgtagaagaagaaatcctgatagggcagctagaaattgggaccggccatgtgggacttcgtcgcg

SEQ ID NO: 28355 - DNA, 1063 bp, Glycine max
  Peptide Sequence Number=SeqID_120040
ggccgaacatctcggtgatgctcatggtgccgtggcccagcaccttgttgtgctgcaactgggcaagcagcagcgcgttcttgccattcgaatcgccaccgtcggtgtcggccgcggccaccctttccgggtcggtgatcagtacattgatgtcacgggcggcgtcgcgcgtgggcgacaacgaccacttgtcgccggcctgcggcggcgaatcgatggtcagcgacacgcccatctcgggggtcaggtccagcgtagcggtgggcggcgtgcccgtggccggaccgttgtacacctgagtgccttccggcaggcgcgtcacgcggtaattggcgccgtcgaaactgatttcgtagtccttggcgttgatgttgttcacgtccgtgaacgtgccggtaagctgcgcgccgctcttgttgttggcattcggcacgccctgggggttcccgatgctgaagaaatcggtgccgggattgccggccgaatccaggccctggcgatgctgcgcgttgaacgacatggccaggcccaccgccatctggcccagctgggcctgcatgaagtccagcgagctggcgcggaactgcagcaggccacccagcttgccgccggtgacttcggcgtcattcagctcgaccgccacggtcttgccaccggaaccggccggcaaggtgtaggcgatgacggtgcggctgacatccttggccgacgacacggcctgcagcggatagacggtttcgcccgacagcagcgcctggccgcccgaggccagcgagatgttgagcttgtcgccctgctcgtaggtggtgatgccgatcaactggttcagttcggagacggcctggtcgcgctggtccagcaggtcgttgggcgggttgcccgcgcccttgccgcgcgcgatggagatctggctgttcaggtcgttgatgcgggcccaggcgctggttctgcatctcctggtaggccgagcggatctggctggtcaggctgttggccttgcccagcaggtcctggcgcgcggcgggatccgccggcttgctggccacggtgttcatgctggtga

SEQ ID NO: 28356 - DNA, 180 bp, Glycine max
  Peptide Sequence Number=SeqID_120041
atgcatctatgtgatcaagaggaatcgagaaggaagagacagaggagatgccagttcaaggagaagatgagtctagaagacgctcagcaccataagaggccatggataagagcttcgaggaagaaggagatgaatgaagggatggggagagaagagcacgaaattttgtgctctaaatga

SEQ ID NO: 28357 - DNA, 360 bp, Glycine max
  Peptide Sequence Number=SeqID_120042
atggctaagaagcccacatcaaattgcttctttacttcttctttaatccttaaggacatttcaagcttcatcctcctcagcttttgcttcaccggggaacatccaggatttaaggggagtctatgttgtacaattctgatgcaatcctatcccgcaagggcattgggtagcagactccaagtagattgggctagagatccaagggaaggccctagggttctcatgagccttagggaggtgagcttagctattagagagcttctcaaggaagttttctcaaagaagcttctcaaggaagttttctcaagaaagcttctcaaggaagttttctcaagaaagcttctcaaggaagctacctag

SEQ ID NO: 28358 - DNA, 267 bp, Glycine max
  Peptide Sequence Number=SeqID_120043
atgaagccggaatcgctagtaatcgccggtcagccatacggcggtgattcgttcccgggcattgtacacaccgcccgtcacactatgggagctggccatgcccgaagtcgttaccttaaccgcaaggagggggatgccgaaggcagggctagtgactggagtgaagtcgtaacaagccacatggatagtttaatgtgctcatcggcgcctgaccctgagatgtggatcatccaaggcacattagcatggcgtacttctcctgtttga

SEQ ID NO: 28359 - DNA, 675 bp, Glycine max
  Peptide Sequence Number=SeqID_120044
atggcagttttaggagaaactagcagtcagacgattgtcaactcaaggttgggtttcatttttcccaatggatcaattattcacaatgatactggggtttacttccaaacatcgactctggtgcccattcgagtaccaaacagctgtgattttgcaagcctaaaaatcagaatacacaatacccttcaactatccgacaaacaatttttggatgaaactcactttcagtgtatgaaattgataaatgatgacgatgtcaacacaatgttaatgtgtaatgatcaattttcgtgtgtcggtccgattgagttattatgcaccattggaagaacaccagatggagtaataaacttacttcaacgcactatgccccgtactcatgacgcgatcctgtattacaacaggaaatggaacatggcaccgcagaacaaacttgttggatgcgcattcacaggaaaaaatcctaagaaatttcaaattccttcaacatgtaccatcgatgaattgaaggatttaataaagcaagttacacctaaagggattccccctcttggaattcacgaatctcaaacggtaagacgattatttttctgccaaccaggtcgctttgagtattcagataagcttataaaatatgaaattaatgagctgaagaccaacaaagaactgctgaag

SEQ ID NO: 28360 - DNA, 340 bp, Glycine max
  Peptide Sequence Number=SeqID_120045
gaatggcacccacaaagacacccagtggacccggagaagtccaacagggccctggggtttccagctctggttacgggcctctgtagtcctacagggtgcccgttcctcccgacaaggtcacgtcatcatagggatcgcgcctgcaagacacccagtggacccgaagaagtccaacagggtcttggagttgtcaagctctaattacgggtctctaagtactgcgtccccaggcaggcacagggcgaaactaccacagcagcctggggatggccagcagcgggcagtagacgcaccgccatcacctctagagttcacctcagctcatccacaaaaaggttag

SEQ ID NO: 28361 - DNA, 144 bp, Glycine max
  Peptide Sequence Number=SeqID_120046
atgacattcgcggcactaggcaatgacattcatggggctccgaaaaaagtggagtatggagaattggcgaacagcgctaggcaacgacattcgcggggctccagactcgaaggtggaggacacatgaacagcgctaggcaatga

SEQ ID NO: 28362 - DNA, 279 bp, Glycine max
  Peptide Sequence Number=SeqID_120047
atggcaagttcaacatgctttcaacaaatttcttcacaaataactatcatgaagcagaaacctagcaaaactacccatcatatctcccaaaacccaatacccacgaaaatcaaagatgcgcttcatgactccgaaaatgcctttctttcgcgatttggagcagaaatgggcaccaaaggttggagctttaatggagtttcaatggaggatgaagaagaagacaatggcaacgtgagagagagagaaaagagctttctgaaattttctttggctgagtga

SEQ ID NO: 28363 - DNA, 183 bp, Glycine max
  Peptide Sequence Number=SeqID_120048
atgtctaatgaagaagtgaagttgcaggatccacgatgtcggatacaatgtcctgacatcctgcccgaaaatactggagttgctgcacaatgcataagtcaagataaattgtcaaattttttcagaagagatagatctctccagcatcaagaagttgcagcccagaatcgtacacggctataa

SEQ ID NO: 28364 - DNA, 133 bp, Glycine max
  Peptide Sequence Number=SeqID_120049
atgggggtgcaaatagcacccaggcccatttgggccctccagaagattcctccagaaggcggatctcgcaaaggtttgaaccgttcttcgacgttcttcattcgttcttcatcgttcttcgatcttcaaccgg

SEQ ID NO: 28365 - DNA, 74 bp, Glycine max
  Peptide Sequence Number=SeqID_120050
tcttatacaccatctagagagtggaagagagagagcttggaagaaccaaaacaagaaactcgcaatgactggaa

SEQ ID NO: 28366 - DNA, 138 bp, Glycine max
  Peptide Sequence Number=SeqID_120051
atgaagaaggcctacatcacatgggatgacaatgatatggaatcatctgaggattcagaaaatgaagagataaacctatgtctgatggctaaaagttatgaaagcgatgaagagaatcaattaaacttgcaatgttag

SEQ ID NO: 28367 - DNA, 264 bp, Glycine max
  Peptide Sequence Number=SeqID_120052
atgtccccagtggagtcgccaactgtcgcaacgtgcccttttgcgggcgagcgaaggcgaggctcacgggtgcgctttccaaaggaggaaagatgcgcggagtcgccaccaacgtttatttgtgggaaacatcggaaaatcgaaggaaacggtcgaaatgaaaatctaagttcgggagttgtatttacgtttgaggaaggtcgacaaaaacggggcttttgctcctacgtaccctccatcgaagaggaaatcagacctacgtag

SEQ ID NO: 28368 - DNA, 264 bp, Glycine max
  Peptide Sequence Number=SeqID_120053
atggctagaggaaagatccagatcaagaggatagagaacaccaccaagaaggccaacgagctcaccgttctctgcgatgccaaggtttctattattatgttctccagcactggaaaactccacaagatcgagcaatcaacaaagcagttcttcgatcaataccagatgactctgggagttgatatttggaactctcattacgaggttctctcttttcttttcttcagatttacttctgcctgctgctttggaagttgtaattga

SEQ ID NO: 28369 - DNA, 90 bp, Glycine max
  Peptide Sequence Number=SeqID_120054
atgggtgctaagtacctcaaagtggtcaaacgagggtcgcatcccaacaacggatggtccccggatgaaattaggatagggcatgcatga

SEQ ID NO: 28370 - DNA, 381 bp, Glycine max
  Peptide Sequence Number=SeqID_120055
atgccgatctccccctgcagaagtatcagttggtctgtgccgtcccgacataggggtcacgcccataagacacccagtggactcggagaaatccaacagggccctggggtttccagttctggttacgggcctctatcagtcctacagggtgcccgcactccccggcaagggatcgcgcccgcaggacacccagtggacccaaagaagtccaacagggtcctggggcttccagctctgattacgggcctctgtcagttctacgaagtgcccatcacccccagcaaggtcatcaggcctcctactaaccgagctttcatcaataagtattgcgcccccaggcaggcagagggcaagacaccacaacagcctggggatggctag

SEQ ID NO: 28371 - DNA, 123 bp, Glycine max
  Peptide Sequence Number=SeqID_120056
atgaagaagatcctaggcctacaagctccaatggagcttgcatcacaaacttggaattggaaggaggattggtgccatcccttgaagaatttgagtcaagaagaaaggggccaaccaccttaa

SEQ ID NO: 28372 - DNA, 387 bp, Glycine max
  Peptide Sequence Number=SeqID_120057
atgaagacaataaccagttctttccaaggcatgtctaatcaagctgcacctcggtgggttgaaccaaagagtcatgtccaaactggagcgtacgagtgcggatattatgtcatgcattggatgtggtgcatagtgactggtggattgaaggatgactggaacaagaactgcaggtttatatgcagacatggacttcaaagagggggaactggttctgaaggaccccatgttgtaggagctcaacatcccctcaaaaagattgattgtttggtgtgtagcttctgctttcgttttgttggttccatagaacttgaaattggaaggaggctttacatgcaacaactgagggccaacgagagtcatggttgtgatgtgggaagctcttag

SEQ ID NO: 28373 - DNA, 189 bp, Glycine max
  Peptide Sequence Number=SeqID_120058
atggggctattgctcaagcaaaggaaccaagatcacaccaaaaagataatagaacatggtgacgttaagattgaaaaggtagatggaaaggagaatgcagcagatcccttcaccaaggcgcttggcaaaaaagagtttgacaagcacaaatgggaattaggaatgaagttcatgaatgattggctctag

SEQ ID NO: 28374 - DNA, 294 bp, Glycine max
  Peptide Sequence Number=SeqID_120059
atgggtgccttgatcactaacgatggctctagggactccaaacctgcaaaaaagattagatctaacaaaatccacaataaccttggcatcgttagttctggtgggctcacaagtgctacagattctccacgcatacttgaagatagtgggtgtcgcaacctacccttcggcgagagggcgatgcgtgactcacgagtgtgtgctccaagaaaggagtacgcgcggagtcgccaccaacgtttatttgaggaaaacgtcggaaaaaccggaaaagacgtgatctacgaattctaa

SEQ ID NO: 28375 - DNA, 777 bp, Glycine max
  Peptide Sequence Number=SeqID_120060
atgaggggagcagggacagaagagaggcatgaatggctaagagttcatacacgagggttagattggctctccaagttgaaaattatcaatgaggagaagttcgaagctttggaagaggatgaagaagtccaagctctaaaatcagagctaggaaaggcaagactcaccaaagaaaaattcaagttagtcgctatagacatccggaaagagtgtgccagattacgagaggaaaatgcggctaccgcaagagccctcgaacgagaaaccaagagggctcgcaaggaagagcatggccaagataaattccgaggagctttgtggggcagcaacaatgaactcaagctctggagagaggaaagagaccagtcacgagtacacgacatggtcttaaaggaggagttagctgcttgctcaagatctaagaggagtttggcccaacacttagaagccacggagcaaagcatgctagctataataggggaactcaccataactaaaaaagcgcaatggaacccctataacacccgatccagaagtaagatggaaaacgaagaaggagtgcaagaacagatgaaggccgacctatcggccttaaaagatcaaatggcttctatcacggaggccatgctaaggcttcaaaaaactatagaagataatgctacgaaggccgcttccaatacagctagggaagcggaaccggtgctacagctcgcaataaacttgggccgagacagaggaaagagagacgggagttacgaaattcgtaaaattttgtaa

SEQ ID NO: 28376 - DNA, 222 bp, Glycine max
  Peptide Sequence Number=SeqID_120061
atggtggccgacatctccagagtccacctctggtcacctgtggaggatcccagtgcttatgcgtggcctactcctgagcagttcgaggctgcagtgggcatgcggggacctgtggagatggagggaaaaattaatgagtttcaagaacctctagatttgaggtcaaatccttttcaagggggagggaatgatgcaatcctaccccccaagggcattggatag

SEQ ID NO: 28377 - DNA, 847 bp, Glycine max
  Peptide Sequence Number=SeqID_120062
atgtcgctgattcccggtgccaaacgcctcaacctgcatgccatctaccttgagagcgaccgcccggtagaacgtgatgcgattgagccgcagcacttcagcaactggctggagtgggcgaaaagcaggcagctggggctggattttaacccaacctgtttttctcatgcgctaagcgcagacgggtttacgctgtcgcatgccgatccgggcattcgccagttctggatcgaccactgcaccgccagccgccgtatttctgcctggtttggcgagcagctgggcacgccgtcagtcatgaatatctgggtgccggacggcatgaaagatctcaccgtcgatcgcctcgcgccgcgccagcgtctcgccagtgcgctggatgagatcatccgtgaaccgctgaatccgcagcaccacattgatgcggtggaaagcaaactgtttggcattggcgcggagagttacaccgtgggttccagtgagttctgcctcggttacgccaccagccgccagaccgcgctgacgctggatgccggccacttccatcctaccgaagtgatctccgacaaaatctccagcgccatgctgtttgcgccgcgcctgctgttgcacgtcagccgtccggtccgctgggacagcgatcacgtggtgctgctggatgatgaaacccaggcgattgccagtgagatcgcccgtcaaaagttgttcgacagggtgcacatcggtctcgacttcttcgatgcctcgatcaaccgcattgccgcctgggtgatcggcacgcgcaatacccaaaaagccctgttgcgggcgctgctggagccgggcgaacagctgcgtcagcgggaac

SEQ ID NO: 28378 - DNA, 315 bp, Glycine max
  Peptide Sequence Number=SeqID_120063
atgaatggtagtggaatggagaaggaagagagagaggagatgccacttcaaggagaagatgagtctagaagaagctcacttgatgatcttcttcatcaatggattcctttgcttcttggaagaggaatggcagcgaaaaggagaaggaagagagagagaaaacaccacttcaaggagaagatgagtctagaagaagctcaccaccataggaggccatggataagagcttggaggaagaaggagatgaatgaagggagagggagagaagagcatgaaattttatgctctaaaagagctctgaaatctgaagtttaa

SEQ ID NO: 28379 - DNA, 294 bp, Glycine max
  Peptide Sequence Number=SeqID_120064
atggtagccataaccccaaccaaggttcatcaacctccatttttccgagaatacgactcgaacgcaacgtgtgcttgtcacggagaagccccggggcgttccattgagcattgtagggctctgaagcgtaaggtgcaaggtctaattgatatgggctggctgaaatttgaggagaatcgcgtgattttcaactttcaccggaagtgggtgcaagccattggtcagtttgctcgagcgacctatgctcctgagtttgggacttccaagaccgttggtgggcctgccgtaaaataa

SEQ ID NO: 28380 - DNA, 369 bp, Glycine max
  Peptide Sequence Number=SeqID_120065
atgattatgaggagccaagacatttattgtagccaagatgagtctactatgtcaccttcctctagtgaaagtgaagaagcaaaaggggaagaatctagtgaagaaatctacccccaagaagaaggacaacctttaatggttaaggaggagtgtaaggaggtaagtgtctcctccaagagtgatcaaggggttcccacggaccttaagagaataaaggtcattcctgattggcccactccaccaagtataagggaaatttggggctgccatgacttaacaaacttttacaccaggtgtcgagggaaggagcccagagtatgccgaacctcgggatttgaggtcaaatcctttccaaggtggaggggatga

SEQ ID NO: 28381 - DNA, 199 bp, Glycine max
  Peptide Sequence Number=SeqID_120066
tagagggttgtcgcaacgtgcccttcacgggcgagcgaaggcgaggctcacgggtgcgctttctaaaggaggaaagatgcgcggagtcgccaccaacgaaggtattagcacctctcacgtcgacaaaagcggggctctttctcctacgtaccctccatcgaagaggaaatcagacctacgtagttcttcctttttaagc

SEQ ID NO: 28382 - DNA, 246 bp, Glycine max
  Peptide Sequence Number=SeqID_120067
atggcagcggaatggagaaggaagagagagaggagacgccacttcaaggagaagatgagtctagaagaagctcaccaccataggaggccatggataagagcttggaggaagaaggagatgaatgaagggagagggagagaagagcacaaaattttgtgctcaaaaagagctctgaaatctgaacccactaatccaagatcaattccaagattctccactaagtgtcttaggtgtcatgaggcatga

SEQ ID NO: 28383 - DNA, 303 bp, Glycine max
  Peptide Sequence Number=SeqID_120068
atgaaatgtcaggcccagctgtggattgcagcagctcgtgcttatctgctgcacctggtcggttgcactctttttgctaataagagtgcaacatacgttcatgtggtgcacctagacgcttttcgcgacctgggtcagagtggtggttatgcttggggagttgtcgcgttggttcatatgtatgaccagttagatgaggcttctaggaccaccacacgacaaattgcggggtacctgactctattccagatgtgtcctggttgccgtacactgagcatcggcgggttaggggctttgagctga

SEQ ID NO: 28384 - DNA, 635 bp, Glycine max
  misc_feature (61)..(61): n is a, c, g, or t
  Peptide Sequence Number=SeqID_120069
tcctgtcgggtttcgccacctctgacttgagcgtcgatttttgtgatgctcgtcagggggncggagcctatggaaaaacgccagctacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagagcatacaggtggaagggaaatacttcgtctagctccaacccattttccactaagttcattgctttgcaaagcatcttggctcaaaaagatgcattgaaagccatggtaacttctaaagattggacaagctcggcttatgccaaagaagccaaggcaaaaagatttatggaacaagttttagactctaggttttggaaagcatgtgctgagattgtgaaacttactaaacctcttatgcgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 28385 - DNA, 363 bp, Glycine max
  Peptide Sequence Number=SeqID_120070
gtaggaggccagctcatcatagtctctggagaggaggatatattggttagctggttgtctgctactcctgatgttgaggaagcagaggaatctcttgaaatagcttttcaagcgttagaggtcatggacaatgcctatgtggagattgcgttgggtcgaaatggtgatggcatggtgactttgctggaaattgccaaaaatcgtgggaggtttgggttgggttacaagcccaccaatactgataagagaagaactactctagagagaaaagaaaagtgcttggcttgtcttcaagggcatgaaccacggatagagaggtccctatctgccgcattagcaaaagcttcaggagtgcgggattga

SEQ ID NO: 28386 - DNA, 505 bp, Glycine max
  Peptide Sequence Number=SeqID_120071
atggtgtcaccacaagggaggaacacatggacagttgatgatctcatgccttacgtggaaaagttagcgattatatccgaagagcaagagagaatcattgagccagtgtcacatggtccaacatcagagcgtgaattctcagcacaagagtttcacattcttcagtcaagtgttgaaactcggggcataggcagacgaagggagcttgttgaagcggaacaatattcccaacaaatgatggagcgtggtcatggaatgtattacacgccagcaacattttcccaatatccttcacagatgtatcagtattcttttgaaggtcatcacactgatacttctgcgagcgaacattcgttcggtggtgttgcggaaacacagtctcatttttcatggcccactatgactccttcacagcaacacgatgccccaatggcaacacctaacgccccatttgctctgcaatggcatgtccccgaagcaatacctcatatgggcgacttattag

SEQ ID NO: 28387 - DNA, 325 bp, Glycine max
  Peptide Sequence Number=SeqID_120072
ggtggacccttgggtacttgtacctatcgcctttagaggactacacatcctcgcctttagaggactgcacgtcctcaccttgagaggactacacgtcctcgccttgagaggactacatgtcctcaccatcagagggctgcacgccctcacctccagaggactacacgtccttgccttgagagggctacccgccctcgccttgggtactagttaccctcaccttcagaggactacatgtcctcaccttcgtagaggattacacgccctcacctttagaggactacacatcctcgccttaacagagggctgcacatcctcaccatga

SEQ ID NO: 28388 - DNA, 681 bp, Glycine max
  Peptide Sequence Number=SeqID_120073
atgaaaagagaaaaacatgtctcctatagtagtcataactcttgcaagagcctaagtgaagaacttcgtgactattatgaaggaaggcataggtcacatcttagacctcactcccataggagagaaaatgaaagaaagcctcaagaggttaacattaaactcccatacttccatgggaaggacaatgtagaggctaatttagattgggaaataagggtagagcaacaacttaaaaggaagtctacttcaaaatcttatggctctcactcttatccaaagaaagaccaaggtcaaggaatcttaggggtgagacattctaagcccaaagatgataaggggaagacaatagaaaagaaaccccttaaggctagtatgcaagagaagactagctccatgaataaaagtgaagaagcaaaaggggaagaatctagtgaagagatctacccccaagaagaaggacaacctttaatggttaaggaggagtgtaaggaggtaagtgtctcctccaagaggttagctaagaaggaaagacattttgaaataaagacaaatattaaagaaatttcccttcttagacaacctccacattttctcctttgtaaagagacacttgttagccttgccacatctcttaggcttgagtttattcctcaagtaaaggagttgttggatgagggtttg

SEQ ID NO: 28389 - DNA, 549 bp, Glycine max
  Peptide Sequence Number=SeqID_120074
atggcttctatcacagaagccatgctaaaaattcaaaaatcaatagaagacaatgctacggtgaccgcttccaatacagctagggaagcggaaccggtgctacagcctgcaatgaacttgggccgggacagaagcgcgacgggtttcaatcagagctatagtcctcaagcctacccttatggttttcctccagacttcactccccgtactgctccagacgatttgagccaagcccctaccttcgaggggcaactccctcctcatgtcgactatcctctgcaggaagatgatgaaggagattcccatttagaccttctacttcctcagagggaatcggccccccatgagttgccccaaccaaacataatccgccatgccccgtctcaattcaccctcgttaaggaactcgttcccatttcaaaagataagggaaagattgatctgcttgaagagaggttgagagcggtggaaggcctcggcaactatcctttctcagatttagccgatctgtgtctagtacctgacatcatcattcctcccaagtttaag

SEQ ID NO: 28390 - DNA, 423 bp, Glycine max
  Peptide Sequence Number=SeqID_120075
atgggctcaaaaatctaccctaaggttcatgagaaccctaaggccttctttatcagctttagcccaatccttgtgcagcctcttgggaagattgcatcaccttttgcttcttcactttcatttgaggaaggtgaagtagtagcctcatcttggctactttatatatcttggctcctcataatcatggttttcttggtgcatttgcgcttaactcatccgtgggctaagcgcgcatccactgctaagcgcaacttcagtgtgcttagcacaacagaagaatttggcagggcatcatcatcaaggttgcgcgctaagcacgagatcagtgcgccaagcgcaacaattgtcttcagccaagctcagcgcacgactggcgctaagctcaaatccacttactcgcacttagcgcgagggtggcgctaa

SEQ ID NO: 28391 - DNA, 528 bp, Glycine max
  Peptide Sequence Number=SeqID_120076
atggccacgctgaccaagatgccggtgatcaccaccgcctcggtgccgcaaggtcccaatggtccgctgatccccgagatccaccagaacgcgccgcatgccaagtacgtcgcgcgccgtggcgagatcaacgcctgggacaatcccgacttcgttgccgcggtcaaggccaccggccgcaagcagctgatcatcgccggcaccatcaccagcgtctgcatggcctttcccagcattgcggcggtggctgacggctaccaggtgttcgccgtgatcgacgcctcgggcacctattcgaagatggcgcaggaaatcacgctggcgcgcgtggtccaggccggcgtggtgccgatggacaccgccgcggtggcgtcggaactgcaacgcacctggcaccgcgacgacgcggcgcaatgggcggaaatctacggcggcattttcccgtcgtaccagttgctggccgaaagctacgccaaggcgcaggacgtcgaacgcaaccaggaagcgctggactcgcaacgcgcctga

SEQ ID NO: 28392 - DNA, 456 bp, Glycine max
  Peptide Sequence Number=SeqID_120077
atgggtgaccaagaggaagtacaggaacagatgaaagccgacatgtcagctttgaaagagcaaatggcttccatgatggatgccatgctaggaatgagacaactaatggagaataacgcggccactgccgccgctgttagttcggctgccgaagcagacccaactctcccagctaccgcgcaccatcctatcctaaacgtggtaggacgagaaagaaacacactggggcacgtcagcaacccccattcggggtacaaccgagtagcttacccctatggattaccacctaattacacaccaccagggagcctcctcgacagtcgaacgaggtccacgaggatcgtcgagagcatgcccaaggagacatcgattcctactccccgttccccgccgaggggccagcacccaacgcactacctcagcccaacctcacgggagaacctcgaaaccacctaa

SEQ ID NO: 28393 - DNA, 267 bp, Glycine max
  Peptide Sequence Number=SeqID_120078
atggcgataagtcgtgtcttaccgggttggactcaagacgatagttaccggataaggcgcagcggtcgggctgaacggggggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtga

SEQ ID NO: 28394 - DNA, 246 bp, Glycine max
  Peptide Sequence Number=SeqID_120079
atgaagagtgagatgctaatgtttgctatattcccagggctatgttattttgaaagaagttacttcgcatcaataatgggttcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 28395 - DNA, 717 bp, Glycine max
  Peptide Sequence Number=SeqID_120080
atgggaacaaatcaaactggaaaaaggttttatcaagtcaagattaagggcctagatatcaccagcataaagaagttggggcggttgatgggacctctccaaatgcaagccttccgcaaggcgtacggaaagattttagattggaccatagcagagatatccacggaagccattgtatcactcacccaatactatgaccaacctttgagatgcttcacgtttggagacttccaattagtaccgactgttgaagaatttgaggagattctaggatgtcctcttgggggaaggaaaccatatcttttctccgagtgtcttccctccttgagcaagattgcagttgtggtcaaggattcggcaagagagttggatcgtgtaaagcaaactcgaaatggcgtagtgcgcctaccacgaaagtacttagaaggcaaggcaagggatatggcgaatcaagagaagtgggtcccgtttatggacgtattagcattgctaatctttggggttgtcctctttccaaacatggacggtttggtggacctagccgcaattgacgctttccttgcatatcaccagagcaaagaaagcccaatcctagctatcttgacgaacttatttgatacatttgaccgaaggtgcgagaagagtagcgcacggatcatctgtttcttgcccgctctttatgtatggttggtttcgcacctgtccagcaagacataa

SEQ ID NO: 28396 - DNA, 132 bp, Glycine max
  Peptide Sequence Number=SeqID_120081
atggggagagctgacccctacaggaattccaagtttatcttaagaccagagaccaattcaaagcttttcaggatacactttagaattttccccgtatcttctccatatgcaatggccaccttcacgatttga

SEQ ID NO: 28397 - DNA, 243 bp, Glycine max
  Peptide Sequence Number=SeqID_120082
atgacaataaaaggaggagacgagggaaccgcttcaagctcaagagaagaatgtggattcaccactggagattgtgggctgtgcttgataataaactatcttcggaataagctttgtagcataggaactaaagttagtgagctttggacattctgtcctacggttactgacgaaggagctggagtggacgacaaaggtatgtcctccgttctagttatttttcttgatgccatctgtaactaa

SEQ ID NO: 28398 - DNA, 1248 bp, Glycine max
  Peptide Sequence Number=SeqID_120083
atgatggaatcccagaaccagaacctactacgccaacccttgataaactcaacgcatcatcatcatcactctgctgattcccgtctcgaagaggtcctctctgaccccaccctaccctggtccaagcgcatcctctccgccacatggatcgaactcaacctcctcttccccctcgccgctcccgccatcctcgtttacgtcttcaacaacctcatgtccaacgttactcgcgccttcgccggccacctcggaaacctcgaactcgccgctgccaacctcggcaacagtggcattcagctcttcgcctatggcctaatgttgggtatgggaagtgcggtggagactttatgtggacaagcgtacggagcgaacaaatatgaaatgctagggatatacatgcagagagcaattatcgtgctaaccataacagggattcccttaacggtggtgtacattttctgcaaaccaattcttctcttgctgggggagccaccggaggtggcatcagtggccgcgatgttcgtgtacggtctgatcccgcagatcttcgcttacgcagtgaacttccccatacagaagtttctgcaggcgcagagcgtggtggcgccgagcacatacatctccgctgccacgctggtgctgcacgtggcgctgagctgggtggtggtgtacaagttagggtttgggatcatgggttcgtcgttgatgctgagtttgtcttggtggatcattgttggggcacagtttttgtatgttgttagtgcttcaaagtttaaggatacgtggagtgggtttagtgttgaggcattctctggactctgggattttgttaagctatcggctgcgtccgcggtgatgctgtgtttggagacttggtattttcaggtgctcgtgctcattactggcttgcttgataaccctcaactctctcttgattctatctcagtttgcatggcaataacagggttgacgatgcatattggaattggatttaatgcagctgcaagggtgagtaacgagttgggagctgagcatccaaagtctgcagcattctcagtgattgtagtgaatatgatatctttcataattgcggtgatagaagcagtggtggtccttgcactgcgtcgggttgtaagctatgcattcacagatggtgaaaccgtcgctaatgcggtctcagacctctgtccctacttggccgtcactctcattcttaatggaatccaaccggtgttatctggtgagtaa

SEQ ID NO: 28399 - DNA, 621 bp, Glycine max
  Peptide Sequence Number=SeqID_120084
atggcatatgcacgttcacacgcacttgctcagtcatcccaaagatgctcccctcttcccccatttcacacacgtccctcattggacccaatcaatgccacggagtcatcatctatggattggggtggtgatgattggggttctttatcatcatctaagaagagaaggaagaataaggtgtttgatgaagttcatggggagagtttggggaacgtggagaaggagaagctcttgggtgcgctgagagcttcttctgatgccaatgggaaggtgaagataaagatctcaaagaaggagctggagaagttgttgggatcagagaaagagattaataataagcaattaggtgaaggacacgcttcggcggaacaagttctggctcgcttgatacacgctagagatcatgatgatgttcatcataggccttggaggcccgtgcttcagagtatacctgagcttgtaaggttgggaatgtgtgatttgtatattcgtcattctgcgagtaaaacctcaaaactagggaatcaagaagagaccaaatcaaagaagtttcgtgtactgtatcgttattcatctaaccatgacgcgaacagacctgtccagaagatatatattatctga

SEQ ID NO: 28400 - DNA, 2070 bp, Glycine max
  Peptide Sequence Number=SeqID_120085
atgactattggagagtgctcgtattcgacagtgaaagaggaggaggaagttgatgattgtggatcagttaagagtccacatagcatttttatggaaggaggtagtttgagtatcgagaaaatgcttggagatgatgactatgatgaaaatgactttgccagacagacaaagacaatggatttgcatttgaagagtttgtttaacagatttctggagcaatttgggtctggtcctggtcttggccctggatctgggacatgtatgatgaaagtggatggcattgctccaaatttcattaaatctatatacaaagcttctgcagctttgtatagagctgagccgtggaagaggctgcgtccagggcacttgtttggcgtccgggttgggaaagattcggattggcctggcaagaaacaaccttttccatgtgttcagttcattggaggggatggaggagatgttggattttacatgtttagatcagagaatgatgctaagaaaatgacagggtctagagagaccattcatgttccaaatgttgagcttctgagggtcacatatgaagtggagtctttgatgttcccttctaaccggaagatgatcaagtctttgtcattggaagcatcaggctcagatcggtttccagttattgatgttgcacgatgcacgccatctggtgatcttcgatttagaaatccaaaccttgaagagcttagatttgtctatgcattcatgaaggccatttccctggtgcactccttacttcaggttgacagggaaagtggtccaaagtattcaacagtggtgtgttttgaaccttttatagagactgttgatgttcagtggcctccagaagtagccaagggaggttatgaccttgttgctgttactgtttcccacccacccggtcaggcatatgatgaaaaatctaatagtgcgagtgctggctcgacccccaccaagtatgtagaaccacctagggaggacatattcaatgacacaaaagcatactcaagtactggcttgagacagtgtgcaatatgtgagaaagaagtgaatggagaacagtctctttgttgtggccggtgtagagcagttgtttattgcagttcaatctgccagaaacaacactggaatgacacacataaaagcatgtgtggactttacaaggccatgatggagagggaagaagagctggctataatgattttcatgttcccatgttctgctgaccagccttgtaagtggcttgaatcattaggtgtccaccagaagggtatgtggaggagaaagtgcagttgctattcacactgcccttttggtctccttcctgtgaaaggtgggctgcaggaactatggggtggaattgatgaatttgaataccctcatgattctccatttaataaccatttcatctcaagcccatttcttctctctggttggtctgagtactacaaccttcgctcacttccattgtcaagtcctgtagccgacattctttcacatccattgaccgtgtatcacattcttaccacccttaatataagttcaaagaaccttatactgaaagggaaagaggtgattgtccactaccttggacctgaaggagagttagattggatgccagcattcgcagaagtaggacacttgcttaatggattaggcaatgtacaaatagtgatggtgggaccagaagttccaacaaatttgtcaggtacaacctcaggaattggtagcagagttagagtgaatcttgtaaggggtgtttatcaggtggaagcctcctacctacctactccacatgtcgtcattgctctgaattctagattagcaatctattctagttggggtggagctcttgatgtaatcaaatcaattggggtgcctgccttcttcactgatcaatccgaagtttcgtgtgtaaatgctaaacaagttcttcggaatgctggactgcacatcacacatccagtaactccaaatcctttccggtcacctgtgaaaaatctcacagcttctagcaatcttccttcatacagcaatggttttgtctttggggtgaatacttga

SEQ ID NO: 28401 - DNA, 270 bp, Glycine max
  Peptide Sequence Number=SeqID_120086
atgaagaaagcaacttcctttttttccctcagccttggtgttgtgttttcttctcacctatgctgcatgtgtcccttggtttccctttctcttctagctttaaagacttttgagtttctcagattacgaatgcgcgctcagcgagcatgtctcgctgagcaagagttagtgactaagcgcttaacgaatgtagacgcgctaagcgtgagaagcgacaaaggcttcgctgagcgagctgactttctcgctaaacagattagcctcgcttag

SEQ ID NO: 28402 - DNA, 219 bp, Glycine max
  Peptide Sequence Number=SeqID_120087
atggcaacagtgaaactgagagggagcttagtctatgatgagtgtaaagcgcaaggagagagtggtgaaagcctcaaaggcaaggatgttggccatggtttgcacacattggacagttggaatggcatgattggtggcttgtctgacactccagctccagttgattggggtgaagccatgaagttgtcacatgaaacaacatacctacctagaagatga

SEQ ID NO: 28403 - DNA, 840 bp, Glycine max
  Peptide Sequence Number=SeqID_120088
atggcttctatggcgagaggcgccaagagacgccacgctgtaataagtaaaaaaatgctcatcctcttctccgcttccctctcatgcgtcgtcgttttggttattttttctctcttcagattccactctcccaaacccccaatttcaatttcaatttctcgcgtcgtcttcgatggccctcccaagatcgctttcttgttcctcgttcgccgcaacctccctctcgatttcctctgggacgctttcttccagaacggtgacgtttcgagattctctatttacgttcattcggcgccggggtttgtgttggatgagtcaaccaccaggtcacaactcttctacggtcgacaaatcagtaacagcattcaggttttatggggagaatcaagtatgattcaggctgaaagattgttactagcagcagctttagaggaccatgcaaatcaaagatttgttcttctctcggatagctgtgttcctctgtacaacttttcctacgtgtacaattatctcatggtttctccaaggagtttcgtggacagttttcttgatgcaaaggagggccgctacaacccaaaaatgtcaactaaaataccaagggaaaaatggcgtaaagggtcacagtggatcactgttgttcgtaagcatgcagaagtgattgtagatgatgatgttatcttttctgtctttaagaaatattgtaagagacgtccaccaattgatacaagcaagggaaagctgaatctgtggtgcacgttctttgcttttgagtggaaaattttaattcaaggcaggctaggtagtttaagttatgttgattgtgtttatagttccaaataa

SEQ ID NO: 28404 - DNA, 174 bp, Glycine max
  Peptide Sequence Number=SeqID_120089
atgacactagcagtggcaacgatggtgccattgaaggtagtggtaattagtggtggtggtgtggtgatagtgacgatgtcgatgatgatggtaatagcaaataacaatatcggtgattatgatgctattgatgtcaacaatgatagtgatggtaggggtgataatgcagattga

SEQ ID NO: 28405 - DNA, 1581 bp, Glycine max
  Peptide Sequence Number=SeqID_120090
atgcttgaatcttctatgcaatgtctcaaatgttctaaagaagaggcaacaaaatggaacactgcccttaataataatgaagcatgcaacaagtttaatatgcttcatggaatgaagcatgttgaagaaaaacaaattgtaggtgactgttactttggtgtcactaatttgctagaactcctacgcgctcagaggtccatcaatgaacttaaggctacacaaaagtcctctaagaaaacagtggaacaatttttgcagaatcttgaagacaaaagggtctcccagaagtgtagagaatgcctcaagattggaacaatgttagataacataaaggacaagttggcaagggaaaaaagaagtagagaaaggatggagttattcaataccaaattggtacatgaattggctaaaaccaagatttctgcaaagcagtatatgacaaactacaagaaagaaaagagagaaagaaaactgatagaggaagtttgcaacgaattagccatgcaagtaagggaagacacggctaagcttgaggtgttgctaagcgattccgtgaaaatttgcaaggaggtggaagaagagagggagatgatggaaatggctgagctatggcgcgaagaacgcgtgcaaatgaagctagctgatgtacagtttttacttgaagacaaatataatcagatggtccagttgattgcttttctccaagtgtttttgagatcaaggggtgctgaactagacaccactgaactagaggacgcagagttgatcaaacaggtagttgaatcagtaaatatcaaacgcattctggagctttcatatgatttctcaaagtcagatgacacagtttccacttttgaggagctaagaaaagaaaacacagaagaggggaagattaaaccatgttattcccataccacacttactagccctatgtccacaatctacattgaaaatcttgatgaagagttgaatgaaagctctatattgcatcacaacagtccctccagtgattataattttggattagaaccaactaattattccttagaaactattggttatattgaggatcggaagtttagctcaatgccacaaagaggagacacctattctgttaatgttaattaccaagacaaggatttattaggtagtgaaaaggcatgtttggaatctttaaagacaggagttaatggggaatgttccgtatctattggagacttaaagaggaaagtttgtcttacttctaaacaactaaggtcatgctccaataatggtggaataacgatttcttctacaaaatgttctcaacatagaaggctaggtgatgatggttggcacaaacaaaaggagtgtaaccatagacttccaacaagttcaattcagtgtcaaggttctgttgaaggtagcttcaaacactcagaattgttggaacaaggaaactctacatacaataacacgaacccacacataatacgtgggatgagagggtgcacagaatggccacgaggtattccaaaatctagtttcgaagtcactccttttggaaaggagagaaaagccaaaaatatcggttatacttaa

SEQ ID NO: 28406 - DNA, 132 bp, Glycine max
  Peptide Sequence Number=SeqID_120091
atgtttgaggacaagaaatggcagcgacagcagctggttggtgggattggaaggttcacactaattggaggtggttataagatgcttgcaaaaaatttcttggctggcaatatcattgtcactttctgctga

SEQ ID NO: 28407 - DNA, 138 bp, Glycine max
  Peptide Sequence Number=SeqID_120092
atggcatatcacttttctgaatgtgtagagagtcatgcatttgaaacttatgacaaatttatcaaggttcaaggaggcccaagaccaattagtgcccgactatgcttgggggtaccagtgatacaacacgtatcataa

SEQ ID NO: 28408 - DNA, 138 bp, Glycine max
  Peptide Sequence Number=SeqID_120093
atggcgttccgatctttccgatttctcacacgcttcgccaaaccccacaaccccttcccctccacgcgccggtccccactctcatctctccacgcgcctccacctcaccacgaacaacccaacctcgaagaccgcctc

SEQ ID NO: 28409 - DNA, 384 bp, Glycine max
  Peptide Sequence Number=SeqID_120094
atggtgcctcctcaacgtggaaaagaggaggaagacatgaatatattggttagggtaaaaggatgggaagttgaggattacgagtattggaagatggactggggactcggagtgccgctaaaagcgatgatgcacgacgacactgacaggctcttcgaggggggcgttagcaagggtgtcgacgaagatggggccaaagacgtcatggctgaggtgtgtggagaaggagttggtggtacggcgaaggaaagagaagaagaggcagtgcaatggtggccaaagaagggagttagtttcggtttgtggtggaggaatggatctttggaagagggtgagaagatcgagaaggagaggaggaagatgacgaaggagaaggggaagtag

SEQ ID NO: 28410 - DNA, 789 bp, Glycine max
  Peptide Sequence Number=SeqID_120095
atggcatccttttcaatcactggtcccataaaatgcaaaacatttgcctcattttccccactgtccttttctgctacctataattcttgtaatattaccatttctaataatctaacaagaaaagttcgtgcacatagcaattctctatcttcattttcataccaatcctcgtgtcataggagcttgtattctgagaagctgcagagaggccaatccctgattgcctttgatggcaataactcagaatcagaagcggaagatgatcatgccctggactcagtaatgaaactgtactctgccttcaagaacaaaaacacacacgaattatctgcagatgagcgccgacgtgtgagcaatttcctctcattcttcgaaaccttccaaggaagaacgcaagtgttggaattcttttcttatctgacaagtatattaggaaacaacattcaaattatatttaaaccgactccccatgaaggcgtaaatgttggtctccagtggaaattcgaatggaacaagatacaccttcccctttggaagggtttcggcttacacataagccacacttaccacggaagagcagtaataaggaatattgagacgtttatggaaccactgctccacttgaaaccctttggactgaaaatgaaaataggcttgggagaattcatggagaagatagcctcatttatggtgtcagaattcgggaataaggctaaaagagttttataccttgttctggccgtgtcgtccctaactgctttcttattcttcatgaaactagcttcctag

SEQ ID NO: 28411 - DNA, 1071 bp, Glycine max
  Peptide Sequence Number=SeqID_120096
atgtcgacggacctgcaattgaagtcgagttgtagcggatgcggatcaacgacggatctctacggaagcaattgcaagcacatgactctgtgcttgagctgcggcaaaaccatggcggagaaacgcgccaaatgcttcgattgtggggccaccctcactcgcctcattcgagaatataatgttcgtgcaagttctaccaatgataagaattacttcattggaaggttcataaacggtttgcctgatttttcgaagaagaaaagtgctgagaacaagtggtctctgcagaaggatggactgcacggacgccaaattactgatactctgcgggtattgaaatctatccttgtgttattattgttgctttgtcgttatagcttccaagcgtggtatttagttagaaggagtgctttaaagcactgtatttctcaaaagaaatgctctctgaaaaattggaaacttgtaatacttaagtattactttatgcttaggaatacaacgacatatcatgtcacggagaagtacaagaacaagccttggctcttggaggacgaaacgggtcagtcccagttccagggtcatctagaaggttcccaatcggctacatattacctgctaatgaaggaaaggaaggagtttgttgccattcctgctggttcttggtacaactttaacaaggtagctcaatataagcaattgacattggaggaagcagaagagaagatgaagaatagaaagaaaactgcagatggatatcaaagatggatgatgaaagcagcaaataatggcccagctgcatttggtgaacatgggaaatttgatgacaaggaaagcaacacaggtggagtgagaatccgtaaaaaaactggtgaggatgatgaaggtcatgtctctgataagggagaggaggatgaagaggaggaatcagaaaggaagagtagacttggactaaataaaagagctggtgatgatgatgaagaaggtccaaggggaggggaccatgatctagatgacgacgatgttgagaagggtgagtatcttgccttctttgttcatgatgtttctgattag

SEQ ID NO: 28412 - DNA, 468 bp, Glycine max
  Peptide Sequence Number=SeqID_120097
atggttggaaagttgttggtgatgaggcttgtgttggtcatctatatgttgagcactgtcattttgaaatcctcagcacaagcatgcaagaacaagaccttcaatgacaacaaggtgttcgccaaatgtcgtgatcttcctcagtcatcctcatatctctactggacctatgatcaagccacagggaagttggacatgacattcacacatgctggaatcactgcaccagaaaggtgggtcgcatgggctatcaatcccaacaacaacctcaaaacagctatgggaacatttcgtatcctcactcaggcttggcggctacccgtcaaaacaatgagatcactatctatgctatcctgcaccaaagttgttcacctttggcaagatggtcctctctctagttctatccctcaagcccatcaactagctacttctaacatccaagccaagggaatcttacatcttgtctaa

SEQ ID NO: 28413 - DNA, 924 bp, Glycine max
  Peptide Sequence Number=SeqID_120098
atgcacggtgcgactcgaataagaaaaaggtgtaacgaaggcttccacgagttcacggctgaaacgaacagtgaagaaggaacggtgaagaagcgaagaaatgaagagggtgaagacaatgtgaaaggaacaaagcttgaatcttctataccacatctcaatggttcaaaaggagtggccacaatatggaaccctactcgcaatgaagcatccaatgagtttatcatgatccatagcaggaagcttcttgaagacaaaaaagtagtaggtaaccataactctgttgtatccactttgcttgaagaactccttcaagctcaaagatccatcaataaactcaaagcagaacagaagtccctcaagaaaaatgttgaacattttttgcaaaaccttaaagtggaaaacatctttttgaagcacaaggaacactacaagattaaagcaacattagatgacttaaagggtatgttggaaagggaaagaagaagtagagagaggatggagttacttaacaccaaattggtgcatgaactagctgaagccaacttattggccaagcagtttatgacaaactgcgagaaagaaaagaaagaaagagaactaatggaggaaatgtgtgaagaactagccatgcaaataggagaagacaaggctaagttcacagtagtactaagcgaatccatgagaatttgcgagaaagtggaagaagagaggaacatgatgcaaatggctgaactgtggcgtgaagaacgcgtgcaaatgaagcttgctgatgcacaacttgttcttgaagacaaatataaccagttggtgcaactttatgcttctctcgaaatgttcttcatgtcaaggggtactgaacttgaaactacggagctagaggatgctgagtcgatcaaacaagaagttgaatcaataaattaa

SEQ ID NO: 28414 - DNA, 372 bp, Glycine max
  Peptide Sequence Number=SeqID_120099
atgccagaggttgcaatgcaaaagttttcagcatcaacactacaaaaggcaaagaggattgaagatgaggtgagagcaactgttgctgagctgcaaaatgttgttcgtgtatttagtcagttttttgctacttccaacctacatattcatgggtttgatggggaaaaaattgacactcatgttggatactgcaaccacttactttcggttgctaaagttcatcttgaagcagctgagcgtgaagagcagcaaggtttagggttcaaaataatgatcgtcccgttatccctctatagcatttttggggtcggccactccgcgttgctatttgggatcggctactatggtattatacaagtaaaccaagaataa

SEQ ID NO: 28415 - DNA, 351 bp, Glycine max
  Peptide Sequence Number=SeqID_120100
atggctctaagatgggttctccactcagcttgccatgttttggggtaccctacgaggaacatagaagaagaggagtgcaagaagattgaaggttactcaaatattggagaggccaaaagcgtgaaggggttatccctttcaaacaatttcaatgaggttgatcagtgctatccttgttcagggtttcaaatgccacttcactatccacgctacaccaaacaagactatgagagcatggaggagtggaaggtggacttgcttcttaagcaatatgggttaagtttcaagggcacccttgatgagaagagagcttttgcaatgggagcattcttgtggcccgatcaagattag

SEQ ID NO: 28416 - DNA, 1005 bp, Glycine max
  Peptide Sequence Number=SeqID_120101
atgggcaatgtcaatgggagagacgatgttaatggtactccatcgggaaccgaaggagaagaagaagaagccggagaagagggtggttctgacagtgtcgccgattgcatgtcttccaaccctggccatcgtgcgccttccgagttgatgggtcattctccccctgctagccctagagcaacccaatctccattcatgttcaccccacaagttccggtggttccgctacaaaaacctgatgagatgcatgctccaagcccttcctggatgcagactacatcaggatatgaggatatgtactgtgaactagggattccaacgatgattacttggagctatgatgggaaggaagttgctgtggagggttcgtgggataattggaaaacaagaatggctttacagagatcagggaaggacttcacaataatgaaggtgctgccatctggtgtataccaatttagatttattgtggatgggcagtggaggtacgcacctgacttgccttgggctcaagatgatgctgggaatgcatacaacattttggacttgcaggattatgttcctgaagacattggaagcatttctagttttgaacctcctaaatcaccagactctagctataacaacttacaacttagttctgaagattatgcaaaggagccaccattggttcctccatatttacaaatgacgcttcttaacattccgtcaacaaatatggaagtccaacctcttacatccagacctcagcatgtggtactcaatcatctttacatgcagaaaggaaagggtagcccttcagtggttgcccttggtacgactcatcggtttgtagccaaatatgtgactgtggtgctgtacaagtctttgcagagaaattctgagcatcataaggatcattacatgaaagtgaagattgtggtacatataatgcaattgcttgatggccattcatcatgcaattcagtttccattcttacatcatttgatgatgctattctctag

SEQ ID NO: 28417 - DNA, 207 bp, Glycine max
  Peptide Sequence Number=SeqID_120102
atggaggggaatgggggtggttactgccttactggttgtaaaatttcagttcctatcgcactcgcaggttcattacttggtcagatcactgccgaagctctcactcctcttttcctcagccaggaatccccattatctttcaagtgctcagcgtttcatatctcaagggagaatagcagcttcaagagggggtctcttgcatcatga

SEQ ID NO: 28418 - DNA, 393 bp, Glycine max
  Peptide Sequence Number=SeqID_120103
atggctgaaacaatggagacaaattccagagacaaaaaacgtgcatgcctacactcccacatccatggccttgccctagattcctccctggagccgcgcctgcctcaaacggcatggtcgggcaacaagactgccattgccatgggaatggccaagtccctcgagctcgaaaccccctttgccatgatcaccgccagcgaaatcttctccctccagatattgaaaactaaagcgccatcgttgtccacttcaaggaagaaaccaaagtcgtcgaggttcaaatggaccgtcccgcggcatgaattgttgagcattcacatgcctgcatattctgattctattgttaagggggtctctacagtcatggttcaaactccagttggaatggtgtaa

SEQ ID NO: 28419 - DNA, 594 bp, Glycine max
  Peptide Sequence Number=SeqID_120104
atgttcttgatggggatgaacgaatctttctctactatcagaggtcaaattctttccgtggatccctttcccccaattactaaggtttttgccttaattgttcaagaagaaaaacaaaaagaggttggtgcatccacatttggaacttttgctagtgaggtttcacatgcttttgcattcaagaactcttttaatgaaagaaataattctgataatcgctccaaaggcttttccaagaacaccccttgtgtggtcattgtgttgcatggctatcctccaaattataagaagaatggatattcctcaaaggtcgagaagcaatcttcttcctcctctaaaccatcacacaaggttgctcaccaagtgtctgttgatatgcctcaatcacaaccctcttctgttgacttgggttcacagtttcaacttattgctcaacaatatagccaattgatgaatcctttacaaagtcatgctaccaatattgtcattcctcacggtgtttcttcctcaagtggagaagcaagcttgcaagaggattggcagaggggatttcatccaaggcctttatgtcctagacctcaaggacacttatga

SEQ ID NO: 28420 - DNA, 315 bp, Glycine max
  Peptide Sequence Number=SeqID_120105
atgtcgcttaagtcaacgaggtccagaaatgcttccaacgtcggtgaccttctccgtcaaagcaatgagaaaattgcccctgaagccattcaagcacatggtcaaggtaacaggaacatagtgcgcgcgaggtgtgcgacacatgggtcctgtggttgtggtcatgttcattgtggagatctcatttctgggaaggcgcgctggatctggaagggggaggggtggtgcacgatagtgatggaggttaggggtgagaagtttgaaggaaagaaaaatgtggtccatggaaaggtggagggtatgttcgtcatttaa

SEQ ID NO: 28421 - DNA, 654 bp, Glycine max
  Peptide Sequence Number=SeqID_120106
atggctgaagccgcaaaacttgtcaacaatgccgacgtttccaaccgcacgccatcgattgcaaccatagccaagctgctgcctgacgtctcaaaaattaaggtcttcactggccaaaccttccattgctggcaagaacgtgttcatacattgttggaaatgcatggagttgtcttcgctctttccactcccaaacttgatgccgtataccgtcacactttgttaagtgccttgtccaatcatcttttcgatgtctactgctcctacaaggaatccaaagagatatgggactctctcatactcaaatacattgttgaggacctggctttgggtttgagggtggtaaagaagactgatagacctgaatacaagtatactatagctatgcttgggtatgcagaggaacatgagacaactgtgttggagctgacatataactatggtgtcactgaatacaccaagggaaatgcttatgcacaggttgctattggtactgatgatgtatacaagagtgctgaggttgtcaacatagtcacacaagagcttggagggaagattactcggcaaccaggaccaattcctggccttaacacaaagatcactgctttcttagatcctgatggatggaaaactgtaagaaatttctttgtttaa

SEQ ID NO: 28422 - DNA, 507 bp, Glycine max
  Peptide Sequence Number=SeqID_120107
atggagggccttgtgaagcttacaaacatggtttgggagttacgaattagtgaagccaagaggttgagacatatagatgtcctcagagatggtgtccctttggcaacaaggcaagctgtatgccgggaaatagaaccatcagtgttatgtttgagtcgaaaatcccatttgttcccgatgacattaagatttagctatgaagggacaagtgtccaagttccattagcaatgagcgcattgagttcttctaacatggtgaacttgtttaggtttgaaaattccattcttagagcgagtcaccatgggagtttgattgagattcttcatttggggtttgagtttggtttaatgtttggagatatggtgaagctgagactggagaaggttggtttgatacgtgaggtgggtttagacttgaatgttgttgaggtgataaggtttgctgggaggaattggagtttggttggttcggtgataaagcagcttcctataaaagataggaattga

SEQ ID NO: 28423 - DNA, 186 bp, Glycine max
  Peptide Sequence Number=SeqID_120108
gagaataaaactactactcctgagaaggtgtcactaggtgatgccggtgatgaaagggaccatcaaagattccaagacacactgtccctttcaatgagctcaaggccctcttcacattcgttcttgaatcggagccacactggtccagatgccaatgatgtctctcttgagctcacgctctgttag

SEQ ID NO: 28424 - DNA, 225 bp, Glycine max
  Peptide Sequence Number=SeqID_120109
atggcacccacattgctgctcttgaatccattttgcccatgtgatcgcaggcattggtacaggtataggtggcatgggaggaggcctaggaggtggtgctgggtagtggctttggagctggcatgggcatgggtggaatgggagaaagaaatgatggggatagaggcagagaaggagattataaagaacaatgatattcctattgctcctatgattgcactataa

SEQ ID NO: 28425 - DNA, 719 bp, Glycine max
  Peptide Sequence Number=SeqID_120110
atgcagagataccttatggttatccgcaccttttgtcagctagaggcaagcgagcctgttgacacgcagagactaacgtcatcatgtgcacctgtcccagagatgtcaacatcttccgatcgagactgcgaaaaagtctcctttgttatccgtcagactcaaggttctgatgccaagtctgaagacatgcagagataccttatggttatccgcaccttctgtcagctagaggcaagcgagcctattgacatgcagagactaacgtcatcatttgcacctttcccgaagatgtcagcgtcttctggccgagactgcgaaaaagtctcgtttgctatccttcagactcaagggtccgatggcaagtatgatgacatgcggagataccttatggttatccgcaccttttgtcagctagaggaaagcgagcccgttgacacgcagagactaacgtcgtcatttccacctttcccgaagatgtcagcgtcttccggtcgagactgtgaaaaagtcttgtttgctatccatcagactcaagggtctgggtccggtagcatgcagagatatcttagggttattcacacctttcgtcaactagaggcaagcgagcccgttgacacgcagagaccaatgtggtcatctgcacccttcccggagatgtcggcgtcttccgaccgagaccgcaaaaaagtctcatttctgccatcaaactcaagtgtccg

SEQ ID NO: 28426 - DNA, 435 bp, Glycine max
  Peptide Sequence Number=SeqID_120111
atggcagaggtctccacggaggccattgcctcctcacctattaacgcccacggtcgagagtttgaagagatcccgggatgcccgctgggaggaaggaagccatatcttttctcagggttctatccctctttggctagaatttcaaaaatagtcaaaatctcggcacaagaattagatcaggggaagcaagtcaaaaatggagtggttggcgtgccaaggaaatgtttggaagcaaaggcaagagccttggcaagtcaagacgaatgggctccgttcattgatgtcttggcactcttgatcttcagagtggtcctctttccaaacgtggatgggttggttgacctggcaacaattgacgcttttctcgcctttcatgactgcaaggaaagcccggttgtcgctatcttagccaacctatatgacacattcgattga

SEQ ID NO: 28427 - DNA, 217 bp, Glycine max
  Peptide Sequence Number=SeqID_120112
gtcgactctagaggatcccacctttacttcttttccgtgccctactccggaccagttcagggcagaggtcgcatggcctggagattggcctgaggcccaggcaggagaggcaccagcaggggcaccagcagaggctcctgacgaggcagatgaggcccgcgagcacgaagagatgaccgatttacttgatttcttaggagggagcggggccacatga

SEQ ID NO: 28428 - DNA, 72 bp, Glycine max
  Peptide Sequence Number=SeqID_120113
gaatctcgcaaaggtttgaaccgttcttcgacgttcttcattcgttcttcatcgttcttcgatcttcaacgg

SEQ ID NO: 28429 - DNA, 357 bp, Glycine max
  Peptide Sequence Number=SeqID_120114
atggcaacgtgtcttcttcgcgttgggagatttacgagtatcgattcgcgctctctcttcgtttccactgctagtttctcctcttctttctcttcgccgtcatcttccggtaagtctaagacggggaagaagctcacggatcgtctttcctccgtcatcgacgccgtcaacgatcgcaaactacctcccgagctacgcggccagcacaacaacgtcagctttatctttattggatttggatatctctctctatctgcccttccgcaggttgctaagacattagttggtggagggtggtgccaggcacaaacagagcttgtttcaaaaacaattttcaaaacaatagtttttggatga

SEQ ID NO: 28430 - DNA, 485 bp, Glycine max
  Peptide Sequence Number=SeqID_120115
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggaaaacgtgtacgagtcattcatgattatcactgcaccgcacagtgcaagctgtggtcttaattacgctgctttatggtcgggaaaccctggtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 28431 - DNA, 480 bp, Glycine max
  Peptide Sequence Number=SeqID_120116
atggaagaggagaatgcacggcgagtgacactagaggactactctagtacaactacctcacaattcttcactagtattgcaaggctggaggttcaagtggccaacatatcttatccccactctctcaaccagttgatacaaggaaacctcttccacggtctaccgaataaggatccttacgcccatctcaccacctacatagaaatatgtaacatgagtcaaagactgccgaggggaagatggaaatatcctcattccatcaatttcctgatgaatcactcagcgaggctcagaaagacgcctacacatgggtacaacgagcctgagcaattaaacatcttcatagatagcctgcgaccacagtcaaagcaactccttgacatatccgtagggggaaaaattaagttgaagaaaccagaggaggcaatggagctgatagaaaacatgacggccaatgatcacgccatcctttgtgattga

SEQ ID NO: 28432 - DNA, 618 bp, Glycine max
  Peptide Sequence Number=SeqID_120117
agtctagatgtcaccagccttaaggagttgggacggttgatgggacccctccaaaggcaagccttccgcaaagtgtacggaaagatcttggatttgaccgcagtggaggtatttacggaagctgttgtatccctcgcccaatactatgaccagccgttgagatgcttcacgtttggggacttccaaatggtaccgactgttgaagagtttgaggagatattaggatgccctcttgggggaagaaaaccgtaccttttctctgggtttcttccctccttgagtaagactgcagctgtgtgggtcccgtttgcggatatactagctttgctgatctttggggttgtcctctttctgaacgtggacggtttggtggacctagccgcaattgatgctttccttgcatatcaccatagcaaggagaatccagtggtggctatcttggcggacttatttgatacctttgaccgaaggtgcgagaagaacagcgcacggattgtctgttgcttacccgctctctgtgtgtggttggtttcgcgcctattccaacaagacgaaggaaaggagggagttcttttctcatgtggggactaccctaatgttccgttgatagggacgacg

SEQ ID NO: 28433 - DNA, 357 bp, Glycine max
  Peptide Sequence Number=SeqID_120118
atgcaaagacaagatgaaacgaaaggtcagattagcgtttcattctctaccgaaaccgcaagccaagttggaaaattccgctccaatcgacgggttcctctcgttgtggagtttcaatggagaacaacgatgagatgctctcgggaacggaagcttctagcacactccagacatcttcgcagagatcccaattgtcagatcatggaaaattgtcttgtgaagttgtcgaccaaatttcgagaagatccaacggttaacgaaggctgggaagcatttttaccgaggcagcttcatgtagctttctctagaagcttcattaagaggcttcctccagaagcttccttgtggcttctttga

SEQ ID NO: 28434 - DNA, 126 bp, Glycine max
  Peptide Sequence Number=SeqID_120119
atggcgccaaaaacttgttcacttccagcgagtgcaccagatcgcgcaagtagtataaaacggtgcttgatgttcaaaggatattctctacttaacaatgcttatgtcttctatggtgtctcctaa

SEQ ID NO: 28435 - DNA, 208 bp, Glycine max
  Peptide Sequence Number=SeqID_120120
atgggtgaagtagaggaggtgcaagagcagatgaaggccaacatagaggccttgaaagagcaaatggccacaatgattaaggccatgatgagcataaaggagataataaaggtcaatgcgactgcaatagccactaccagcaccattgttgaggtggacctgccccccatatggcctcaaccaaataaatcatccaaccccagatatg

SEQ ID NO: 28436 - DNA, 251 bp, Glycine max
  Peptide Sequence Number=SeqID_120121
ggtacatcctttgtggtacaagtagagggtacatctacttggggattgttatactgagaacaagagaggcctcttgtggatcagttcaagtggagggtacattcacttggtttttcaaagagaacaaggaagggtacatcccttgtggatctttggcttgtaaaggattttacaaggttgaaagaaatctcaagaaccgcaggttgcttagggagttgatgcaggcacggtttgtggccaaaccagtataa

SEQ ID NO: 28437 - DNA, 372 bp, Glycine max
  Peptide Sequence Number=SeqID_120122
atggcgcctaccaggcaccctctggacccggataagtccaacagggccctgggatttcccgccttgatcacaagactctgccagtcgttcgacgtccccgtcgcacctagcatggcggccaaccaccgggcacatgtacagacccatgattgtctttatcagatgagtctcagcctgcagagccagggctttacttcttttccgtgccctactccggaccagttcagggcagaggtcgcatggcctggagattggcctgaggcccaggcaggagaggcaccagcagaggctcccgatgaggcagatgaggcccgcgaggacgaagagatgaccgatttactagatttcttaggagggagcggggccacatga

SEQ ID NO: 28438 - DNA, 862 bp, Glycine max
  Peptide Sequence Number=SeqID_120123
ccatttggtgccgcaaacgccgaatgcaaactgcgctccggcttactggaactatcaggagattcgcccacatcttctggccagcggcgagttgattggcgccaaagaggcggttcgccgcgtgctggtgctggaaaacccgatgctgcgcggacagtcctccatcaccccgacgttgtatgccggattgcagttgatcatgccgggtgaagtcgcgccgagccatcgccataatcagtcggcattgcgttttatcgtcgaagggaaaggggcatttaccgccgttgacggtgaacgtacgcaaatgcatgaaggcgacttcattttgacgccgcagtggtgctggcacgatcacggtaatcccggcgaggaggcggtggtatggctggatgggctggatctgccgctggtgaacttgctgggttgcggtttcgcggaggactatccgcaagaacagcagcccgtgacgcgccaggagggggattatttacctcgctatgcggccaatatgctgccgttgcgccatcagaaaggcaactcgtcgcctattttcaactaccgctacgatcgcagtcgggaagcgctgcacgacctcacccgcttgggggaagtcgacgagtgggatggctacaagatgcgctacgccaacccggtgaccggcggctatcccatgccctcgatgggcgccttcctgcaactgctgccgaaaggcttttcctcacggaaggcgcgcaccacggacagcaccatttaccacgtggtggaagggcgcggccaggcggacgaagacaccgtgttattcagtttttcggaccgaccggttcaggaagccctgggactgttccgtgaagcacgttattaa

SEQ ID NO: 28439 - DNA, 627 bp, Glycine max
  Peptide Sequence Number=SeqID_120124
gatctagactaccttggcccaggtgtggagtgttctctcgtactccaacctgacccctacatctcatacatcagaccttattgtggacagagtcagtcaaactcttgcagacttgggtttcctactttgcttaccaccttatgccgagcccgaggggttgtctctaacaacctcacatttgagcgcctgagcccggctattaacttggcatacatcaggaagaactgttggaacattgatgatctaacagttgctttcccgggggctaggagggcgagggtgaggccagttgatattccatctacttttgcaactccatcacctactccaacatctacttttgcagctccttcagtcccagctcatatggtatcttctccagaatccatcctatcagtggatcagttcttagagaaggtagcttggcttggggcccatccttctcttgatagggaaggtggaggtcccacagcccaggtagcccaacaggtacaggatgcttcatttgagaccaccattccagagccattcactcttcatcatgaggtaggtgaagaacaggtgagaccaaagattgatgttacttctgagagatcacttgagggcacatcagagcctcctactccc

SEQ ID NO: 28440 - DNA, 522 bp, Glycine max
  Peptide Sequence Number=SeqID_120125
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatccccgctattgatgaagagaaggcgagagaggaagaggatgcggatgccgaaatgcagctcaacatcaaccaagagtctgatgagttcagattgcctaccaaagaggagtgcttgaattttggaagagtaacagaggagaagggtaccgagctcgaattcgtaatcatggtcatagctgtttcctgtgtgaaattgttatccgctcacaattccacacaacatacgagccggaagcataaagtgtaa

SEQ ID NO: 28441 - DNA, 832 bp, Glycine max
  Peptide Sequence Number=SeqID_120126
gactacatgtcctcaccttcagagggctacacgtcctcgccatcagagggctgcacgccctcaccttcagaggactacacgtcctcgccttgagagggctacacgccctcaccttgggactacacgtcctcaccatcagagggctgcatgccctcgcctcaagaggactacatgtcctcgccttgagagggctacacgccctcagcttgggactacacgtcctcactttcagaaggctacacgccctcgcctttagaggactacacgtcctcaccatcagagggttgcacgccctcacctccagaggactacacgtcctcgccttcagaggactgcacgtcctcaccttcagaaggctacacgccctcgcctttagagggctacgcgtcctcactttcaggaccagtagtttccttttaacggttcctggggcaccccctgatattggaggagggccaactgtgcgagcacaaccagagagggaggctatcacacagctactatgcatactggggcaagatttcacccgtgccgctgcaaagagaagacaacattctgcccagcgaccgcaatgccaatctccccctgcggaagtatcagttggtctgtgccgtcccgacatggggatcgcacccacaaagacacctagtgaacctgaagaagtccaaaagggccctggggtttccagctctggttacgggcctctatcagtcctacagggtgcccgtacccccccggcaaggtcacgtcatcataggattgcgcctgcaagacacccagtggacccgaagaagtccaacagggtcttggagttgtcaagctctaattacgg

SEQ ID NO: 28442 - DNA, 330 bp, Glycine max
  Peptide Sequence Number=SeqID_120127
atggcggcgcagctaatccatgatcgagtggagatggagtgcctagagggagcttgggagaccctcgaaggcaacacgaggtgccgatttcggggcaccattcgattcacggctacttctttggtgacgtcatccgaggaagaccctgaggaggatcccgaggagctacctcccgagcctgctgtggatgctcttgactttctagagggtgatgaggacccacttcctgaggtggattctcccgaggaagtcatgtcggcatctgaggcagactttacggaggatagtggcccgggggagatggcgatcagcggaggctcttcatcctag

SEQ ID NO: 28443 - DNA, 690 bp, Glycine max
  Peptide Sequence Number=SeqID_120128
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccagaaaactttgctgagtttttttcttcgtgctttcaatccctaagtgttaaggagatggaggcttgtgttagggagtatgtggaaggcaagaaacatagacttatgggaaaacaaattgttgcagtcgaccaagtggttttccaggcaacgaaagtgcttacccaatggagtggtgcacaagctatggagaagagtttggatgttcaaagagatagagagctggtggtagctcttggactccaccgcaaaatgacttcctga

SEQ ID NO: 28444 - DNA, 224 bp, Glycine max
  Peptide Sequence Number=SeqID_120129
aatacggcgtacaaatcgctgcttccggcgagtacgctcacgctctggaggccatcaagtggggaaccgattatttcatcaaggcacacactcaaccaaatgttctttggcttgagctaaccggaggaatagatttaaatgtcggaagagtcaacggattcgtccggaatttcctgcaatctcgccgtgactggcgcttgttatcactctcagctggggcatga

SEQ ID NO: 28445 - DNA, 186 bp, Glycine max
  Peptide Sequence Number=SeqID_120130
atgacagaaggatgtataggtgtgtgggtgcttggatggtctgtgcggcgatgggcagcagcagcggcggtggaggatgatccctttctctctttgacgattcttccattgatgaagagtagtaagccttctggtaatcgattacaggctgcttgttcttgtgtaatcgattacactgaatggtaa

SEQ ID NO: 28446 - DNA, 399 bp, Glycine max
  Peptide Sequence Number=SeqID_120131
ggtgctttggatgcgcgtggttctaagttaatgccagataaaaaagattttggtatagttttccttgcgatggcccgggacgaggcgggtaatgtttcacagtttaatgaatcttctacctatttgatgggatggttaagagattatctatggttgaactcttcacaacttatcaacggatataacccttttggtatgaatagtttatcagtctgggcatggatgttcttgtttggacatcttgtttgggctactggatttatgttcttaatttcctggcgcggatattggcaggaattgattgaaactttagcatgggctcatgaacgcacacctttggctaatttgattcgatggagagataaaccagtggctctttccattgtgcaagcaagattg

SEQ ID NO: 28447 - DNA, 312 bp, Glycine max
  Peptide Sequence Number=SeqID_120132
atgaacgaaaacgcaattcatggggctccgaaaaaggttgagaatggagaattgcaccaagcaatcactacgcatagctccaaactcgaaggtggaggacacatcaacgaaaacgcaattcttggggctccgaaaaaggttgagaatggagaattgcaccaagcaatcactacgcatagctccaaactcgaaggtggaggacacatgaacaaaaacgcaattcttggggctccgaaaaaggggttgagaatggagaattacactaagcaatcaccacgcatagctgcaaagtcgaaggctgaggacacatga

SEQ ID NO: 28448 - DNA, 117 bp, Glycine max
  misc_feature (74)..(74): n is a, c, g, or t
  Peptide Sequence Number=SeqID_120133
atgtggaccactacgggggaggtggttgccgcccagctcgcccaggcgagctcagctcgcccaggcgagccagnttgcttcctccagaagcaacagccttctggaggaatattctag

SEQ ID NO: 28449 - DNA, 823 bp, Glycine max
  Peptide Sequence Number=SeqID_120134
atgttttgcgcgccttaccagatcctcagtacccaaacagcaaatcgttttgtggagtatggttgcacgggtgatgaaatcggctatgtatgggcggatcacccaaactacgatcctaccctcaaaatacaaatcgccagcgccgatacgcttattcgtcgcgtgttccctgacaatatcgatctgctgattatcgacgaagcgcacctgcgcaaaaaacgcatcctgcaggatatcgaacgcctgcgcgaaaaaggcgtgaaagtgatcggcctgtcggggacaccgttttccccgttcctgggcaaatactatgaccgactgattaagccaaccaccatcggcgagctgatccagcgcggcgacctgagcaaatacgaattttacgcgcccacaaagccggatctgaaaggggttaaaacctctccgtccctgcagtacggtaccgactacaacgaggcgcagctggcggagatcatgtgcggttcaacgctggtgggcgatatcgtccaaaactggctggagaacgggcgggacctgcctacaatcgcgttctgcgtcaacgtagaccacgctaattttctgactattcagtttaaccaggcaggcgtaaatgcagaggttatgactgcagatacgcctgcggaagaacgccaaaccatcattcaccgcttcgaaactggcgccacaaaaatcatcgtcagtgtaggggtgctggttgccgggttcgacagcgatgttcgctgcatcatctacgccaggccaactaagagcgaaattcgctggctgcaggcgctcgggcgtggcttgcgcaccgcaccgg

SEQ ID NO: 28450 - DNA, 391 bp, Glycine max
  Peptide Sequence Number=SeqID_120135
cctacagatggtagctcctccagggtccattctgtcaatagagcagttccttgagcaggtggcctggcctggagctcaaccctcaattgtgagaactggtggaaggtttgcagctcaggcacctcaacaggagggatctgacgaggcagatactcctcctgagcctacacctatgcaggctgaaccaatgccagatgatccacattctccagtggcagatccatcttctcccaaacttgaagtagctcccccatctttacctattattatcatctcaaaagactctacagagtcagcatctggagaagctgttgctctctctgattcctctgttttccatatgatagatgaggaggatgctcagactcgggatacccaggatctatcttag

SEQ ID NO: 28451 - DNA, 219 bp, Glycine max
  Peptide Sequence Number=SeqID_120136
atgttgaagaaattgggctacactccttgcaagcatatgtttgatcaaaatttagaaaaatttcgtcaattgagtccaaccatagcaacatggactaatcgcatttcaaaggaaaaatggaccatggcttatgataaagaaggacgtagatatggtcacatgacaaataacctctcagaatgtcatacccataacagcgttggtggaatcaacatatag

SEQ ID NO: 28452 - DNA, 501 bp, Glycine max
  Peptide Sequence Number=SeqID_120137
atgtcagccagtgatcatgccattctacgaggcagaacccaccaacccatgaagaaaagcttgatagagctatcatcacatgacgcattattggcacagaacaagttgctttctaagcaactggagattttaatagaaacacttgggctcatgaaacaggccaatgtactcccactgaagaaaacactcaagaaattcattatatgggaaatcaacagcgacaagggtatactcaaggaggactttcaggcttctagcaggttcaacaaagaccagagtgggccttcaaataggccaattcaacaaggacctaacatattccagagaactactaagttggaggagaccttgactcagtttatgcaggcaacaatgtcaaatcataaaagcactgagtcaacactgaaaaatcttgaagtccaggtgggacaattggccaagcagatagctgacaagtcatccaacagttttgtggcaaatatggaacagaatcccaagtag

SEQ ID NO: 28453 - DNA, 234 bp, Glycine max
  Peptide Sequence Number=SeqID_120138
atgtccgccagggtccagcctatagccttcttatgcttcttgagaactgacaacaacttctcctcttgctcatcagcaagggaggcagatataatcactggaaaactcttgctatcatccaaaggtaaacaccaccaccagacatgcaatcaatatcactttcagattcactctcagcatcaaattcagacatatgatcaagcacaatttcagactcaatgcatgaagagttga

SEQ ID NO: 28454 - DNA, 699 bp, Glycine max
  misc_feature (680)..(680): n is a, c, g, or t
  Peptide Sequence Number=SeqID_120139
atgacggacagcagtgcaaatccccgtaattacggcgagcgtccgttgcacgaagacgatccactgatggaactgtcgcggatcatggacttcggcacgcctgctgatgacaacgtcgcttggaatgagcgccgacctagttactttgaagatagccggacagagccgggcttcgatccatcgctggatctggagcgcgaattgctcggtgacttcaatgattattctcagcctacggaccagtcccagttcgcagcgacccctgcacaagatgattctcatctgttggatgagcctctgattcatgaggaagaacttgcttcggctctggaagacgagcttgatcttcaaatggatgaagatgagcaggcgccggaattggaaacgccctcattcgaagcacttgagttcgaagaagctgaccgcactgaacctgtgccgcaattcgactacagtgattattcggctgcgcgcgattcgaacgaagagacctatgccgcatcgtcgtcggtctacgctcgccgggaaactgtcgagccgcttcatgtcgatcagaccgattacgatccgaccatctatcagccagccatagagccgcatcaagaggcttatcagcctgcgcgcgatcatgaatggaacgttcaggctgttgagcctgccgaacagtcctatgccaccgntgcgcccggtttcacttga

SEQ ID NO: 28455 - DNA, 419 bp, Glycine max
  Peptide Sequence Number=SeqID_120140
ggccccgtagataaaccttctgggggtcgtcacgtccttcagaggtttggacctgcgcggcctacccgactcgacggcattaacagctccccctccatgatttgcaagcagtggcccggggttctcccatggtatgagcaggttgcgttagggttataccactttagaaaaggaggttggtggatccttccgggagatatcacagccatctggttggcgacgaggggtggcaagaggtcttcgtatgtcattgggatcgggctggagcttgggggcctccctctggatgggcacgggatccctaggttgtacggcggcttgacctatgcaagcgttgaagtgatggcatgggtatctccttccttcctttttgccccagttgctctgatcctcctagctttggtacctgtgaaggagac

SEQ ID NO: 28456 - DNA, 483 bp, Glycine max
  Peptide Sequence Number=SeqID_120141
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggttcacctgaaaaggctagtaaggatgatgcattgaagaaaacccttcaagttagcaatcttagccctcttctcactgtggaacagctaaaacaactctttggattctgtggcactgggtaccgagctcgaattcgtaatcatgtcgggaaacctgtcgtgccagctgcattaatgaatcggccaacgcgcggggagaggcggtttgcgtattgggcgctcttccgcttcctcgctcactga

SEQ ID NO: 28457 - DNA, 618 bp, Glycine max
  Peptide Sequence Number=SeqID_120142
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccctgaacccggcccagcgcgaagccgtctccgctccccccggccaccacctggtgctggccggtgccggttccggcaagacccgcgtactcacccatcgcatcgcctgggatcctctagagtcgacctgcaggcatgcaagcttggcactggccgtcgtttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 28458 - DNA, 702 bp, Glycine max
  Peptide Sequence Number=SeqID_120143
atggattcagcaagaggtttggaccgcataaaacagactcgaaacggcatagcgggcctaccacggaagtacctagaagataaggcgaaggatatggcaagtcaaggggattgggtcacgtttatggatgtgttagcgttgctaatttttggggtcgtcctctttccaaacatagatggtttggtggacctagcagcaatcgatgctttccttgcataccaccatagcaaggaaagtccggtggtagctgtcttggcagatttatttgacacatttgaccgaaggtgcgaaaagagtagcgcacggatcatctgttgcttgcccactctctgtgtttggttggtttcacacctgttccagcaagacacgagacatccatgtccgctccagagccatcgctcgtgtactgaaaaaagaagaatagattgggaccagcttttggctgggataggaggtagaacaatcaattggttcccccgatggaaggaaggaaaagagggagtccttttctcatgtggagggtacccaaacattccgctaataggaacgaggggttgtattaactacaatcccgtgctcgctataagacaactagggtaccccatgaggtgggcgccgggggaagaaagcatgtctcctttccttgtgaggaatttcggcgcgcaaaatttcaaggctatacaaaaaatccataaggcatag

SEQ ID NO: 28459 - DNA, 699 bp, Glycine max
  Peptide Sequence Number=SeqID_120144
atgtatttatctcgtatccagcttcggttcaataatctacggccggagatgttgaaaaagtgggattcagcccgtccttatgctagccatcagtggctatggcagctctttccggagcaggaaacgcgccagtttctttttcgcgaagagccgcacggcggtttttttatgctttcagcgatacctccattgactcagcattcactgtttctcattgagaccaagccatttaatccgcaactgataaatggccttgagcttgattttcagttacgcgctaatccggtgattacccgtaatggcaaacgtagtgatgtgatgatgaatgcgaagtatcaggcaaaagagaatgatgtggcgcaagaacggtggtgggagcttcaacagcaggcggcgcagacctggctggaaaagcaagggcagcagcatggtttccgtttgcttgaaccggagcctgatgatttcgctcaatggactggtgcagaatacagtgaaatgcaggcgcattgtggatgtgtgcaagcgtaccagcagcatcgttttgtacgtaacgaccaggaaaagccgattgctttcagtagcgttgattttagcggaacgctctgtatcaccgatgcatcattgtttgaacaggcgctattttctggtctaggtaaagctcttggctgtgggatgctgatggtgaagaggaaacgctaa

SEQ ID NO: 28460 - DNA, 297 bp, Glycine max
  Peptide Sequence Number=SeqID_120145
gaaccgcgcaaacaatttcaccggtttatccccgctggcgcggggaacatccggataggatcaccaagttttgccgtattcgcgggtcggtttatccccgctggcgcggggaacatggaactgcgcctcatcgtatttgctgtacatccggtcgatgtatggtctggtacaggcggtttatccccgctggcgcggggaacatccgctatccgtgaagacatggctgactacatgcggtttatccccgctggcgcggggaacataaaaccgacagaatggcgaagccggccaggaacg

SEQ ID NO: 28461 - DNA, 505 bp, Glycine max
  Peptide Sequence Number=SeqID_120146
atgaggtcctgggtaaggggtcagtggatcccgtttgatgccgacgctatcggccagctcctggggatatccgttgggtgttggaagagggccaggagtgcgagtatggccagaggaggaaccggtctgatgggttcgatgaggaggccattgcccaattgctatatataccggggcaggattttgcctggactgctgccggaagacgggtgcggatcattgcgcaccaacatgaccaccttgacacagatatggatgactttgctgctcagcaacatcctgcccaccgatcataattccgacctccccctgccgaagtgtcagctggtgtacgccatcctgacacggatgagtgttcatgtggctcagttaatcgctgatgccatctatatttttgcagtccccgtggcacctaccaagttgattcggccgcccatcacccgggcttttattgagaagtactgtacccagagacaggctcagggtgatgctcctcagtccgcag

SEQ ID NO: 28462 - DNA, 252 bp, Glycine max
  Peptide Sequence Number=SeqID_120147
atgtcggcatctgatattatgcaagttgaaaattatagaaaagttggcattagacctccgcacatgtacgcagcatttgccaatcaatgtggtggatatgagaaggtcgggtttatcaggaaagatatttacaatgaagaagggcgcatgaggaagcaacatagttcagatgcaaggggtgcattgaagtatttatatgatttacgcaagaaagaaccaatgatgtatgtttcgtacactgcggatggatag

SEQ ID NO: 28463 - DNA, 210 bp, Glycine max
  Peptide Sequence Number=SeqID_120148
atgcatgctcagcgagcatgtctcactgagcgagagttagtgactgggcacttagtggatgttcacacgctaagcgtgagaagcaacaaaggcttcgctggtcgagctagctgcgtgctaagcacaatgctctctgactttacattctctagggttcttctcgcgctgggcgagctggctttcctcgctaagtgggttagtgtcgcttag

SEQ ID NO: 28464 - DNA, 465 bp, Glycine max
  Peptide Sequence Number=SeqID_120149
atggaactactgcttttaagagctggacttagggaggaggaaagtacaagcatagctaggttccttagtgggcttaatatggaagtgagggacaaggaccaagcccatggaattttgggggctgcacctttaaatcccattgaagacaagggtaagaccatagagaaatacacccctaagactagttcccaagaaaggactagcaacattaaatgcttcaaatgtcttgggagaggtcacattgcctctcaatgccccacaaagaaaaacatgatcatgaggggtcaagacatttatagtagtcaagagcagactacttcttgcccttcctctagtgaaagtgaagatgaagtaaggggtgaagagtctagtgaggaagtctacccccatgaagaagggcattggatagaagactccaagaagatttggccaaagatgcaagagaaggccctagggttctcatga

SEQ ID NO: 28465 - DNA, 279 bp, Glycine max
  Peptide Sequence Number=SeqID_120150
atggtgaatgtgattcaaaggtgttttgatcataacaatgatgacaaaggtgataaacaaaaagctcaaagatcaaagaacaaatcaagtgaatcaaagaacatctcaagtgaatcaagaacaagtcaagagttcaagaatcaagaagaattcaagactcaagaagaaagcctagaatcaagaatcaagaatcaagattcaaggtctcaagaatcaagatcaagattcaagactcaagattcaagaatgaagaaaatactcaatcaaaataagtattaa

SEQ ID NO: 28466 - DNA, 519 bp, Glycine max
  Peptide Sequence Number=SeqID_120151
atggatgatgatctacaaatagtttatggtatgaaatcaggtatcaagatgaactgggtactattgattgaagacattatgatgaagtgttgtcacttggtggattatgaattcccttatgttgtgcttgcctcaggattcattgactacttcaatgttgatatctctaatgaggttatgcactttaccaaagcctctagtgacattactaaaaggcatctcaagaatcttggaatgaggtttgttgatcatgaatggataatggttggagagcctgcagtaggaaacgttgacgagatgcaagaaaatgctgaagttgaagctccacaagagcttgcacatcaatggagtcctttcgagacccttatgattaagaagatggacgttatgcttcacctccatcaagagcactcagctaaagttcatagttccttggagaatataactacccaactagaagacattgagactaggttgacccttagcaacctccttagccatgatgaggatcaagcttag

SEQ ID NO: 28467 - DNA, 342 bp, Glycine max
  Peptide Sequence Number=SeqID_120152
atgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggcgtatcacgaggccctttcgtctcgcgcgtttcggtgatgacggtgaaacatctgacacatgcagctcccggagacgggtcacagcttgtctgtaagcggatgccgggagcagacaagcccgtcagggcgcgtcagcgggtgttggcgggtgtcggggctggcttaactatgcggcatcagagcagattgtactga

SEQ ID NO: 28468 - DNA, 243 bp, Glycine max
  Peptide Sequence Number=SeqID_120153
agtgaggttgggcaggttcatttgcggatgaggaagatgctactggttgaggtccttgacactgctttcctgacctcaatgattcgaccatccaaggttgggatgattcctccacccgggattgtacctgttgctggagagcataagcttcaggttgttcaattgcttcagattgttgcacagaagggcaaaggtttgtgtggtgctcgctcgcggagcataaaccacagagtctggcgatag

SEQ ID NO: 28469 - DNA, 120 bp, Glycine max
  Peptide Sequence Number=SeqID_120154
atggcacctttgatcccttgtggtactcatctggctgcccctttttggaatgggatttctcgcttggggaaggatgcagccgcagcggtggactgcgccaaagagaaaagacgtaacaag

SEQ ID NO: 28470 - DNA, 1127 bp, Glycine max
  Peptide Sequence Number=SeqID_120155
atggaacctctccacatgcaagccttccgcaagacgtacggaaagatcttagaattgaccctagcagaggtatccatagaagccattgcatcactcacccaatactacgaccagcctttgagatgcttcacgttcggagacttccaattggtaccaaccattgaagaatttgaggaaattctaggatgtcctctcgggggaagaaaaccatacctttccttcgggtgtctcccctctttgagcaaaattgcaactgtggtcaaggattcagcaagaggtttggaccgcataaaacagactcgaaacggcatagcgggcctaccacggaagtacctagaagacaaggcaagggatatggccaatcaaggggattgggtcccgtttatggatgtgttagctttgctaatttttggggtcgtcctctttccaaacatttatcttgacacatttaaccgaaggtgcgaaaagagtagcgcacggatcatctgtgcttaccgccctctgtgtttggttggtttcagcacttgttccagacaagacacgagacatccatgtccgctcctgagccatcgctcgtgtactgaaaagagaagaatagattgggaccagcttttggctgggataggaggtagacaatcagttggttcccccgatggaaggaagaaaaggaggagtccttttctcatgtggaggtacccaaacattccgctggtaggaacgaggggttgtattaactacaatcccgcgctcgctataagacaactagggtaccccatgaggggagctccgacggaagaaagcatgtctcctttccttgtgagggatctcggtgcacaaagttccaagaccatacaaagaatccataaggcatgggaaaccccgttaaggaaagatcaagagcttagaggcattcgtaatggcatcattggtgggtaccacgaatggctgaaagttcatatacgaggtttagattggctcaccaagttaaaagtcatcagcgaagagagttttgaagcaccggaagaggacgaagaagtccaagctctcaaaagcgagttaggaaaggcaaaacttgccaaggagaagttcaagttggccgctacacacgttcggaaggagtgtgccgg

SEQ ID NO: 28471 - DNA, 318 bp, Glycine max
  Peptide Sequence Number=SeqID_120156
atgagtcatcattcatctagtgttaatggtgagggtactagtcataaggaccctctatctagaatcttagatgagttaagttccctcaatagtcatgtcccttgcaagagcctaagtgaagaacttcgtgactattttgaaggaagtcattggtcacatcttagacctcactcccataggagagaaaaggaaagaaagcctcaagaggctaacattaacctctcgtacttccatgggaaggacaatgtagaggcttacttagattggaaaataagggtagagcaacaacttaaaaggaagtctacttcaaaatcttag

SEQ ID NO: 28472 - DNA, 339 bp, Glycine max
  Peptide Sequence Number=SeqID_120157
atgtctctctctacttctccttcgccttcgcgttgcccattatctatctccgcttctgctcctttttctatgttttactctgctcctacttcatcttctacttctatcgttgtccctatcccagctcaaaaccctagactcgaaagaaggcttttcttgagattgtcgtggatggattggagctgtgcttgcttctttgactcggaggaggctttgacgaatttggagaggaaggaagaggagggttttggaacatcatcctttgctgccgaagaggaaaagcggagacccagcttgaaccacgcagctctctcgcctttacaggtcaactcgtcgtag

SEQ ID NO: 28473 - DNA, 141 bp, Glycine max
  Peptide Sequence Number=SeqID_120158
atggccaaaatacaaggcctaaaagaaggaaaaacctattctaatatttacaaagaagagaggacccaaccttggtccatgggctcaaaactctaccctggggatttgtgctctcttagaattgaagcctttgaatcctag

SEQ ID NO: 28474 - DNA, 378 bp, Glycine max
  Peptide Sequence Number=SeqID_120159
atggcggcgcagctaatccgtgatcgagtagagatggagtgcctagagggagcttgggaaccctcgaaggcaacacgagatgaaccggcgcgtacgcttcagcgcactgtggagtggatactacccacgcctacaccatatcgtctagtggagccagtccaagtgatcgaggtaacgtcatccgaggaagacccagaggaggatctcgaggagctacctcccgagcctgctgtggatgctcttgactttctagagggtgatgaggacccacttcctgaggtggattctcccgaggaagtcatgtcggcatctgaggcagactctacggaggatagtggcccgagagagatggcgaccagtggaggctcttcatcatag

SEQ ID NO: 28475 - DNA, 756 bp, Glycine max
  Peptide Sequence Number=SeqID_120160
atggcattgggcatggccggacaggtatatgcggaagccgatcccaaattgtgggcagtggtcaaggaggcattttttcccaagcgtgagattcaggaggttgatttcctgaaaattgaagcgccgcgccgcgcggaaagtggtgcgcaagtgccggtgacgctgatttatgacaaggccgccgccaatggcgtggtgcttaaaaaactgtatgtgattgtggatgctaacccgattcaactggcgtctacctatcatctgaccgacatgctgaatggtttccagatggccacccgtatccgccaggaaacggattcttttgtccggttaattggtgaaacagccgatggcaagctgtatatgggcaaacgtgaaatccgtgccgccggcggctgtggtggtaccgtggataacaacgaagctgaagtacgggcagccgcaggcaagatcaagctgaatgtcgatgcgcctaaatttggtgagccagccacagccacgtttaatatccgtcacgttatgcgtacaggtttgcagcgcgacctggtctctcagggctatgtgcctgctttctatatcaataaaaccacttttacctataacggtaaagaagtgatgactgtagatgtgggtgtaggaaccagtgaggatccttacatgaagttcagctttattccagaggcccccggcaagctggaagtggtcgctactgataatgaaggcaaaacatttacacaaagcctggatgtccatagttga

SEQ ID NO: 28476 - DNA, 251 bp, Glycine max
  Peptide Sequence Number=SeqID_120161
gcccacttgggccctccagaatattcctccagaaggctgttgcttctggaggaagcaacctggctcgcctgggcgagctgggcggcaaccacctcccctattttgctataaataggggaggaagtgaagaagaaaaggccgaggcgcttccgaaacgtttccgtaacgttttccgtgaagaatttcgcaaaggtttcaaccgttcttcgacgttcttcattcgttcttcatcgttcttcgatcttcaacgg

SEQ ID NO: 28477 - DNA, 198 bp, Glycine max
  Peptide Sequence Number=SeqID_120162
atggggtgtaaatcaccaaaaaaagcagagggggtgtacttagtaaaatggggtgcaaatagcacccagggccacttgggccctccagaatatctccagaaggctgttgcttctggaggaagcaactggctcgctgggcgagctgagctcgctgggcgagctgggcggcaaccacctcccctattttgctataaatag

SEQ ID NO: 28478 - DNA, 216 bp, Glycine max
  Peptide Sequence Number=SeqID_120163
atgagttgtacaagttcgctaagcgcaccacttcatctttctaagtgcaccgcttcagttcatccgctaagtgagaaagggagtttggactgggattcagagctttgcttgtctagggtttctagagagagaaaggtccaagttccagagagttttgagagattttgctgtgtgaagatctacagagaccagagctttaagcaggagccagtttga

SEQ ID NO: 28479 - DNA, 639 bp, Glycine max
  Peptide Sequence Number=SeqID_120164
atgatcgaaagttttcaacaacaacaacaaatgtcagttctagaattgtacgtagaaaaggatgttgctggtagttctatatttcattctgcaaattctgttctatcatgtggacataatctatctcatcatgagtcgaaactgccaagaagtataagcaatttacatgataatgaagatgatgatcttgcgtctaactcatacattgaagagtctttgaatgaagatgatagtgttgatggaatatctgatacagacgatgaagtcaccaacatcattgaaccaatttcaattgttcacccaacagaaggtgtaccaggaattcaaaatccattttggaatgatgctttgcatcataacaatgtcaattggagtcatccggacgaggacatttgcggtttggacatgccaacgacttttaatgttggacaagaattatatgttcgcatggattttgacagtaaagatgcggtcaaaaatgcactgaaacaatatgtgatgaaggtgcatcaaagtttcaaggttgctgaaaccgaatcgcacaaatatatcgtttgttgccccaacaacagtgcagagtctccttgccctttttatatgagggcaatttatctaaaaaaacttatgcctggaaagtga

SEQ ID NO: 28480 - DNA, 648 bp, Glycine max
  Peptide Sequence Number=SeqID_120165
atgaccaccttgactcagatttggataacgttgctactcaacaacgtcctgcccaatgatcataactccgacctccctctgtcgaagtgtcagctggtgtatgccatcctgacacggatgagcgtccatgtggctcagttgatcgctgacgccatttatttatttttagtgttgatcacgggtctctgccagtcattcggggttctcgtcacacctagtaaagtgattcgactgccgatcacccgggccttcattgagaagtattgcacgcctagacaggcacaggctgatgcaccgcaggccgcagacgcaccgctgccacctcatcaggctgatccagctgggtcatttggcatggagcggtatttacagcacttggttcaccagcaggcggccaaccacaaggggcaggtgcagttacatgagtgtctctaccagctcagcctcagtcagcagagccagggtttcgctccttttgcgtgccctactccacatcaggtcagggctgaggttgcatggcccggagattggcctgaggcccaggcaggggaggcgcccgcagaggctcctgacgatgcagaggaggcccgcatggatgaggagatgacagatgtactcagtttgttgggagggagtggagccacatga

SEQ ID NO: 28481 - DNA, 2324 bp, Glycine max
  Peptide Sequence Number=SeqID_120166
atgaggggcactgtgcatgagcctcaggcgcacctaggggcaggtcaaaagttctcacccgtcgatggtggaccattgggtactagtacccttgccttgagagggttgcacacccttgccttcagagggctacacgaccttaccttcagagagctacatgccctcgccttcagaggactacacgacctcgctttcagagggctacacgccctcgccttcagaggattacatgtcctcgcctttagagggctacacgccctcacctacagaggactacacgtcctcgccttcagaggactacacatcctcgacttcaaaggactacacgtcctgcattcagagagctacacaggactacacgtcctcgccgtcagagggctgcacgccttcgccttcagagggctacatgccctcgccttcagaggactacatgtcctcgccttcagagggctacatgcctgcaccttcaaaggcctaaacaccctcgccttcagagggctacacgtcctcaccttcagaggactacacgcccttgccttcagaggactaaacgtcctcgccttcagagggctgcacgtcctggctttcagagggctccacatttgcgcctttagagaactcaagttcctgggccacccctctgatcttcgaggagggccaactgtgggagcacaactgaaggaggaggcagggaacgcgcctgcaagacacccagtggactcggagaagtccaacagggtccaggggtttccagctttgattatgaacctccgtcagttctacggagtgcctgtcacccccagcagggtcatcaggcccctattaacaaggctttcattgagaagtattgtgcccccaggtaggcgtagggcgaggcatcacagtagcgggcaacagatgcactgccaccacctcagctcatctacaaaagctggagtgttgcctacgacatgtggccgaccagtaggcgaccaagtccaaagacaaagagacggcaagtccaatgacatgcggagataccttatggttatccacactttttgtcagctagaggcaagtgagtccgttgacacgaagagactaacgtcattatcaccacctttcttggagatgtcagcgtcttatggccgacactgcgaaaatgtcttctttgctatccatcagactcaaggagacggcaagtccgatgacatgcggaaataccttatggttatccgcaccttttgtcagctagaggcaagcgagcccgttgacatgcggagactaacatcgtcatctgcacctttcccagagatgtcagcgtcttctggccgagattgcgaaaaagtctcattggctatccatcagactcaaggagatagcaagtccgatgacatgtggagataccttattgttatccccaccatttgtcagctagaggcaagcgagcccgttgacacgcagagactaacatcgtcatttgcatcgatcccagagatgtcagcatcttcctgcccagactgtgaaagagtctcgtttgctatccgtcagactcaaggagatagcaagtccaatgacatgcggggataccttatggttatccataccttttttcagctagaggcaagcgagcccgttgatacgcagagactaacgtcgtcatctgcacatttcccggagatgtcaacatcttccggccgagactgcgaaaaagtctcgttggctatccatcaaactcaagggtccggttgcatgcagacactaacgtcgtcatctgcacctttgtcatccagagatggcaagtccgatgacatgcggagataccttatggttatctgcaccttctgtcagctagaggcaagcgagcctattgacacacagagactaacattcgagctcgttgacacgcagagaccaacatcgtcatctgcacctttcctggagatgtcagcgtcttccggccaagactgcaaaaaagtcacattggctatccgtcagaatcaaggagacaacaagtccgatgacatgcggagataccttatggctatccgcaccctttttcagctagaggcaagcgagtccgttgacatgcagagaccaacgtcgtcatctgcatctttcccggagatgtcaacatcttccgaccgagactacaaaaaagtcttgtatgctatccgtcaaactcaaggaaaagtctcatttgctatccgtcagactcaaggagacggcaagtccgatgacatgtggagataccttatggttatccgcaccttttttcagctagaggcaagcgagccccttgacatgcagagactaacatcgtcatctgcacctttctcagagat

SEQ ID NO: 28482 - DNA, 471 bp, Glycine max
  Peptide Sequence Number=SeqID_120167
atggctcagagcttaaacattctaatttcgagcgtctcgatatattacgggactgaatcagacatccgagtaaaaagttattgtcgtttgaaatcgctcagagagcttcggtcattcaatttcgagcgtctcgatatattcgggcctcaatcagacatccgagtaaaaagttattgtcgtttgaattggctcagagcttcgacattcaatttcgagcgtctcgatatattacgggcctcaatcagacaactgagtaaaaagttattgtcgtttgaattggctcagagattcaaaacattcaatttcgagcgtctcgatatattacgagactatatcagacatccgagtaaaagttattgtcgtttgaattttctcgagaggttcaacatttcgagcgtctcgatatattacgggcctcaatcagacatccgaatacaaagatattgtcgtttgaattggctcagagcttaa

SEQ ID NO: 28483 - DNA, 958 bp, Glycine max
  Peptide Sequence Number=SeqID_120168
gggttgtattaactacaatcccgcgctcgctataagacaactagggtaccgcatgaggggagcaccgatggaagaaagcatgtctcctttccttgtgagagatttcggcacgcaaaatttcaaggctatacaaaggatccataaagtgtgggaaaccccgttaagaaaagataaagaacttaggggcattcataatggcattattggtggttatcatgaatggctgaaagttcatacacgaggtttagattggctcgccaagttaaaggttgtcagcgaagagagtttcgaagcaccgaaaggggacgaagaagtccaagctctcaaaaacgagttaggaaaggcgagacttgccaaggagaagttcaagttagccgctacagatatccggaaagagtgtgccggattacgagaagagaatgtaactgccgcaagagcccttgaacaagagaccaagagggctcgcaaggaagagtatggtcgtaacaaatttcgcggagctttgtggggtagcaacagtgaactcaagctgcgaagggaagaaagagaccagtcgcgagcacatggcatggtcttgaaagaagagttagttgcctgttcaaggtccaaaagaaacttgtctcagcgtttgtgcgagacggagaccaacatgctagctatcatcgccaagtaccaagaagagctaagtctagccacggcccatgagcatagggtcgcggacgagtatgcccaagtatacgcggaaaaagaggctagaggaagggtgatcgactcgttacaccaagaggcatccatgtgggatggaccgatttgctcttaccttgaacgggagtcaagaacttccccgattgctagccaaggccaaagcaatggcggacacctactccgcccccgaggagatccacggacttctcgactattgccagcacatgatagatttaatgacccatataattag

SEQ ID NO: 28484 - DNA, 495 bp, Glycine max
  Peptide Sequence Number=SeqID_120169
atggctgaaccatcatccgatgttgctactgcaagtgcaacgagaaaaaataagacagatccagactggaaatattgtcattcactggtggaaggagatacaaacaccattgtttgtaatttctgtgaaaaaatcacaaaggtaggaatattcagagtcaaacaacacctgattggaaagtcaggcaacgttgcagcttgcaagaaaactccaccaaatgtagtcgaagagttgaagaaatatatggctaccaaaaaaagtgggaccacttacaatacttctggcagtgaagatgagtttgtggactcttgtaatgctgctgcaagtgcaaagacaaagtgtgggactaaaaaaggaccaatggacaaattttgtaagaatccagaaaatgcaatcaatcggagaaaaatggagatgttgaggcaaatgaacataagagagtcaatggataagaatgaagtattgaaggtgcatcaaaatattgctcgcttttga

SEQ ID NO: 28485 - DNA, 228 bp, Glycine max
  Peptide Sequence Number=SeqID_120170
atgaagaaacaacaatggaagagaagatgcagcggaagacaaaggagaagaggagagaggaggcgccatccactagggaataagccttggaagaaggagtttcaccaccaagatgagccttggataaagaagcttggagaggatgcttcaatggaggaaaagaaagagggagagaaagagagaggggggagcacgaaattgaaggacgaaaaagggagagaagtttga

SEQ ID NO: 28486 - DNA, 424 bp, Glycine max
  Peptide Sequence Number=SeqID_120171
atggcgaggattcctgacaagattaggtctattgatggatcaaaagaaacgcttaagcttgctgttaggatcatcgatctttggttcgttgggactcctaacaagtctgagcaagcggaaatggtttttgttgattctgagtttgcatgtttcagggtgatcaaattcatgctatttgtcccatcggaccacctcaagtcttggaaagctgatttgaaagagaattgcacttatgttatgcataatttcaaagttgttaagaatgatggtcaatttagagtgtgcgaacatgagtacaagttattttttattggagtgacggttgttagagaagctgatttgcaagaactttcttttaaggaatttagatttgttgcatttgcaaatcttgttgctggcaattttgtgtctggcctgttggttg

SEQ ID NO: 28487 - DNA, 203 bp, Glycine max
  Peptide Sequence Number=SeqID_120172
atggacgaatacgcaagcatacgtttcatgcttgttctggggatatcgaaaattcgagtggctgaagctgaagcagctactttcgaagtaacagaaagaaaagcaacgactggagtgggagagtcagagtcgaaaagaggcttcctcacttctttctctcattcaaaaccgtgcatgagactttcatctcgcacggctcctaa

SEQ ID NO: 28488 - DNA, 291 bp, Glycine max
  Peptide Sequence Number=SeqID_120173
atgtggataattgatagtggtgctacattgcatgttacagccaggaaggagttcttcacattttacgctccaggtgatcttggagtcttgaagatgggtaatgatggcgtgtccgaggtacttgaagatgcttgttatgataaccactttggctctagaaagtggaaactcaccgagggtaacttggttgtcactaaaggggagaaaatttcaaagttgtattggatgaaagctttgtttgctagagactatgtgaatgctatggatatggaggcatctttatggcactga

SEQ ID NO: 28489 - DNA, 377 bp, Glycine max
  Peptide Sequence Number=SeqID_120174
ggtggacccttgggtactcgtacctatcaccttgagaggactacatgtcctcgccatcagaggactgcatgtcctcaacttcagagggctacgcgccctcgccatcagaggactacacgtcctcgccttgagagggctacacgccctcaccttgggactacacgtcctcaccatcagagggctgcacgccctcacctccagaggactacatgtcctcgccttgagagggctacacgccctcaccttggagggctacacgccctcaccttgggtactagttaccctcaccgttgagaggactacacgtcctcgccttgagaggactacacgtcctcaccatcagagggctagaacgccttcactccagaggactacat

SEQ ID NO: 28490 - DNA, 667 bp, Glycine max
  Peptide Sequence Number=SeqID_120175
atgttggtgcgcatgatccgcactcgtctctttgcaacggcacaggtgaaatcttgccccggtatgcatagtagctgtgtgacagcctccctctctggttgtgctcgcacagttggccctcctccaatatcagggggtggcccaagaaccgttaaagggaaactactggtgtggatatggagcccactgaaagtgaggacgcatagtcctctaaaggcgagggcgtgtagccctctgaagttcaagacgtgtcgcctttcgaaggcgagggagtgtagtcctatgatggcaaggacgtgcaatcctctaaaggtgagggcgtgtagccctacaaaggtgaaggcacatgaccctttgacggcagggacgtgtagtcctctgaagttgaaggtacatgaccctttgaaggcgaggacttgtagtcctctgaaggtgaaggcgaggacttatagtcctctggaggtgagggcgtgcagccctctggtggtgaggacgtgtagtcctctcaaggcgaggacgtgtagtcctctgacggtgagggtgagggcgtgcagccctctcaaggcgaggacatgtagtcctctggaggtgagggcgtgcagccctctgatggtgaggacgtgtagtcctctcaaggggaggacgtgtagttctctcaacggtgagg

SEQ ID NO: 28491 - DNA, 794 bp, Glycine max
  Peptide Sequence Number=SeqID_120176
atggtcaatccgcacacccccttggccattcagacacagtcgtgtccgatggcacgcagagacaaattatggtcattctgcacccttttgtcatctagaggcggtgggcccgatgacatgcggagacaaattatggtcattacgcacatccttttgccattcagacacagtcgtgtccgatggcacgcagagacaaattatggtcattctgcgcccctttatcatccagaggtggctggtccgatgacatgcggagacaaattatggtcattccgcacaccccttttgccattcagacacagtcgtgtccagatggcacgcagagacaaattatggtcattctgcacccttttgtcatccagaggcggcgggctcgatgacatgcggagaaaaattatggtcattccgcacaccccttttgccattcagacacagttgtgtccgatggcacgcagagacaaattatggtcattctgcgcccttttatcatccagaggtggcgggtccgatgacatgcggagacaaattatggtcattccgcacaccccttttgccattcagacacagtcgtgtccgatggcacgcagagacaaattatggtcattctgcacccttttgtcatccagaggtggcgggcccgatgacatgcggagacaaattatggtcattccgcacaccccttttgccattcaggcacagtcgtgtccgatggcacgcagagacaaattatggtcattctgcgcccttcttatcatccagaggcggcggccgatgacatgcggagacaaattatg

SEQ ID NO: 28492 - DNA, 441 bp, Glycine max
  Peptide Sequence Number=SeqID_120177
atgggtaaagcagaggaggtgcaagagcagatgaaggccgacatggaggtcatgaaagagcaaatggctacaatggtggaggccatgatgagcatgaggaagataatggaagccaatgcggttgcaattgctgctaccagtgctgttgctaaggtgaacccggtacccccatatgatctcaaccaaatgagtcatccaacctcagatatggtgggcaaagatttgggaagtacggacgaccccatgatgtgcaaattcaaaacgagtatgccttcccgccatatggcttgcctcccaactatacaccacccaatgtggcatacactcccaatgaggatgttaataactccgctcccatactcattgagagccgacaacctcatcatgtacatgtctctcaacccatgggggagatacatgaaattccccaccacaatctag

SEQ ID NO: 28493 - DNA, 427 bp, Glycine max
  Peptide Sequence Number=SeqID_120178
actagcccgtcagggcgcgtcagcggttgttgccggctgtcggtgctggcttaactatgcggcatcagagcagattgtcctggcgatcggtgcgggcctctttgatattacgccagctggcgaaaggggtatgtgctgcaaggcgattaagttggccccacgccagggttttcccagtcacgacgttgaatggttcaaggtagtctcaactaaccgggatcaggacttggttagtaagaagcgtgtcatcaatgatattttatctgaggatgataatggctgtgaggatagaaataattcaaatgatgcccctggatgtgcaagtgcaatgaatgatatcgctgatcaggaggttgtggatcacggcattgcaagaaatggcaaactgtttgagagtgctggaggggtaccgagctcgaattcgtaa

SEQ ID NO: 28494 - DNA, 258 bp, Glycine max
  Peptide Sequence Number=SeqID_120179
atgtcacaggctgagccgattaatgtaaacattggaaatcctatagaagaaatgatttgcgatcttgggcaagaggggtttgaacaggcacatgcacccttagatgagtttgccgaaatgcattgttaccctatttgcggggtatcacggtacagagtgaacgacggggaatacagtgttgatgcaaccgcaaacaaccgacgtctagcaaagcgaaagtacataatgttgagtatgatgatagctggtccaagatag

SEQ ID NO: 28495 - DNA, 277 bp, Glycine max
  Peptide Sequence Number=SeqID_120180
ggacggtgcctacgagacaccctatggacccagagaggtccaatggggccctggggttcctagctttgatcacgggcctctgccagatctacggagtgcccgtcgccgccagcaaggtcattcggcctcccattaccaaagccttcatcgagaagtattgcatccccaggcaagtgcaggactaggcaccgcagcagcccgaggaggatcagcagccagcggcaaatgcgccactgccgccacgagaggaggcatcgtctttgagatccctctctga

SEQ ID NO: 28496 - DNA, 246 bp, Glycine max
  Peptide Sequence Number=SeqID_120181
atgggaggtagaactgtagctagagatttagctcctatcaacttggaaattgaagccacttgcaggcgtaacaacgcggcaagaaaaagaagggaaaaggaagcacaaggatgcagtcaaacctcacctcctcccactccacaaagctacattcaaatggaagagaaacatgcacgacaaatgacgctaggggactactctagtacagcaactccacaattcttcacaagcattgcaaggccggag

SEQ ID NO: 28497 - DNA, 625 bp, Glycine max
  Peptide Sequence Number=SeqID_120182
atgttggtgcgcatgatccgcactcgtctctttgcagcggcacgggtgaaatcttgccccggtatgcatagtagctgtgtgatagcctccctctctggttgtgctcgcacagttggccgtcctccaatatcagggggtggcccaggaaccgtgcggatgtggagcacactgaaaatgaggacacatagccctctaaaagcgagggcgtgtagccctctgaagttcaggacgtgtcgcctttcgaaggcgagggagtgtagtcctatgatggcaaggacgtgcaatcctctaaaggtgaggacgtgtagtcctctaaaggtgagggcgtgtagccctacaaaggtgaaggcacatgaccctttgacggcgaggacgtgtagtcctctgaagttgaaggtacatgaccctttgaaggcgaggacgtgtagtcctctgaaggtgaaggcgaggacttatagtcttctggaggtgagggcgtgcagccctctggtggtgaggacgtgtagtcctctcaaggcgaggacgtgtagtcctctgacggtgagggtaagggcgtgcagccctctgatggtgaggacgtgtagtcctctcaaagcgaggacgtgtagtcctctcaacggtgagg

SEQ ID NO: 28498 - DNA, 231 bp, Glycine max
  Peptide Sequence Number=SeqID_120183
atgtcagtgaaaaaccaccctgggcgcttaggagtacataacaagacacaccacacaatgggtttgtcaggcttaaaggagcactcaaacccggtgacccccaaggcctacactccgaagagtccgtcagggcctctccctcctgatttaggtccaacccctaaaataattttgcatgcagacactgctcatgaattatacaatacccacgacctcacactcgtgttttaa

SEQ ID NO: 28499 - DNA, 1231 bp, Glycine max
  misc_feature (52)..(52): n is a, c, g, or t
  Peptide Sequence Number=SeqID_120184
atggctgaagatcttttgaagaaaccaaggaaaggtaggactttagaagagnttggtcatgagtattttgatgatttggtttcgagatcatttttccaacgttcaaacacaagtagaagtagttggccttatggcaaatgttttgtgatgcatgacctcatgcatgatctagccacatcactcggtggagatttttactttagatcagaagaacttgggaaagaaacaaagatcaacaccaagactcgtcatttgtcatttgccaaattcaattcttcagtcttggacaactttgatgttgttggtagagcaaaatttctgagaactttcttgtccattataaattttgaagctgctccattcaacaatgaggaggcacaatgtatcataatgtcgaagcttataaagctgactaagttgcctagtgacatgtgcaatcttgttaacttgcgtcatcttgagatacttggaactcctataaaagagatgccgagaggaatgagtaaattaaatcatttacaacatctggatttctttgctgtgggcaagcacgaagagaatggaatcaaagaattgggagcactttcaaatcttcgtggtcaacttgaaattaggaacttggagaatgtttcccaaagtgatgaagcgttggaggcaaggatgatggataaaaaacacattaatagtttacagttggaatggtctggatgtaacaacaacagtaccaacttccaacttgaaatagatgtgctttgcaagttacagcctcactttaacattgaatcgttgtatataaaaggctataaaggaaccagatttccagattggatgggaaattcttcctactgcaatatgatgagtctaaaattgcgtgattgtgacaactgtagtatgcttccttcacttggacaactaccttctctcaaggtccttaagattgcacgattgaataggctgaagactattgatgcaggtttttacaagaacgaagattgtcgttctgggacgccctttccctcccttgaatctctggccattcatcacatgccttgttgggaggtgtggagttccttcgattcagaagcttttcctgtgcttgaaattcttgaaatacgtgactgccccaaactagagggaagtttgccgaatcaccttcctgctctgaaacacttacaattagaaattgtgagctgcttggctcttctctcccaaaaagctcccgcgattcaaa

SEQ ID NO: 28500 - DNA, 222 bp, Glycine max
  Peptide Sequence Number=SeqID_120185
atgaaggcgagggcgtgcagccctctgaaggtgaggacgtgtagtcctctgaaggtaaagacgtgtagtcctctgaaagagaggacgtgtagtcctttgaaggccaggacgtgtagccctctgaagaaagactatgatagttcatgcaaccttatcctatcttttgcaaatctctccaagaactccctaagagtgtatgttctatttgatttagtcacttga

SEQ ID NO: 28501 - DNA, 114 bp, Glycine max
  Peptide Sequence Number=SeqID_120186
atgcctagggcacataaatccacaacacaccatagtgcctatttcgggaaaagagctctggagacaggaagaggagtagcttttgcagggatacctaggttttggatcctctag

SEQ ID NO: 28502 - DNA, 330 bp, Glycine max
  Peptide Sequence Number=SeqID_120187
ggatcgcgcccgcaagacacccagtggacccggagaagtcaacatggtcctgaggtttctagctctgattacgagcctctgtcagttctacggagtgcctgtcgcccccagcaaggtcatcagacccatactaaccgagctttcatcaagatgtactgcgcccccaggcaggcgcagggcgaggcaccacagcagcctggggatggccggcagcgggcagcagacgcactgccgccacctccaaagcccctcagctcatctacaaaagctggagcgttgcctacaacccgtggtcgacctgcaggcgaccaagtccaaagccaaaggtag

SEQ ID NO: 28503 - DNA, 696 bp, Glycine max
  Peptide Sequence Number=SeqID_120188
atgaggcaccatgtcaagagcctagaactagccagcttgcaaaggctagggcaatggattgatcaagttcaatgtcaagccttccgcaaggcatattggaaaatctgggatttggccatgatagaagtttctgtagaagccatcgcatcccttgctcagtactacgaccagttgatcagatgcttcacatttggggactttcagttggtaccaaccatagaagagtttgaagggatcttgggatgcccgctgggaagaaggaagccgtatctatttttcggattctacccctccatggaaatagtagcaaaagtggtcaagatctcggcacaagagttagaccgactgaagcaaaaaatgagtggagtggtagggataccaaggcagcacttggaggaaaaggccaaatctttggcagatcaagaagagtggacttcattcatggatatattagcgcttctggtatttgggattgtactccttccaaatgtagatgggctagtagatttagcagcgattgatacttttcttgcttatcaccacaacaaggaaagcccggtcattgctattttggctaatgcctatgacacatttgacctgagatgccaaaagagcagtgtagacctgtttgtcccctacaaggtcatcgcatgtgtgccgaaaagggaaaagcaaattgggaggaactcttggcag

SEQ ID NO: 28504 - DNA, 237 bp, Glycine max
  Peptide Sequence Number=SeqID_120189
atggaagagactctagctcagttcatgcaggtttctatgtccaaccagaagagcacaaagtctgccataaagaatctggaggtccaagtgggacagcttgcaaaaagcagaatggaaatccatgtggatgagagtgaagctgagaagaagatagaggaacataaacaacagctggcaccaaagccagcacttgaatccgtttctgattttgtagaacttgaagatattaatgagtag

SEQ ID NO: 28505 - DNA, 234 bp, Glycine max
  Peptide Sequence Number=SeqID_120190
atgaggattccttttttacaggccaaggttcaaaaaggtctaaggttgtgtttcaatggggtcttttatcctgggaaccccaatcttgatatctggggcgaaacaaatttgggtgtcaagtcatggctacaccaagtgggccctcaagcatcccgtttatggcattgtgatactacggttgggaattacacagacccaacgtttcccaattatgttcttttatcagctcaatga

SEQ ID NO: 28506 - DNA, 500 bp, Glycine max
  Peptide Sequence Number=SeqID_120191
aacatggctaagaaggaaagtgagaccctttaaagagtacgttgagcggtggagagaccctggcagcacaagtggcccctttcatggtcgaaagggagatgattaccatgatggctacatgccttccagcttcgcggacttggtattcgccggggaaagaatcgaagtagggttgaagagagggaagttcgattacgtctcctccacaagtaccaatgctaggaggatcggagcaactggggcaaaaaggaaggaaggagatactcatgccgtcacttcggcacccgttatgggtcaagccaccgtagacctctcatggtacccatcaggaggccccccaagctccagctccaaccacgactcgcccggccagcaatgcccactatggtgccagttccaacgcgatgaggaactttcccccgaggccaattccagaattcaccctgatcccaatgacttacgaagacctcttgccgtccctcatcgccaaccagatggcc

SEQ ID NO: 28507 - DNA, 411 bp, Glycine max
  Peptide Sequence Number=SeqID_120192
atggacagagccaggttggtttatggcttggtaacccatatggatatgaacatcgacgccctaatctcaggtcaaatctcttctattgctcagagtaactcctttaggctcagatttccagccttgatcactgccctttgcagagctagaggagttacctctgacactctgacttatgagagcctgagcccgaccattaacttggcctacattaagaaaaattgttggaatatggatgatctgatagttaactttagaggggcaaggaaggcaagggctcgaccaactgatgttccttcttcttctactccaccagccccttccacttttgctactcctacaccaacttctccaggcccatctgcccaggactctcaacgctttgagtccatgcttcagagtctttattag

SEQ ID NO: 28508 - DNA, 628 bp, Glycine max
  Peptide Sequence Number=SeqID_120193
atgccatatgtggaagccgcggaggagtcattagaaatgaccttccagtcttttgaggtggttagcattgcctctgtagattccttctttgggcaaccttgcctatctgatgcggcaataatgatggcccgagtgatgttggggaatggttacgagcccggaatgggtttaggcaaggacaacggcggcataaccagcctgataagcgctaaaggaaaccgcgggaagtttgggttaggctataaacccacacaagcggacataaagaaaggcattacaggaaggaagagcagaggtcaaggctcgcaattgggacaagaagtcaaaagaggcccgccctgccacatcagtgggagctttataagcgcgggactaggacacgaaggccaagtcgttgcgatatgtgaagatgattcaccatgtgggtcggaatccgacgacgagtccctcgaaggtactaatacctgggacccgaccatcgatttcgagcaagaaacgaatcaaacggaggatgaagagaacaaggatgtgggacttcccccggagtcggataagatagtcgcccatgaggaccaagagatgtggcctcataaaaaagagacagaactagtgaacttaggaaccgaca

SEQ ID NO: 28509 - DNA, 543 bp, Glycine max
  Peptide Sequence Number=SeqID_120194
atggccccgaggaaacttgcctcaaagagatccaggaaagataaattggccgaaggaaccagttccgctcccgagtatgacagtcaccgcgttaggagcgctgaacaccagcagcgcttcgaggccatcaagggatggtcatttctccaggagcgacgcgcccagctcagggacgatgagtataccgatttccaggaggagatagtttgccggcggtgggcatcactggttacccccatggccaagttcgatccagacatagtcctcgaattttatgccaatgcttggcctacagaggagggcgtgagagatatgaggtcctgggtgaggggtcagtggatctcgtttgatgcagatgctatcagccagttcctgggataccctttagtgctggaagagggtcaggagtgcgagtatggccagaggaggaaccggtccgatgggttcaatgaggaggccatcgcccatttgctatgtatactgggccagattttgcccggactgctgccgggagacgggtgcggatcatgcgcaccaacatga

SEQ ID NO: 28510 - DNA, 468 bp, Glycine max
  Peptide Sequence Number=SeqID_120195
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatccccattgctgattttggccttgcaaagattcttcagggaggagcaggcaattggaccaatgtcattgctggaacagttggatacatgcctcctgtcgggaaacctgtcgtgccagctgcattaatgaatcggccaacgcgcggggagaggcggtttgcgtattgggcgctcttccgcttcctcgctcactga

SEQ ID NO: 28511 - DNA, 732 bp, Glycine max
  Peptide Sequence Number=SeqID_120196
atgaggggcatcgtgcatgagcctcagggtgaacccttgggtactagtaccctcacctctagaggactgcatgtcctcgctattagaggactgcatgttctcaccttcgtagggctacacgccctcaccttcagaggaccacacatcctcaccttcagagggctacacgccctcgccatcagaggactgcatgtcctcaccttcagagggctacacgccctcgccatcagaggactgcatgtcctcaccttcagagggctacacgcccttgccatcagaggattgcatgtcctcaccttcgtagggctacatgccctcacctttagaggactacacgtcctcgccaacagagggctgcacgccctcaccttgagaggactacacgccctcgccatcagaggattgcatgtcctcaccttcgtagggctacatgccctcacctttagaggactacacgtcctcgccaacagagggctgcacgccctcaccttgagaggactacatgccctcgccatcagaggattgcatgtcctcaccttcgtacggctacatgccctcacctttagaggactacacgtcctcgccaacagagggctgcacgccctcagcttgagaggactacacgtcctcgccaacagagggctgcacgccctcaccttgagaggactacacgccctcacctccagaggactacacaccctcgccttgagagggctgcacgccctcaacttt

SEQ ID NO: 28512 - DNA, 147 bp, Glycine max
  Peptide Sequence Number=SeqID_120197
atggtggttgcgcatcgtgattggtttttgagtagtaagccttctggtaatcgattacaagctgctgtaatcgattacaggctatctgttcttgtgcaatcgattacacttaatggtaatcgattaccagaacacaaactaggctag

SEQ ID NO: 28513 - DNA, 216 bp, Glycine max
  Peptide Sequence Number=SeqID_120198
atgacccctactcatgatgccctgcggtattacaatgggaggtggaacatgccatgccaaaatgactttgttgattactcgttcacaagaaaaaatctcaaaaagtttgacattccttccggatgttccatggatgaactgaaagatttgatcaagcaagttgcacctcatgggattcctccttatggtattcatgaaacacaaatgctaatgtaa

SEQ ID NO: 28514 - DNA, 564 bp, Glycine max
  Peptide Sequence Number=SeqID_120199
atggccccgaggaagcttgtctcaaagagatccaggaaggataaagtggctaaaggaaccagttccgcccccgaatatgacagccaccgttttaggagcgctgagcaccagcagtgcttcgaggccatcaaagaatggtcatttctccgggagcgacgcgtccagctcagagacgacgagtatatcgacttccaggaggagatagttcgccggcagtgggcatcactggttacccccatggccaagttcgacccagacatagtcctcgaattttatgccaatgcttggcctacagaggagggcgtgcgagatatgcgatcctgggtgaggggtaagtggatcccgttcgatgcggatgctctcagccagttcctgggataccctttagtgctggaggagggccaggaatgcgagtatagccagaggaggaaccggtccgatgggtttgatgaggaggccatcgcccagttgctatgtataccggggcaggattttgcccggactgctgctgggagacaggtgcggatcatgcgcaccaacatgaccaccctgactcagatctag

SEQ ID NO: 28515 - DNA, 192 bp, Glycine max
  Peptide Sequence Number=SeqID_120200
atggaagtgcttcttagtccaatagctcttaaggtggttggccccttacttctggactcaaattcttcaagggatggcaccaatcctcctttcaattcctatatggcaacccacaaacaaggaaacaaagagacaagcgataaccaaagaccaaaaaaactaaatatgaaagctaaaccaatggagttttaa

SEQ ID NO: 28516 - DNA, 318 bp, Glycine max
  Peptide Sequence Number=SeqID_120201
atgaggacacgtagccctctaaaggtgagggcgtgcagccctctcaaggcgaggatgtgtagtcctttggaggtgagggcgtgcagccctctgttggcgaggatgtccctttgttggcgaggacgtgtagtcctctcaaggcgaggacatgtagtcctctggaggaaatgccgccctttgttggcgaggacgtgtagtcctctcaaggcgaggacatgtagtcctctggaggtgagggcgtgcaaccttctgatggtgaggacgtgtagtcctctcaaggcgaggacgtgtagtcctctcaacggtgagggtaactag

SEQ ID NO: 28517 - DNA, 657 bp, Glycine max
  Peptide Sequence Number=SeqID_120202
atgtacaaagataattggacccaaccttggcccatgggctcagaaatctaccctaaggttcatgagaaccctagggccttcttcaacagctctagcccaatcttcttggagcctcttgctcatggttctagtgattggtcccttcctagggaggattgcatcaaaggttttccaagcggaccccatgacgcatcagttctcagagattttgaaaatcacattgctttgagagtctggaatggagaggaacgtcctgagctgaagctatcctcccatggaaggaagatggttaagtttgggaggcctgctctagagattgaaggccttgtggcggccagtggactatgtcctttgatcacctgttccctggatacgaacgatcgggaactaatgtctgcttttgtggaatgctggcttaaggaaactagaagtttccattttcccgtcggagaggtgactatcaccttggatgacatcacgccgttgctacatctgcctattgtaggggcgttacacagcttcgagctacttcatgtcgacgacgctgtcgatatgttggtggaactactcgaggtcagtgctgcaaaggcgagagctgagatgattcagtgtcatggctcttatgttcgactatcgtggctacgcgatgtgtattag

SEQ ID NO: 28518 - DNA, 225 bp, Glycine max
  misc_feature (187)..(187): n is a, c, g, or t
  Peptide Sequence Number=SeqID_120203
acacttgttagcattgccacatctcttaggcttgagtttattcctcaagtaaaggagttgttggatgagggtttggttcgcaagagattaaatccttgtgctttgttggtgttgaggaaaaaagcccagagtttcaagaaccttgggatttcaggtcaaatccttttcaaggggcagggaatgatgncatcctaccctgcaagggcattggatagaacactccaa

SEQ ID NO: 28519 - DNA, 1242 bp, Glycine max
  Peptide Sequence Number=SeqID_120204
atgccagctaactacgtggacctcgtcttcgccggagaaagaattgagtccggattgagaaaaggcaagtttgagtatgcctccaatgcggcccccaacaacaatagaagagccccagtggtgggagcgaggaaaaaggaaggagatacctacgcggtcaccaccggcccaacatggatgaaagcaccccaaaatatccaaagctcataccagcccaaccccccgaacttttcaatccgagccgggagttccctcccaactcaagtagaaggagcacctgcagcagaaagaacaccggcccaacacacagctccagccactccccggccagtcaataatacagctcctgacacgagctataataatgcacgatgcccacccccgaaagatgatttctctcttattcccatggcgtactccgagttgtggccttcattattggagaatcatttggtggtggccatacccgcgaaggtcttccagccaccataccccaagtggtacaacccggaggccaagagggccctaacgttaaaactaaccccactagccagtcatggaggggctagcataaacgccatcggaaagaggatgggccatcacgggcaaagagattggaagatgtggctacatctaggcgttcatctaccagtcgctgcaagcggcatgcatggtctctctgtggttcttcccgcggtggaagaattgcttcagcggctcaaggactgggggcagctcgaagtgtccaaaggagggagggaagaaccacagatttgcatgcagtcagaagagaagaaggttcccccaacccccaaagccctagtaatatgtttcactaggaaagggaccggctccacgcccatatacccctggacagcgcccaagccgatttcgattgcatatcaaagcaataaggtcgttccgtggaagtatacccctcccgcttttggagaaagagttgcaaccgaagttgactccttgtcagccaaggtgaccaacatcaccggcctcagtggtgtaacccgtagtggccgggtgttcgctccccctcactcggcggaattgccctccaaggggaaggcacccatgatccaagagcccgcagacgtagccaccccctcaaaagaagtggatcctccggtggaaagaggggctgaaaagaaaaaaggtcttcaaggaaagacggtgactttggaagaggctcatgagttccttcgtctcatccaacaaagcgagtttaag

SEQ ID NO: 28520 - DNA, 576 bp, Glycine max
  Peptide Sequence Number=SeqID_120205
atggcccgcaccaagaagacaggggagatgacgactgaggccgcaaagaaaatcgctgagaagattggatcgttcgtcccccatggacgtcaggatgttctggccgctgctattggacgtccagagcaccctggacgtgtccgtgctactggagccggtgtcaccatcaagcaatactttggatcggctccacgaacgtctcgcagtgcttcctccctgcctcctgacgaattacagcagctgactcagcagatcagggaccagctagaggagtccatcacagagaaagtgacgaggcaggaaacgatcctgagacaggtgactctgacagtaaaggtgagtgtggacgaggttaaagatgcagatgctccagttcctgtacccactgatgaggtttccttagtggggcaggcacttcacaccttccttgcttggccgacacatctggtcaagtctttatcacaccaggtagttgtgtctccgccaaaaccacctccgaagcccgatccggaggtcgatgatccgctttatctgatgacattgaccatcccaaagcttttcttgaggccttatcag

SEQ ID NO: 28521 - DNA, 275 bp, Glycine max
  Peptide Sequence Number=SeqID_120206
atggttgaactggtgaagaattcaagagtaatgaagaaagcacaagctaaggtttccatacatggacttccattcttagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 28522 - DNA, 1025 bp, Glycine max
  Peptide Sequence Number=SeqID_120207
cctcctccttcctctcactcactcactcactctccctcgccgccgctgagacacgaagagtagctgccatcctcactgtgccgcccttgccatcacgaagagtagctgccatcctcactgtgccgtttcagttagaaaaagaagtcaagaggcaaaacccggtgagagttgttgtatgttcatctttactggtatctttgctaatgtcagaaacgccgaaactggatatcctgactgctgccattgggcgaccagagcaccctagccgtgtttgtgctgttggagccggtgtcaccataaagcaatactttggatcgacttcacgaacgtcccacaattcttccttcccgcctgatgcagaggctctcgttcttgtacccactgacgaggttaccttagtggggcagacacttaacaccttccttgcttggccaacacatcttgcagctgtgtctccagcaaaacctccagaaagcccagatgaagaggtcgatgatcccctgtacttgatgacattgaccatcccacaactgtttttgaagccgctccaggttatgtgggatgctaccatattcggggtgtttaatcaaaacttcccattgtatataaagcacgaagatctcactgaaattgcacacggtggtcaatgtctcagcatatctgttatacagttgtggattctccatctgactgagacaagtgtgcgagcggggaattctgatgtgtatggattcctcgagccacagtccattcagaaatctgggcaatcacaatttgaatcggaaagttacatcaagaattggatacagagttcaaaacgagatgtttaccttggagcctacctgaatggcggacactggcaaatggtcgtcattctgcctaaggaaaacctagttgtctggttttgttctttacataacaagtcagacaactaccttaagagaataattaacagtgctttgaaaggacttgatgatactccacaaccgaaatccaaggctgctactaggtggattgttgttaag

SEQ ID NO: 28523 - DNA, 915 bp, Glycine max
  Peptide Sequence Number=SeqID_120208
atgaatattttttggttgatcgccaccttactcatgctgctggccgccgggtttttactctacagtgcgcaaaaagacaatcatcccaagcatattcaccggcgttttcgtgaagccttgcaacaagaaggcattcacatctcagcacgattcaccccactcaatttgacagaaatcatccaggccacgctcgccaaggtctcacatagcgaaatggaggaaatgcaacacctactcttacaggctggctggccaggagccaaggccaccttcacgttcctgctattggcctggctgctgccggtagcgttcggcctgctggctgccttttatgccatattaacgcaggactccgcggtgaatgtactcttccatttagtgtttgcttttgcagcaacatttgtcctgatacgccgtttactacgttggaaagcacaaaaaagacgtgaagctattcgcaaagaagtcattccatttttacacctactccgtatgctctttgaagcaggcctgtctttggagcatattttgctggttattgagcaacaaggtcgtgacctgattcccaatcttgccaaggaactggagggagtgatcaaacgtatacacacaggacaggacagggcagatgcattggtagaaatggcggcaccactagaggtgaccgaattgaatgacaccattgccatgcttaagcaggtgacacgttatggcggtaatgtccgcgattcattggccgaatatactacattaactgagcagcgccaggtttcacaattgcgcgaatatgtcagcaaactatctgcaaaaaggaccatcgtcatgatcctgtttttgttcccggcgctcatggcattccttgcaggacctggttttattgggctaagcaaagcgttaaaaggagtgggtggataa

SEQ ID NO: 28524 - DNA, 162 bp, Glycine max
  Peptide Sequence Number=SeqID_120209
atggttaaagcatgtcaaaaagggggaaatagagggagatggttgccgcccagctcgccaaggcgagctgggttgcttccaccagaaggcatcgccttctgttggaacaccctggaaggcccaagtggacctggttgctatttgcacacccctttttactaa

SEQ ID NO: 28525 - DNA, 437 bp, Glycine max
  Peptide Sequence Number=SeqID_120210
tagagcgtacttctacttgggttataatactgaaaacagtagagggtacatctcttgtggatcagttcaagtggagcgtacatccacttggtgttacattgagcacaaaggaggagacatcctttggggctcattgcttgaaaaggattttacaaggttaaaggaaatctcaagaaccggtggttgcttggggactggatgtaggcacgggcggtttcaagattatgatgaagaccaagccaacttatgtctcatgacaaaatctcatgagaagaatgaggaagaatttgtaaagaagaagtggtacatcgacagtggatgttctaagcatatgacgggagatatatccaagtttacaaccatttcccccaagaaaagtggacatgttacatatggtgacaacaacaaaggcaaaatcattggagttggcaaaatag

SEQ ID NO: 28526 - DNA, 576 bp, Glycine max
  Peptide Sequence Number=SeqID_120211
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccatatagctttgtgcccctgcagatcattccaggcttacacttgcgcttatgttttctttattccatctcaaacaggggctggtgttatactgtgcattgaaaaggcattagctcagtctggagtatcaaaagaggatgtgaattacataaatgcacatgccacatccacaccagctggagatcttaaggagtaccaagctctaatgcattgttttggtcaaaaccccgagttaagagtgaattctacaaaatctatgattggtcatctactaggggcagctggtaccgagctcgaattcgtaatcatggtcatagctgtttcctgtgtgaaattgttatccgctcacaattccacacaacatacgagccggaagcataaagtgtaa

SEQ ID NO: 28527 - DNA, 186 bp, Glycine max
  Peptide Sequence Number=SeqID_120212
atgtcacctgacttcacgggtcaggatgacaaaggtgcagaagacgacactctcgggtcactggatagcaaagggtgtgtgcgggttaccgtcaggtgtctccgcatgccaccggactcttgggtcacggtaacaaaaggtggggtggtcgacaaaagcagagcttttgctcctacgtatccataa

SEQ ID NO: 28528 - DNA, 270 bp, Glycine max
  Peptide Sequence Number=SeqID_120213
atgtgtagtcctctgaaggtgaggacatgtagtcctctgaaggtgagggcgtgcagccctctgatggtgaggacgtgtagtcctctgaaggtgaaggtacatgaccctctaaaggcgaggatgtgtaatcctctgaaggtgagggcgtgcagccctctgatggcgaggacgtgtagtcctctgaaggcgaggacatgtagtcctctgatggcaaggacttgtaatcttctaaaggtgagggtactagtacccaagggtccatccttatga

SEQ ID NO: 28529 - DNA, 203 bp, Glycine max
  Peptide Sequence Number=SeqID_120214
cacttggtgggcgcacgtttagacataaattgcaagagaatgggagcaatgtggcatgctccattgcttcagaatacaacctaggcctaaggccttttcattcaaatcctcaattcaagaaaacaagcaccaaagtgtcataccctaatttcgtccagggacctttgcttgatgacatgcgacttttgtttggtccttgtgag

SEQ ID NO: 28530 - DNA, 271 bp, Glycine max
  Peptide Sequence Number=SeqID_120215
atgggtgccaagtacctcgaagcggtcaagcaaagctttaactgtcaaaagtttgggcactttgctgatgagtgttacagcaaacccaataacaaaagagaacctaaaggcgatgatgcaaaattggctcaggaagaagatgatgacactgaacagagccaagtcaaatttgctgatgatagaactttgagtgctgaaggaattgggaaggtccttatcaaaacaaaggatagaggtcagtcttgcatcactgatgtactctttgtaccag

SEQ ID NO: 28531 - DNA, 966 bp, Glycine max
  Peptide Sequence Number=SeqID_120216
atggaaccagaatactgggacaagaatcctttcaaggcaaccgccaaagtattccctccaagattccattataggtcaacggccataaataaaaccagaaaattctacgaattcatcctaatagatacaaactcagtatctattaaacacttcaaagaccccaaagatccaaatctaaatacccattccacaatccaaatcctaaaggttatgcagccacgacattatggctcaaacttaaaccaacccaaaaaaatttttgcaccttttgatcctgcaggatataattattgggattacattgacgcctggaccaatgtgttatggcatcaaaatagtaaaattaagcattcatggctaatttactttaaaaataatactgtgtataattttccaaattggttcctccaatggtggaactacttcggaccaattccacaaatattcccagaagaagtccaacagggattccaacaattcaacaagctctataatagcaaggaatcacgtattccaacagatctaaaatacttttccagttttgccttgtcatggattttttcatggcaatacagatacggaaaaactgaaaacagcaagcaatatccaccgttacagagacacgcctttgtaaaatggtggtcacaattcgatacttcaaaggctgctccagatcaagtcaagaactggttccagagcaatcctgagttccttaaacctgctgatccagagacatctctgttcctgaatcagaagtcgcaactggcagcattcttagcaagctcaaaatctaaagagagtcttgctcagaatctcaaagaagttctccaactagttcaacaggaagtggaagaagaaccttccaaaaaggaagctgaatcatcagagactaatgatgaccaagaagacgatccattctaccagaatgaagatgattgtttcggtatatcattagacgacgattaa

SEQ ID NO: 28532 - DNA, 756 bp, Glycine max
  Peptide Sequence Number=SeqID_120217
atggctacctcaccaaaagaaacttcagcttctggttcaccctctgtaccatcatctccgcaccagggacaacctgaattcaacatccaacccatacaaataattcctggtcaagcccctgttcctgagaaactggtccccaaacgacaacagggagtgaagatttctgaaaaccctagccttgcaacaagtcctagggaagtagacacggagatggacaagaagatccgcagtattgtgagtagcattctgaaaaatgcttctgttcctgatgctgatgaagatgttccaacatcttccaccccaaatgtttctgtgcctgatgctgataaagatgttccaacatcttccactccaaatgctgaagtcctcccttcacccagtgaagaggaatcaacagaagaagaagatcaagccacagaagagacccctgcaccaagggcaccagaacctgctccaggtgacctcattgacctagaagaagtcgaatctgatgaggaacccattgccaacaagttagcacctggcattgcagaaagacttcaaagccgaaagggaaaaacccccattaagaggtctggacgaatcaaaactatggcacagaagaagagcactccaatcactcctaccacatccagacggagcaaagctgcaatcccttccaagaagaggaaagaaatttcctcatctgattctgatgatgatgtcgaactagatgttcccgacatcaagagggccaagacatcagggaaaaag

SEQ ID NO: 28533 - DNA, 207 bp, Glycine max
  Peptide Sequence Number=SeqID_120218
atggcactgacacctcacacacacattgagatattaggccctatacctgggtctattgtgagccataaggactggagttcgatctgtggtcatgctgggtcttcgactcgcttgataacagtgaagcctcatctagagttttcctcttttggtgatgcattgtcactgacagtccttatcgccacaatgtattacctaagaggatga

SEQ ID NO: 28534 - DNA, 282 bp, Glycine max
  Peptide Sequence Number=SeqID_120219
atggtgagaagtatgggctataagttttatgacccaactttaagatcaatatttgaaacgggaaatgcaagatttcttgaggaagttgagtttgggaaggaagagaacataaggaaagttctctttgaggaaaaacctattattgacagttctcaagtccttatacctattgttgttcaagaaacaactccagtaatagaaaatagtgttcaaactattgttgatgacattgttcaagaacaagacaacgatgaggttcttcctcaaatacctatacaataa

SEQ ID NO: 28535 - DNA, 336 bp, Glycine max
  Peptide Sequence Number=SeqID_120220
atggcaagcgataaactagactcttctgcagtgtgtgacctgaaactgaaactcattagtgacaggaaaactgatggcagattatataatttgccaaatgcttttgaagtggctgctttaattgttggtgacgagcatacaacaaataacagagatatcatcattgagaagcaaacaggcatgctgcaaagaataaatgaacttcatcctgcatatttacctttgcaatatcctcttttgtacccacatggatgcaatcaagggataatgaagcacgagcaatacttcattcaagaagattgtttcaccaatgggttgttgatgggtattgtatga

SEQ ID NO: 28536 - DNA, 394 bp, Glycine max
  Peptide Sequence Number=SeqID_120221
cgtcagggtcggaacaggagagcgcacgagggagcttccagggggatacgcctggtatctttatagtcctgtcgggtttcgccacctctgacttgagcgtcgatttttgtgatgctcgtcagggggacggagcctatggaaaaacgccagctacgcggccattttacggttcctggccttttgctggccttttgctcacatgttctttcctgcgttatcccctgattctgtggataaccgtattaccgcctttgagtgagctgataccgctcgcagcagccgaacgaccgagcgcagcgaaccgcctctccccgcgcgttggccgattcatgaatgcagctggcacgacaggtttcccgactggaaagcgggcagtgagcgcaacgcaattaat

SEQ ID NO: 28537 - DNA, 258 bp, Glycine max
  Peptide Sequence Number=SeqID_120222
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggggttacgagaattttacggaagcattacggaagccccgaaagccattttccaacaaaacgaggtagaaggttgccgcccagctcgcccaagcgagctaggttgcttcctccttaagtaa

SEQ ID NO: 28538 - DNA, 693 bp, Glycine max
  Peptide Sequence Number=SeqID_120223
atgtcggagccctcatttctgggcagattacttctatggcccagtctaactcctgaagacttggatttcctgctcttatcacagctttatgcaagaccagaggagtttcctccgatagtcttgtctttgaaggggtccagaagaccaagggcaaggccagctaagactccttctacatcggcagctcctcatccagcttctacatcagcagctcctcctccagctcgtattgcagcaactccttctaccccacctcctggagagtttcaacatttcaaagccatgcttcgaagcatacatcaagggcagattattttgctgcaaacctggccagggactcagcctcctcttcacagggacgacgaggatcccgccgctcaggtaccacatcagccattagatgagtcatcagagtcttccacccctaagcccttgatcaggaagaggagggtagttgtaactcaggaagccgcagccactcctgaaaagtcccctgaggccactccagagcctccagtaccaatggcaaataccacttctccacagcaagcagcagatccttcaacgcctgaagttcaaaccaccccagtcctgtctccgaacacctctcttgtagctactcctgtactgcatttgactaacgaggaggaggttcagacacaggacacccaggaccaatcacaggatctttaa

SEQ ID NO: 28539 - DNA, 279 bp, Glycine max
  Peptide Sequence Number=SeqID_120224
gctgacaaagccattgcagaaattgaggcaaagtgtggccaaaaaattgaagaatgcaaagaagaacataggcagcagttgatgcgcattgaagatgaacacacgttgctcatcaaagcattgaggtgtgaacttgaagatgagtgtcagaagctggaagaggagttgcatcttcaaaaatccaaagaagacaggcaaagggctttgttgcagttgcagttgaaagtgatgagtgacaagcccaaagaggaccaagaagtgaattcaaaacagatttag

SEQ ID NO: 28540 - DNA, 636 bp, Glycine max
  Peptide Sequence Number=SeqID_120225
atgccgatctccccctacggaagtatcagtcggtctgtgttgttccgacatagggatcgtacccacaagacacccagtggacccggagaagtccaacagggccctgaggtttccaactttggttacgggcctcagtcagtcctacagggtgcccattccccccagcaaggggtagcgcccacaagacacccagtggacccggaggagcccaacagggccctggggtttccagctctggttacgagcctctgtcagtcctacagggcgcctatccccccaacaagttcatgccatcgtgacatagggatcacgcccgcaagacactcaatggacccggagaagtccaacatggtcctggggtttccagctctaattataggcctttgtcagttctatggagtgcctatctcccccaacaaggtcatcaagccccctactaaccgagctttcatcaagaagtactgtgcccccaggctggcgcagggcgagacaccatcgcagcctggggatggccaacagcaggcaacatacgcaccgccgccacctccaaagcccctcagcccatctacaaaagctggaatgttgcctacgacctgtggtcgaccagcaggcgaccaagtccaaagccaaagataa

SEQ ID NO: 28541 - DNA, 664 bp, Glycine max
  Peptide Sequence Number=SeqID_120226
atgattcctggtcaagcccctgttcctgaaaaactggttcccaaacgacaacagggtgtgaagatttctgaaaaccctagccttgcaacaagtcctagggaagtagacacggagatggacaagaagatccgcagtattgtgagtaacattctgaaaaatgcttctgtccctgatactgatgaagatgttccaacatcttccatcccagatgttgctgttcctgatgctgagaaagatgttccaacatcttccacaccaaatactgaagccgtctcttcacccagcaaagaggaatcaacagagaaagaggaacaagccacagaggagacccctgcaccacgggcaccagaacctgctccaggtgacctcattgacctagaagaggtagaatctgatgaggaacccattgccaacaagttggcacctggcattgcggaaagactacaaagcagaaaaggaaaaacccccattaagaggtctggacgaatcaagactatggcccagaagaaaagcactccaattactcctacctcatccagacgaagcaaagtcgcaattcctctcaagaagaggaaagaaatttcctcatctgattctgatgatgatgtcgaactagatgtcacgacatcaaagaggaccaagacatcagggaagaaggtgcctg

SEQ ID NO: 28542 - DNA, 378 bp, Glycine max
  Peptide Sequence Number=SeqID_120227
atggtgggttacatgcctttaagctttgcagatctggtatttgcgggtgaaaggattgaagtgggcctaagaaggggcaagttcgattacgccacttcaacaagtgctggcaataggaggatcggtacaggcggagctaagaaaaaaaagggagatgcccatgccagaatgcctactcaaccacaaaggcttcccccacataatccatttcctgcacagcctcgaccaactggaaatcccaaccctgacacaaacacaaacccaaggaggaacttcctagaaagaaaacccgcggagttcaccccgatactaatgccttatgccaacctgctaccatctttgctcagcaaccaaatggctgtggtgagcccagggaag

SEQ ID NO: 28543 - DNA, 842 bp, Glycine max
  Peptide Sequence Number=SeqID_120228
ccgttagacaaaggaaggagggaagaggaagcgaagacgcgcgtattggcatttcctgttgaaacgaaagaaagaatgttcagaggaaacaacgacgacgagtttgagtttgacggtggcttcgacttcgacaaggaggaggcactgtataaagagttggagaccctcattcattcagagaacactgccccatcgatgatgtttccgttggaggacgccacccatgttcacagtggtgattctgattctgatggtggctccgacaacaacaagctgcaggtgtttgagttggagaacagcctcgttcaacttcctcccaagttgtcatctttgtcagtgcctcccccgacggaatcgatgttgccgcatacacagtttcacggcggcttcgatgagtgggacgacaccctcgtttaccttcctccgatagaagaaaccctcgatcagttagagaacactgccccaaggcttctttctccgtcggccgaagaaaccctcgatcaccttctttccctttcgactccgatgttgttgcaagagttgttggagtcaaagaacactgcccctgcccctagccttcttcccctatccactccgatgttgttgcaagacacccttgttcaccttccacccctgtcactgccagacaacacttcacctagggtattcactccggcagggcacatcacccttcttccacagacacagacagcgaaccgaccctccacttcatcggcatcatcatctcacaatcgctgcaacagatggaccaatgaagaacacatgttatttcttcaagggcttgcaatctatggcaagggagattggaagaatattgcaag

SEQ ID NO: 28544 - DNA, 300 bp, Glycine max
  Peptide Sequence Number=SeqID_120229
atgcatagatctcccacaggaaatttagttcctctggacttagaaattgaagctacgttgagaaggaacagggccaagaggagaaggaaacttctgcaagacagaacaattgcatccattcttgaggaacaaactcatttttctgattcattatcacctggttcaccatcatcaagggaatccgctactcaattgcctgaaaccactatcatggcaaacgagcaacaccagaggatcacccttgaggattattcaagcagctcagtaccgcaattctttactagcattgcacatcctaaa

SEQ ID NO: 28545 - DNA, 116 bp, Glycine max
  Peptide Sequence Number=SeqID_120230
atggattgcaaaggtccaagagataaagaattacaaatagacagaggcatgacactcactgatactcctaagtctagcatggcattctttaacattgttgttcccaataatgcaag

SEQ ID NO: 28546 - DNA, 216 bp, Glycine max
  Peptide Sequence Number=SeqID_120231
atgaagaaagtgagagaacaaaggagtgaggaaggagaaacaaactcaatgtttggaggcacgattagtcctggatggattcacaagaggaaaactgccaggaaaccacattacaagcgaaacctcaaagagagttgggcttcgtcctcaaaaggaaacaacaccagaaaatctagccttccatggattcaaacagaaaacgcaaatgaaacatga

SEQ ID NO: 28547 - DNA, 435 bp, Glycine max
  Peptide Sequence Number=SeqID_120232
atggcaagagaagcgaaagtggtcaagatctcggcacaagagctagaccaagtgaaacaaaatagaaatagggtggttgggatgccaaggaaacacttggaggagaaggaaaaagctttggcagatcaaggagagtggacttcattcattgatgttttagcactgttgttgtttgggatcgtactctttccaaatgtagatgggctggtggatttagcagtgattgacacttttcttgcttatcaccgcaacctatctgccccctataaggtcatcacatgtgtgccgagaaaggaaaagcaaattgggagaaactcttggcaggctcggacgcaagggataacttggctcccgaagctaaagagtccaagtggaggagaagctgaagtccttgaggagagcgaagaaagtgcaagccttgaaagtagagcttga

SEQ ID NO: 28548 - DNA, 333 bp, Glycine max
  Peptide Sequence Number=SeqID_120233
atgaagttcctttatctgttcagggcccatctgcagctgctcgtattgtgcccaggtgacaatctagtggtttggttttgttctttgctaaagaagcctgatgcttccattaagggtgtagtaaacagtgcaatgaaatcagtcagcaaaactgcagagggaaagccacctcagcatgggcctcagtggattgaagcaaagagtcatgttcaaacaggaaactacgagtgtggatactatgttatgcattggatatggtgcatcgtaagtgctggattgaaggatgaatggattcacgtatatttcttgttattcatttcgtcgtcattgtaa

SEQ ID NO: 28549 - DNA, 687 bp, Glycine max
  Peptide Sequence Number=SeqID_120234
atgggcccatcggtggctactgaagatgaagaggtgcaggcccttagggcagaactcgagcaagcccaaaccgtcaaagtaaagttcaaatcagcagctctgaagatccgaaaggagaatgttgaactgagagatacaaatatagctaccaccaaggccttggaacgagagaccaagagggctcgtagggaagaacacatccggaacaagttccgaagggctatgtggggcagtaacagcgagcttaagctccagagagaggaaagggaccaatcgcgagtagacagtttgatcttgaaggacgagttgaaggcttgctcgaggtccaagagaagtttgtctcaacagttatgcgaggcagagacccacatgttggccatcattagcaagtaccaagaagaactaaatctagccacggcccacgagcataaagtggcggacgagtatgcccaagtgtacgcggaaaaggaggctagaggaagggtgatcgactcgctacatcaagaggcaacaatgtggatggaccgatttgcttttacattgaacgggagtcaagaacttccccgattgctagccaaggccaaagcaatggcgaacacctactccgtccccgaggagatccacggactactcagctattgtcagcatatgatagacttaatggcctatataattagaaaccgctag

SEQ ID NO: 28550 - DNA, 285 bp, Glycine max
  Peptide Sequence Number=SeqID_120235
atggttccggttttgattactacatgcattcccatcatcatcatagctcaaaccaccacactctttatcagacaaggcaccacagtggacaggagaatgagaccccattttgaaatccctccagcatgtctcatagcacttagacagaccactgaacaatggattttcatcattaacatagaacagagacataccttcgatgacttccctgggagtcttaaagtcaagcacaatggacttccaaaatcgattcccacctgttccggggactctttcctttcctag

SEQ ID NO: 28551 - DNA, 412 bp, Glycine max
  Peptide Sequence Number=SeqID_120236
tgcctgtcgcccccagcaaggtcatcaggtcccccctaccaatcgagctttcatcaagaagttctgcgtctccaggcaggcgcagggcgaaacaccacagcagcctggcgatggccggcagcgggcaacagacgcaccgccatcacctctagagttcacctctgctcatccacaaaaaggtttgagtattgcctacaccacatggccgaccaataggcgaccaagtccaaagccaaagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 28552 - DNA, 171 bp, Glycine max
  Peptide Sequence Number=SeqID_120237
atggcatggctatcattccaagttgcttggggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 28553 - DNA, 384 bp, Glycine max
  Peptide Sequence Number=SeqID_120238
gtcgactctagaggatccctagaggactacacgtccttgccatcagagggctacacgccctcgactttagaggactacatgtcctcgccttcaaagggttgtacgccttcgccatcagagggctacacggcctcaccttcaggaggactgcacgtcctcaccttcagagggttgcacgctctctccttcaaagggcgacacatcctgaacttcagagggctgcacgctctcgccttcagagggctgcacaccctcgccttcaaagggcgacacatcctaaacttcagagggttgcacgccctcgcctttagagggctacatgtcctcactttcagtgggctccatatccacatcttaagagaatttaaggtcctctgcccttaa

SEQ ID NO: 28554 - DNA, 387 bp, Glycine max
  Peptide Sequence Number=SeqID_120239
atgtaccctccactagaactgatccacaagagatgtaccctctcttgttctcagtcaacaacccaagtagatgtaccctctacttgtaccacaaatgatgtaccctccaatgtgttaagacaaagttctcaggcggttaaacctttgaaactttgtgaatggggatacaaaacaattctcaggcgggagaagggagacacaaaagaattcaggcggttagtccttcgttcttttggaaaagggagaagagagacacaaaaagaattcaggcggttagtccttcgttcttttggaaaagggagaagagagacacaaaaagaattcaggcggttagtcattggcgaattctttttggcaaagggagaagggaatgaaaaagatgaataa

SEQ ID NO: 28555 - DNA, 711 bp, Glycine max
  Peptide Sequence Number=SeqID_120240
atggcgaggattcctgacaagattaagtctattcatgggtcaaaagagacgcttaagcttgctgtcagaatcacggatctttggttcgttgggactcccaacaagtctgagcaagcgaaaatggtttttgttgattctgagtcttggaaagctaatttgaaagagaattccacttatgttatgcataatttcaaagttttcaaggatgctggtcaatttagagtgtgcaaacatgagtacaagttattttttattggagtgacggttgttagagaagctgatttgcatgaactgccttttaagcaatttagatttgttgaattttcaaatgtcgttgttggcaattttgtggctggccttggtgaaattttgtcttgcacactttgggagaattactgtattcagttcctatcctatttgaatgaacatggggatgatgggccgatggttattatattgacacatgccagaataaaagatgcgcagggaagttatccagcttcagtgagcaattctttcaaggcatcaaaactattgattaatgatcctatattggaaattcaggaatttaaagagaggcttttagatttaggtgttgaggtgagtccagttttaatacctggcgatcaagcaagttcacaagtttcagggggaagccagctatcatcaaaggattcgtttctttcaaaagctgaaatcaaaactatttga

SEQ ID NO: 28556 - DNA, 276 bp, Glycine max
  Peptide Sequence Number=SeqID_120241
atggaaaaatccgacaagaaaaatttcaaagataagaaagaaaagaaaacatacatcacttggaaagataatgacatggattcatcaagtgattcaaaaaatgaaatcataaatctgggtctcatggccaaagactataaaatcggagtagaggatgcattcaatgacttgcataaagaatctatcaaacttgccaaattagtttcatattctaagaaaaccatttcaagtttagaaaaggaaattttgaagttaaatgtagttagaaaatcttaa

SEQ ID NO: 28557 - DNA, 366 bp, Glycine max
  Peptide Sequence Number=SeqID_120242
atgccaatctccccctgcaaaagtatcagttggtctgtgtcgtcccgacgtggggatcgcacccacaaagacacccagtggacccggaaaagtcaaacagggccctggggattccaactctggttacgggcctctatcagtcctacagggtgcccgtacccacccccccggcaaggtcacgtcatcatagggattgcgcctgcaagacacccagtggacccgaagaattctacggagtacctgtcacctccagcaagggcatcaggccccctactaatcgagctttcatcaagaagtactgcgcccccagacgggcgcagggcgaaacaccatggcagcattgggatggccggtagcgggcaatag

SEQ ID NO: 28558 - DNA, 441 bp, Glycine max
  Peptide Sequence Number=SeqID_120243
atgggatcaagtcaaacgccttcgcttaaaatgaggttctatcaagtcaaggtcaagagcctagggatcaccagtctaaaaaagctagggcagctaatggggcagctccagcagcaagcttttcgcaaagcttatggtaaaatctgggacctagccatggtagaagtctccacagaggcctttgcctccctcgcccagtattatgatcagccattgaggtgcttcacctttggaaacttccagctatcacccatggtagaagaatttgaagagatcctaggatgtcctctagggggaaggataccatacctcttctcagggttctatccctcattagctagaatttctaagatagtccaaatctcggcacaagaattagaccacagaaagcaattcgaaaatggggtggttggaataccgagaaaatatttggaggcataa

SEQ ID NO: 28559 - DNA, 609 bp, Glycine max
  Peptide Sequence Number=SeqID_120244
atgcaatcacagggacttgcactacctcttgagcttgaggttggtgcttcagctgcttgtgtcagtacaaaggagagttgtgttgatccctcagggaacgatccagacacgggtgactcagacaaatgcaggttgtacatcgaagaaaatcctccctgcctggtttccctaggaagactttatgaggaatccacaaccgttcacaagattcctttattgcatgatcaagtcaaggttggtgttgaggaggttagagatgcagatgcttccattcttgtacccactgaagaggttcagttagtggggcagacacttaacaccttccttgctttgctgacacatcttctcaagcatttatcagaacagggagctgtgggacccgcgaaacctacagatgggttggattatgatgtcgatgatccattatatctgatgacattgaccatcgcacaactatttctgaagtcattgcaggttatgtgggatgctaccgtgtttggggtgtttaatgagaacttccccttgtacataaagtatgaagatctgtttgaaatagcatatggtgatcaatgtctcagcatctctgttatacagttgtggattctataa

SEQ ID NO: 28560 - DNA, 504 bp, Glycine max
  Peptide Sequence Number=SeqID_120245
atgattttggatatgtccgtaaaagatgatgaaaatcaagctttgaagaagaaggtacaagaagctaaaaccgagttagaagatgctaggcaacaaattattaagctattggctgttggtattgttttatcacaattaatgctttctgtgcaaaagctaattgaatgcatttgcttgacaattcaggaattaccacggttcttgaaaggggttactaagattcaaattaaaaaatttggggaggttagtgctaggtcatttaaaaaagtgtgcatgaataggtataaaaataacaaaaaagcatcatcggagtctgtcaaactgtgcgcaaagtggcaaaaagaaattctggattcaacatggcacccttttaagattgttgaagtcgaagggaaggaaatacagaacatctacattggttctaaaaccgatgttgaaagtgacgatgttgaatgtatgaatgttaacatcggttttggagatccgatgttaacatacatatga

SEQ ID NO: 28561 - DNA, 492 bp, Glycine max
  Peptide Sequence Number=SeqID_120246
atgagtcaatcagagaaacagtctctgcctgctggcatgctggccgccgccggcatcgtgtttggtgatatcggtaccagcccgctgtatacactgaaagaatgcctgtcgattttgccggacggcgcgccgtcggcgctggcggtgatgggctttctgtcgctgatcttctgggcgctgacgctcatcgtcacgttgaaatatgtctgcttcgtgatgcgcgccgaccacgacggcgaaggcggtattctcaccctgatgtcactggcccgccgcaacgttggccgcaaagccggtcatatcatcgtgctggccggtctgattggcggcgcatttttctacggtgatggcgtgatcaccccggccatctcggtgctgtcggccattgaagggattcaggtcgtctcgcccgggctggaaaaatatgtggtgccgctggcgctcaccattctcgcgctgctgttcattattcagaaacacggcacggaaaag

SEQ ID NO: 28562 - DNA, 612 bp, Glycine max
  Peptide Sequence Number=SeqID_120247
atggccaagtttgatccagacatagtcctcgaattttatgccaatgcttggcctacggaggaaggcgtgcgagatatgaggtcttgggtaaggggtcagtggatcccgtttgatgcagatgctatcggccagctcctgggatatcctttagtgctggaagagggtcaggagtgcgagtatggccagaggaggaaccggttcgatgggttcgacgaggaggccatcgcccagttgctatgtataccggggcaggattttgcctggactgctgccgggagatgggtgcggatcatgcgcaccaacatgaccaccctgactcaggtctggatgactttgctgctcaacaacattcagcccagcgaccataattccgacctccccctgccaaagtgtcagctggtgtacgccatcctgacacagatgagcattcacgtggctcagctaatcgctgatgccatctatgtatttgcaggtatggcgcctaccaggcaccctctggacccggataagtccaacagggccctgggatttcccgccttgatcacaggactctgcccgtcgttcggagtccctgtcgcacctagcaaggtgattcggccgcccatcacctga

SEQ ID NO: 28563 - DNA, 485 bp, Glycine max
  Peptide Sequence Number=SeqID_120248
tccaacagggattcgaacaattcaacaagctctataatagcaaggaatcacgtattccggcagacttaaagtacttttccagttttgccttgtcatggatcttttcatggcaatacagatacggaaaaactgaaaacaacaagcaatatccaccgttacaaagacacgcctttgtaaaatggtggtcacaattcgatacttcaaaggctgctccagatcaagtcaagaactggttccagagcaatcctgagttccttaaacctgctgatccggagacatctttgtttctaaatcaaaagtcgcaactagcagcattcttagcaagctcaaaatctaaagagagtcttgctcagaatctcaaagaagtctccaactacttcaacaggaagtggaagaagaaccttccaagaaggaagctgaatcatccgagactaatgatgaccaagaagatgatccattctagcagagtgaagatgactgttttg

SEQ ID NO: 28564 - DNA, 612 bp, Glycine max
  Peptide Sequence Number=SeqID_120249
aggatccctccttctccttcggacgcatcggcttcgccgtctgctgtgaagcagacacgcaaagcctcacgtctacgatcgttgtccactagaccacctggtgttgaaagaccagtggtgcatgttgatcctgctacagggaaggccgacggtccccacaagaagaaattaagaacatatttggggattgtggcacgtgataaggtggacatcacctacgagaactggacggaggtccctactgctcagaaggacctgatttgggaggatattcagaggcttctgacagtaggacgaaaaggaagttactacagacagtgggggagagatgaaggcagtttaaatcagacctcacgaggaaatggacccttgcagccgatcaggacggtgtcgaggacactgtttgtgacaaatacgacatcagcaaggaaaagtgggcccagttttgccagactcatagagacccttcttgggaggatgtgcgcatcaaggcacaagccatccaaaagcagaatactgcccccccacgttttgtctcgtgggggttatgattatttggagcaaaagctcctggcatcatcgaccatccatccccggtcagacgccacgtga

SEQ ID NO: 28565 - DNA, 813 bp, Glycine max
  Peptide Sequence Number=SeqID_120250
atggcgagaatagccaaagtggtcaaaatctcggcaccaaatttggaccgagtaaagcaaaatataaatggggtggtcggattaccgaggaagcacttggaagagaaagtgaaggctttggcagatcaaggtgaatgggcttcattcattgatgtcttagcgctattggtgttcgaagttgtcctctttccaaatgtggatgggctagtggatgtagcggtgattgatgccttccttgcttatcaccatagcaaggaaagtccggtcgtcgctgttttgacccatgcctatggcacatttgaccgaagatgcaagaagagcggtgcaaggattgtctattacacacccgctctttatgtatggttggtctctcacctctttcttcatgaaagtagatccatctgtcccctacaaggtcactacattgaccccaatgcaagactgcttcaaagagtccaaaaagcatggaatgtggtggaaagaaaggatggggagcttaggggaagcggcaatgggatcgtcggcggctatcacaagtggctgaaggctagaatgcaagagataacttgcctcccgaagctaaagatttcaagtttggaagaggttgaaacccccgaggagagcaaagaggtgcaagccttgaaggcggaacttgaaagagcacaagtggtcaaggaaaagttcaagacgacaaccattagggttagaaaagagtgtgacaagctgagggacgtcaatgtggccacaactgaagtgttagaacgagaaacaaagagggcccgaaaggaagaatggggccaaaacaagttttga

SEQ ID NO: 28566 - DNA, 195 bp, Glycine max
  Peptide Sequence Number=SeqID_120251
atgaaggatgagatgaaatctatgcaagatgatggtgtttggaatcttgttgaattgcctaaaggcctaggatcttcttcatcaatggattcttttgcttcttgggagatgaatggctgcggaatggagaaggaagagagagaggagatgccacttcaaggagaagatgagtctagaagaagctcaccaccatag

SEQ ID NO: 28567 - DNA, 786 bp, Glycine max
  Peptide Sequence Number=SeqID_120252
atggtagaagaatttgaagagatcctaggatgtcctctagggggaaggaaaccatacctcttctcagggttctacccctcattggccagaatttctaaaaaagtccaaatctcggcgcaggaattagaccgccaaaggcaagtcgaaaatggggtgctcggaataacaagaaaatatttggagggagtcctctttccaaatgtggatgggttggtggacctggcagcaatcgacgtttttctcgcctatcataaccacaaggaaagtccggttgtcgctatgctagccgacctatatgacaccttcgaccgaagatgtgaagaaagcaatgcaaggattgtttgctgtactccagctctctatgtggggctggtttcacacctttttctccaagaaggtaggcccgtctatccgctacaaggaaggaagaatcaagattctatcttcatgcgaaggatgtccaaatgttcccttgatgggaacaagggaaaggacatagagcttaggggaagcagtaatgggagcatcggcggctatcataagtggctgagagtctggacgcaaggattggattggctcccaaatctaaagactatgagagatgatgaggttaaagcttcggaagaaagtgatgaggtacaagccctaaaggcagagcttgaaagagcccgagtagtcgaagagaagttcaaggcagcaatagtgagctcgagctccgaagaggtgaaaggaatcatcacgggtcaaaggcatgatcttgaaggacgagctaaaggcttgccttag

SEQ ID NO: 28568 - DNA, 624 bp, Glycine max
  Peptide Sequence Number=SeqID_120253
atgcagaactatcaacatgcaaagagatgtgattctgcaaaagcgaggaccaacagaaaacgtgttatgcagcagaagcgacatgatcatgctcagtcatcttcacaaccaacagttaattgcacttcagaatataatagttcagtctctaattttatgactcccttcgaggattgtcaatctccaactaatcagcctgtaatcaacactgaagatattgtaatgcacaaatgtggtatgatgaaagaatatcaaaaaataagaattatcagaatccaaggttcagtttatgttgtggagatggcagagttgaattgccattattacaaaatccacccacatatctgcaacaacttctatttcatgatgatacaattgatagtaaaaattatcaacataacttgcaagcataacaacatgatgtttgcctttacttctgctggaattaagctagataaaacaattaataattcaagaggacctcctacgatcagaatacaggggcaaccatgccatagaataggcagtctattaccaatgcttggcaaaaaacccaaatttgcacaactatatatctttgacacagaaaatgaagtgcaaaatagaattaatgtcatgaggtag

SEQ ID NO: 28569 - DNA, 602 bp, Glycine max
  Peptide Sequence Number=SeqID_120254
ggatcacgcgcacgagacacccagtggacccggagaagtccaacaggaccctggggtttccagctctagttaagggcctctgtccgtcctatagggtgcctatccccccagcaaggtcatgccattgtgccataggggtcgcgcccataagacaccaagtggacccggagaagtccaacagggccctggggtttccagctctggttacgggcctctgtcattcctacagggtgcccatccccccaacaaggtcatgccatcatgacatagggaccgcgcccgcaagacgcccaatggaccagaagaagtccaacagggtcctagggtttccagctctggttacgagcctttgtcattcctacagggtgcccgtccccccaacaaggtcatgccatcatgacatagggatcacgcccgcaagacgcctaatggacctgaagaagtccaacagggtcctagggtttccagctctaattacgggcttctatcagttctacagagtgcccatcgcccccagcaagttcatcagaccccctattaatcgggctttcatcaagaagtactgcgcccctaggcaggcgcagggcgagaaaccacagtag

SEQ ID NO: 28570 - DNA, 447 bp, Glycine max
  Peptide Sequence Number=SeqID_120255
atggctgcggcggggcgcacgatggcggcagtcttggcattccgggagttcccgatgaccctccagttcatccacggcggtgtcgaccgccagggtgcgccgctgcatttccatatccgtgatggccgcatcagcggcctcaatggcgaggccgcgccggctgacggggcggaatacgtcgacctgcagggcttcacggtgctgcccgggctggtcgacggccacatccacctcgacaagagctttgtcggcgaccgttggcacccgcaccagccggtgaacagcctgcgtgagcggctggcggtggagaaggcggcggtggcgggtgcggcaccgatggtggaccgtgccgaggcgctgatccgccagtgcagtgctttcggtaccgtggcgatgcgctgtcatgtcgatttcgacgccagcaccggtctcggccatctcgaggca

SEQ ID NO: 28571 - DNA, 507 bp, Glycine max
  Peptide Sequence Number=SeqID_120256
atggagagaagtatgatagatgctgtcagtggtggagcccttggagacatgacccctgctaaagccagaaatttaattgagaagatggcttcaaactcccagcaatttagtgccagaagtgatgttattgtcattagaggagtgcatgaagtagccacgaattcatcaggtgagactaagaagcttgaaggtaaactagatgccttggttaacctggtaacccaactgtccatgaataaaaaatctgcacctgtcgccagaatctgtggtttatgctcctcttccgaccagcacacagacctttgcccttctgtgcaacaatctgaagcaattgaacaacctgaagcttatgctgcaaacatctacagcagacctcctcaacctcaacagcaaaatcagccacaacagaataattatgacctctccaacaatagcccaagtagaccatacgttcctccaccaatccagcagcaacaacaacaacaaggcccagaaacagcaaaatag

SEQ ID NO: 28572 - DNA, 210 bp, Glycine max
  Peptide Sequence Number=SeqID_120257
atgaacgaaaacgcaattcatggggctccgaaaaagagattgagaatggagaagtgcactaagcaatcactacccatggctccaaactcatggtgtggaggacgcatgaacgaaaacgcaattcatggggctccaaaaagggttgagatggagaattgcactaagcaatcaccatgcatggctccaaactcgaaggtggaggacacatga

SEQ ID NO: 28573 - DNA, 435 bp, Glycine max
  Peptide Sequence Number=SeqID_120258
atggggatcgcacccacaaagacacccagtggacctgaagaagtccaacagggccctagggtttccagctctggttacgggcctctgtcggccctacagggcgcccgttccccccagcaaggattgtgcccgcaagacacccagtggacccgaagaagtccaacaggttctacggagtacctgtcacctccagcaaggtcatcaggcccccctaccaatcgagctttcatcaagaagtactgcgtctccaggcaggcgcagggcgaaacaccacagcagcctggggatggccggcagcgggcaacagacgcaccgccatcacctctagagttcacctctgctcatccacgaaaaggtttgagtattgcctacaccacatggccgaccaataggcgaccaagtccaaagccaaaggacgcacctagttgctcatga

SEQ ID NO: 28574 - DNA, 954 bp, Glycine max
  Peptide Sequence Number=SeqID_120259
atgaagtttgttgatgaagcgacgatcctggtcgtggcaggtgatggcggcaacggttgcgtaagcttccgccgtgaaaaatatattcctcgtggtggccctgacggcggcgatggcggcgacggcggtgacgtatggctggaggcggatgagaacctcaacacgctgatcgactaccgttttgaaaaatccttccgcgctgaacgtggtcagaacggccagagccgtgactgtaccggtaaacgcggaaaagacgtcaccattaaggtgcctgtcggtacgcgtgtgatcgatcaggggaccggtgaaaccatgggcgacatgaccaaacacggtcagcgcctgatggtcgctaaaggtggctggcacggtctgggcaacagccgttttaaatcatctgttaaccgtacgccacgtcagaaaaccatgggtacgccgggcgataagcgtgatctgcagctggagctgatgcttctggcagacgtgggcatgctcgggatgccaaacgcgggcaaatcgacgtttattcgtgccgtctctgctgcgaaaccaaaagtggcggactatccgtttacgaccctggtgccaagcctgggcgttgttcgtatggataacgagaagagtttcgtggttgccgatattccgggtctgattgaaggcgcagcggaaggtgccggtctgggtatccgcttcctgaaacaccttgagcgttgccgcgtcctgctgcacctgatcgatatcgatccaattgatggttccgatccggtagaaaatgcccgtatcatcgtcggcgagctggagaaatacagcgaaaaactggcgaacaaaccgcgctggctggtctttaacaaaattgacctgatggataaagccgaagcggaaggcaaagcgaaagccattgctgaagcgatgggctgggaagataaatactatcttatctccgccgcaagccag

SEQ ID NO: 28575 - DNA, 141 bp, Glycine max
  Peptide Sequence Number=SeqID_120260
atggcatttggtggacctgcagctcacccaggcaagctgagacttagccatgaagcaattgactcacctaggcgagccagagactggtataccctcaaaaatcttatacctacaattgttggcgtaggtaaaactctttaa

SEQ ID NO: 28576 - DNA, 321 bp, Glycine max
  Peptide Sequence Number=SeqID_120261
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccggggtaggcagttcgctccaagctggactgtatgcacgaaccccccgttcagtccgaccgctgcgccttatccggtaactatcgtctttgagtccaacccggaaagacatgcaaaagcaccactggcagcagccactggtaaatga

SEQ ID NO: 28577 - DNA, 312 bp, Glycine max
  misc_feature (266)..(266): n is a, c, g, or t
  Peptide Sequence Number=SeqID_120262
atgttttctgatgagaatcatgaaactggccaaatacaggctaaaggcccaagtggagaaggacgaaggcccaagtggagaaggatgaaggcccaaacttatcaaggtaatccttgtggcgtctatcctgacttatcttccttcactggaagtggcgtctacccagacttatcttccttcaccggaagtggcgtctatcctgacttatcttccttcaccggaagtggcgtcatccaaaccttcgtagcctgtatcaaacgatccgntcctactcaggttcacatcatctggtatcagagcttcggctcttga

SEQ ID NO: 28578 - DNA, 285 bp, Glycine max
  Peptide Sequence Number=SeqID_120263
atgaaaggaaaccaacaagggtccccagtggagtcgccaactgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 28579 - DNA, 204 bp, Glycine max
  Peptide Sequence Number=SeqID_120264
atgggtttaggcaaagacaacggcggcataactagcctgataaatgccaaaagaaatcgtgggaaatccgatgacgagttccccgaaggtactaatacctgggacccgcctatcaacttcgagcaagaaacgaatcaaatggaagatgaagggaacgaggatgtgggacttccccccagaattagaaaggatggtcgcccatga

SEQ ID NO: 28580 - DNA, 288 bp, Glycine max
  Peptide Sequence Number=SeqID_120265
atggtggaggatgcacgaatagcgctaggcaatcaattcgtggggctccggactcgatggtggaggatgcatgaatggcaatcaattcatggggctccggacttgatagtggaggatgcaagaacagcgcttggcaatcaattcatggggctccgtgatgcaagctccattggagcttgtaggcctaggatcttcttcatcaatggattcctttgcttcttggaagataaatggcagcggaatggagaaggaagagagagaggagacgccacttcaaggagaagatga

SEQ ID NO: 28581 - DNA, 342 bp, Glycine max
  Peptide Sequence Number=SeqID_120266
atggtgggttacacaccttcaagctttgccaatttagttttcactgacgaaaagatcgaagtgggtctgagaagaggcaaatttgattatcctgctttgatcaatagggagccaggggaaaatggagagaatgagaaggagggaggaacccatgttgtgactgttgttcctacacgaccaaatttccccaccagctcaataatatcaatactcagccaatatcagcccttctcattacccaccaccctatcaaccaagaacactcaatcatccataaaggccacccctaaatcagccacaaagcccacctaccgcacatccaatatcaaacaccacccttaa

SEQ ID NO: 28582 - DNA, 411 bp, Glycine max
  Peptide Sequence Number=SeqID_120267
atggtgggttacacaccttcaagttttacagatttggtcttcgccagcaaaaagatcgaagtggatccgaaaagaggcaaatttgatcatcctactaggacgactgagaaaattggggcaaatgaagagggtgagaaagagggagaaacccatgctgtgactgccattcctatacggccaagtttcccaccaacccaacaatgtcattactcagccaataacaaacctcctccttacccaccacccagttatccacaaaggccatccctaaatcaaccacaaagtctgtctaccgcacttccaatgacgaagaccacttttagcacaaacaaaaaaaaaaacaccaacaaaaaggaattttgcagcaaaaagcctgtagggttcaccccaaattccattgtcatatgctaa

SEQ ID NO: 28583 - DNA, 480 bp, Glycine max
  Peptide Sequence Number=SeqID_120268
gtttatgacgtaactgcctatcaggccaagcttgacgcttgttgctctagcacaggcggttgccatcttattcgggatggatcaatttgtgtaaacgatcgctttctatgtctcccaatcgatgcggtgaagctaaggggcatgagcgtgataagagggattgctttcctcttcgtctgtatctacgcaatttcccgcttcttttcctcgcgtcctcctttccttctttcattctttgttggctcgcagggatatcgattactggtcgtaaggggcgggatatctggttcagcagcagatcctaattacccttctggtgactccgtaactcattgcttcctctcttttcaaagcttgtgggtgctctgcttcaagagtctagtctatttatcatttaacggattgccgagcggagaagcgttaactactgggatatcggggagttcctctccagctactggaacttccctcgctacatga

SEQ ID NO: 28584 - DNA, 490 bp, Glycine max
  Peptide Sequence Number=SeqID_120269
atacaatccatgttggagaaatcatccaaatctgagatgggcaagtcctccactacaacaacagcctgtccctcatttccagaatgctgctggtccaagcaagccatatgttcctccttcaatacagcaacaacaacaacagcggtcacaaaaaagacaacaagcaactgaggctcctcctcaaccttccttagaagagttagtgaggcaaatgaccatccagaatatgcaatttcagcaagagacaaaagcctccattcagagtctgacaaatcagatggggcagatggctactctgttgaaccaagctcagtcccaaaattttgacaaattgccttcacaaactgtgcagaatttgaaaaatgtgagtgctatcaccttgaggtctagcaaccaaattcaagtgcctcgaccagtagcagcacctgcacctaaacctgtcaagtttcattctacacctgaaaaagaggatgagatagttgcacaatag

SEQ ID NO: 28585 - DNA, 297 bp, Glycine max
  Peptide Sequence Number=SeqID_120270
atgccgatctccccctgcggaagtatcagttggtctgtgccgtcccgacataggatcgcgcccgcaagacacccagtggacccgaagaagtccaacggggtcttggagttgccagctctgattacgggcctctgtcagttctacggagtgcttgtcacccccagcaaggtcatcaggccccctactaatcgagctttcatcaagaagtactgcgcccccggcaagtgcagggtgaaacaccacaacagcctggggatggccggcagcgggcaacaaacgcaccgccaccacctctag

SEQ ID NO: 28586 - DNA, 50 bp, Glycine max
  Peptide Sequence Number=SeqID_120271
atgacgaacgatagttcgaagatgacaagcaagtttgcgaagttggacaa

SEQ ID NO: 28587 - DNA, 237 bp, Glycine max
  Peptide Sequence Number=SeqID_120272
atgccactgcgggccctagccgatcttggaatgaattcctacgagccggctaagtcagaccaaggttactattccgggaacgagaagtaccagatgggggagacccgctacttcaacgaaatatactacctcactaagatggctgtcagcccgagtgcctgtcacgaccacaactaccaagattcaaccgtcttttgttttgctgctgctacgccctttctgacctgtccacattaa

SEQ ID NO: 28588 - DNA, 270 bp, Glycine max
  Peptide Sequence Number=SeqID_120273
atgtggcacacgctgtttggagtggacagatatgttaatttggaacgtcctgatttgaagttggtgtcacatgggaggaaggtgacattgattgggaggccagtgcctgagattgaaggactggttggtgccacaggattaagaccactgatcgattgttcagttgttactggcgatcttggacttatattcacatttatggagaggtgtcacagcgtagaccagcaccttctacctttcggtaggagagttgataatcacattggatga

SEQ ID NO: 28589 - DNA, 273 bp, Glycine max
  Peptide Sequence Number=SeqID_120274
atggggttgaatcaatttagatttttcaacatggttcatgacatcttggtcaaggtgaaactggaagtaacaaggacatcaacagtcctaaatgtgtttggcagtaaacaaagcagtgataggaaaatgcaaggatcacgcatgaaaacaaaaggtatgcagtttgtagaacaaaaagaacgatatgttcattatgatgccatgaagagatgcttatgcatgctagagataaaatgcgggagtgatttgattcgcattgatttttcggagtaa

SEQ ID NO: 28590 - DNA, 312 bp, Glycine max
  Peptide Sequence Number=SeqID_120275
atgaagatacaaagaaaaggggttcccatgaaccctaagagaataaaggtcattcctgagtggcccactccaccaacaccactcattgagttggtgaggaaccatgttccttcatgggaagatgcccaagaaatgggttttcagaccttaccttacttcaacataccaaacaccactaatacatatgtttttgttctttttactggtgttaaggaaaaaagcccagagtttcaaaaacctcaagatttgaggtcaattccttttcaagggggagggaatgatgcaatcctaccccacaagggcattggatag

SEQ ID NO: 28591 - DNA, 309 bp, Glycine max
  Peptide Sequence Number=SeqID_120276
atgaatgaaggtgtggaagtaccatatcctgtggtaccttccaagaaagaaaaagatcgtcatctggcgagatttttagacattttcaggaaactagaaataaccatgccctttggagaagctttgcagcagatgctgtcgcaacctaccctattgcgggtgagcgaggcgaggcacacgggtgcgtcttccataggaggaaaatgcgtggagtcgccactaacgtttattgaaaggaaaacgttagaaaaaccaaaggaaaccggtcatgaagaatattccagattcggaagttatctttacgtttga

SEQ ID NO: 28592 - DNA, 115 bp, Glycine max
  Peptide Sequence Number=SeqID_120277
atgaggttatgtgtagactacttccaattgaataagatagaccttaggtcaggctaccatcagatccgagtgaagtctgaggatattccaaagactgtttttaggacccgttatg

SEQ ID NO: 28593 - DNA, 522 bp, Glycine max
  Peptide Sequence Number=SeqID_120278
atggccgataatctcgccaacggcctcaaggcccgcggagagaccgcggccgtgttgccgatggacggcttccacatggataatgccgtgctgatcgagcgcggcctgctcgcccgcaagggcatccccgagaccttcgacgtccgcggtttcctcgatatcgtccgcgccgtgcgcccggccgatcaggaggtgctggtcccggtcttcgaccgctcacgcgaactcgccatcgcctccgcccgcccaatctcgccacacgatcgcttcatcatcatcgaaggcaattacctgctcttcacgcagggcaaatgggccgatctcgacggcatcttcgatttcaccatcatgctcgccccgccgatcgaggttctcgaagagcgcctctgggagcgctggcgcggctacaagctcagcgaagaagaagccagcgccaaggtttacggcaacgacctcccgaacggccgcctcattttggagaaccgccgtccgtccgatgtcaccctcgagatcgcgctctag

SEQ ID NO: 28594 - DNA, 291 bp, Glycine max
  Peptide Sequence Number=SeqID_120279
tccatgatgattggatgtggaattacctggatgttgtggaagcttgggaggattgatggggacccgtcgttgagaggaacgaggataagggctacgtgggagtacgtgagctcagttggaggtgggcaacaggggatggtgggttatacagtggtacctggagatatgtcgtgggggtcaggagaccttggggacgtcaggcgagctcctggcagtcaacagataaaaggaacaaagaccacaaagcaaggaggcttgtgtggtggctggccagctgtgaactttgattga

SEQ ID NO: 28595 - DNA, 402 bp, Glycine max
  Peptide Sequence Number=SeqID_120280
atgggtaaagcaaaggaggtgcaagagaaggtgaaggccgacatggaggccatgaaagagaaaatggccacaatgatggaggccatgatgagcatgaagaagataatggaagccaatgcggttacaattgccgctactagcactgttgctaaggtgaacccgatgcccccatctggcctcaaccaaatgaatcatccaaccttagatatggtaggcaaagatttgggaagtaggggcggcccccattatgcgcaaaacgagcacgccttcccgccatatggcttgcctctcaactatacgccacccaacctggcgtacactcccaatgaggatgtcaataactccactcctatacccattgagagccaacaaccccaaactgatcatgcacatgtctcttaa

SEQ ID NO: 28596 - DNA, 699 bp, Glycine max
  Peptide Sequence Number=SeqID_120281
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtgcaggcggggcgtaatttttttaaggcagtattggtgcctagaaatatttatctga

SEQ ID NO: 28597 - DNA, 591 bp, Glycine max
  Peptide Sequence Number=SeqID_120282
atgggaacaaatcaaactggaaaaagattctatcaagtcaagattaagggcctagatgtcaccagtcttaaggagttggggcggttgatgggacctctccaaatgcaagccttccgcaaggcgtacggaaagattttagatttgaccatagcggagatattcacggaagccgttgtatcactcacccaatactatgaccagcctttgagatgcttcacgtttggagacttccaattattaccgactgttgaagaatttgaggagattctaggatgtcctcttgggggaagaaatccgtatcttttctccgggtttcttccctcattgagcaagattgcaattgtggttagggatttgttaagggagttggatcgtgtaaagcaaactcgaaagagtgtagttggcctaccacagaagtacttagaaggcaaggcaagggatatggcgaatcaagaggagtgggtcccatttatggatgtattagcattgctaatctttggggttgtcctctttccaaatgtggatggtttggtggacctagccgcaattgatgctttccttgcatatcacaatagcaaagaaagcccggtg

SEQ ID NO: 28598 - DNA, 366 bp, Glycine max
  Peptide Sequence Number=SeqID_120283
atggcggttccaaagtcagaaaagatgcaaagacaagatgaaactaacaagagacaagcggttcctctcggtgtggagaacaatgattgtttgtggtggctaatggtggttgtgggtgatggagaaagtgcttggaactttagaaatgactttggaagaaagaaagaagaagaaatgacacatcttctcaaagatcccaacggtcagatcatggacaagtgtcttgtgaagttgcagaccaaatttcgagaagatccaatggttaacgaaggctggacagcgtttttaccgaggcagcttcatgtagttttctctagaagcttcattaagaggcttcctccagaagcttcctcgtggcttctttga

SEQ ID NO: 28599 - DNA, 360 bp, Glycine max
  Peptide Sequence Number=SeqID_120284
atgagaggactacacgtcctcgccttgagaggactacacgtcctcaccatcagagggctgcacgccctcaccttcagaggactacatgtcctcgccttgagagggctacacgccctcaccttgggactacacgtcctcgccttgagaggactacgcgtcctcaccatcagagggctgcacgccctcacctctagaggactacatgtcctcgccttgagagggctgcacgccctcaccttgggtactagttaccctcaacgtgagaggactacacgtcctcaccttcagaggactacacgtcctcgccatcagaggactgcatgtcctcaccttcgaagggctacatgtcctcacctttaa

SEQ ID NO: 28600 - DNA, 543 bp, Glycine max
  Peptide Sequence Number=SeqID_120285
atgggtcagctccagcggcaagctttttgcaaagcttacggtaaaatctgggacctagtcatggtagaagtctccacagaggccattgcttccttcgcccagtattatgatcagccattgaggtgcttcacctttggggacttccagctatcacccatggtagaagaatttgaagagatcctaggatgtcctctagggggaaggagaccatacctcttcttagggttatatccctcattagctagaatttctaagatagtccaaatctcggcacaggaattagactgcagaaagcaagtcgaaaatggggtggttggaataccgagaaggtgtttggaggaaaaagcaagaaacttggcaggcaaaggcgaatgggccccgttcatagacattgtcgtgatgttgatcttcagaggagtcctctttccaaatgtggaagggttggtggaccaagcagtaatcgacgcttttctcgcttatcatagccacaaggaaagcccggttatcgctatattagccgacctatatgacaccttcgactga

SEQ ID NO: 28601 - DNA, 822 bp, Glycine max
  Peptide Sequence Number=SeqID_120286
atgccggggagcagacaagcccgtcagggcgcgtcagcgggtgttgccgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcagtcacaagctgagagagaggatggtggatattatgttggtgatgatgatgatgatgaggagcaagatcttaacatgggaatagcaacaccttcttcatcgcttccttccattctctctcactcgaagacacaacaacaaatacatcattcgaattcttctatgtcccaagattaccaccaccaccaccaaggaatcttcagcttcccgaatgggttcgaaagatcggcggcggccactacgatgactcaccaagaccctcaccaacagcagattcggagggacaaagtgagggtgcaaggcttcgagccaccgccgtcgcatcaaactttggtacctatagaggaagacgaatcgggaagcctcccggtgtacgaaaccgccggggggtaccgagctcgaattcgtaatcatggtcatagctgtttcctgtgtgaaattgttatccgctcacaattccacacaacatacgagccggaagcataa

SEQ ID NO: 28602 - DNA, 132 bp, Glycine max
  Peptide Sequence Number=SeqID_120287
aatgaccaaattttgtctctgcgtgtcatcgggcccgccgccactggacgacataagggtgcggataaccgtaagggtgcggataaccgtaaagtatctccgcgtgtcatcgggcccgccgcctctggatga

SEQ ID NO: 28603 - DNA, 285 bp, Glycine max
  Peptide Sequence Number=SeqID_120288
atggatccttcctcttccacttcttctcatcactctgattcagattggcctattgcctttaggaaaggtactcgatctactcgtaatcctcatcctatttataatttcttgagttatcatcgtttgtctcctcttactgttcctaccaatatttatgagacacttgatcatcctaaatggcgacaagccatgattgatgaaatgcaggctcttgaaaacaatgatgggtctatactattaaggtcgggaccaatggtgaggttgatcagcttaaggctcgattag

SEQ ID NO: 28604 - DNA, 252 bp, Glycine max
  Peptide Sequence Number=SeqID_120289
atggatttcaacagtgatgatttcatggacaaattgcgtgaagccttaaggaacgttgacttgagagatgaacgatggaggcctagaaggggtgaaccacgtccaaacgtggatgagttcaaaatcaccgaactacctgaatttaatggtagtgcagacccggaggtttatctagaatgggagcgcaagattgatagaatgctagaaggacacgagatggaaaggagaaaatccactcttgggagtccttga

SEQ ID NO: 28605 - DNA, 350 bp, Glycine max
  Peptide Sequence Number=SeqID_120290
tcaggacgaccaaaggtgcagaagacgatgttagtcaccgcccgtcaactgactcatttgcccctggttaacgaatggtgcgggaaaccccgcatgtcacctgacttcacgggtcaggatgcacaaatggtgtacgaagatgatgctaatctccgcgcgccaaggctcgtttgcccctggttgaccaaaggtgcgggtaaccatatggtagccccgcatatcacttggcttcacgggtcaggacgacaaaaggtgcagcagacaatgtcaggacgacaaaaggagcagaagacgatgttagtcaccgcccgtcaactgactcatttgcccctggttaacgaatggtgcgg

SEQ ID NO: 28606 - DNA, 222 bp, Glycine max
  Peptide Sequence Number=SeqID_120291
atggagcagtatttacgacatattgttcgccagcaggcagccaaccaccgggcacatagccagggctttgcttctttttcatgccctactccagaccagttcagggcagaggtcgcatggcccggggattggcccgaggcccaagtaggagaggcgcccccggaagttcccgcgcgacggagaggaggcccacgagcacgaggagatggccgatttgcttga

SEQ ID NO: 28607 - DNA, 642 bp, Glycine max
  Peptide Sequence Number=SeqID_120292
gaaggaagaatcggagttcttatttcgtgcggaggatttccaaatgttcccttgttggggacgaggggttgcatcagctacaatcgcgttcttgctacaagacaacttggctaccttatgagagggtcgccactagaggatgagctcacgcctgtcatttcacgaggtttcaataagaccaacatggagacacttcagaaggtccgcaaggcatgggaggtggtaaaaaagaaggacaaagagctcagaggtaataacaatgggcccattggtggctaccatgagtggttgaaagcccacgtgcaaggtttggattggctcccaagtctgagaactgctaagagggagaaagatgaggcaccggaggaagacgaagaggtgcaggcccttaggacggaactcaagcaagctcaaacagtcaaagaaaggttcaaatcagcagctcttaaaatccgaaagaagaatgccgaactaagagatataaatatagctaccaccaaggctttggaacaagagaccaagagggctcgtagggaagagcacggccggaacaagttccgaggggctctgtggggtagtaacaacgagcttaaactccggagggaggaaagggaccaatcgcgagtagacaggatgagttga

SEQ ID NO: 28608 - DNA, 369 bp, Glycine max
  Peptide Sequence Number=SeqID_120293
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccctcaagctcatgcggaaagcattccgtacgaaggaggattag

SEQ ID NO: 28609 - DNA, 192 bp, Glycine max
  Peptide Sequence Number=SeqID_120294
atgtgtaattggatgcatcgcacattagctcaaatggggctgtccaatcagtcaaactccacttccttttgcaacaagttggatgaatggaaggactaccttgctaaaatctcttataaagcgcttgtagaatcctgcatgactaagaaaagatcgcacctctcgcacgcaagaggggtaaggcaattgtga

SEQ ID NO: 28610 - DNA, 291 bp, Glycine max
  Peptide Sequence Number=SeqID_120295
gaaaaatgggcaagattggtgaagtgtagaatttatgaacgcgctaagccaggccacgtgctgggcgagccatctgctaagcgcaccatgctccggctaagtgtgcagaagaatctggaagaaggatgtgttgcacagagagtttttggctgtggagagactgagaaagagttgagcttgacaaggaagccatcttacggagctttggatgagattttgagagattgtgaggaagtttccctgctatggagagctaaatcctcagttggttcttcctatggggtacttgat

SEQ ID NO: 28611 - DNA, 264 bp, Glycine max
  Peptide Sequence Number=SeqID_120296
atgactaaagcacgtcaaaagggggtacggaaagaaaaggaaggagatgcttgcctcccagctcgccaaggcgagctaggttgcttcctccagaagcaaccgccttctggaggaacatcctggaaggcccaagtggattacgtaatcatcccttttcctccttccggaatgttacggaactttacgaattgtgcatttacacttccttttgacttccggcatgtcacgaaaattcatgggttgtgcaacaatgctttcttttga

SEQ ID NO: 28612 - DNA, 351 bp, Glycine max
  misc_feature (339)..(339): n is a, c, g, or t
  Peptide Sequence Number=SeqID_120297
atgttgtccttcagtcagatgcagtcccagtttcaatctcaaatgcaatcattgggacttgcactgcctcctgagcttgaggttggtccttcagctgctcgtgtcagcacaaaggagagttgtgttgatccctcaaggaataatccagacacgggtgactcagagaaatacgggttgtacattaaagaaaatcttccccaactggttgccctaggaagactttatgaggggtcgacaaccgttcacaacatccctttacgacctgatcaagtccaggttggtgttgaggaagttagagatgccgatgctcccattcctgtacccactcaagaggttctngtagtgggatag

SEQ ID NO: 28613 - DNA, 1030 bp, Glycine max
  Peptide Sequence Number=SeqID_120298
tctcaacacattcctggagacacctgtggtattagctgagggagagactctacccgcctactccaaatactgcaggttgcctacagacttcagagagatagaggctgccttatgcatacctgaccgagggttcattttgaactctgagggccaacctggaaagattctcaggaaggatctaactacactagctcaggtgtggagtgtcctctcatactccaacttggcccccacatcacatacctataatttgacaattgacagagctaagctgatctttggcctagtctctcacttggatatgaacataggagcactgatctctggccagatgacctctatagcccagtctaacacctctagacttgggctccctgctctaataatcgcattatgcagatccagaggggttgtctctaacagccttaccttcgagcgcctgagtccggatctaacagtctctatccgaagggctaggagggcgagggcaaggccagctgagcttccttttacttctgcagctcctactccagcatccacttcagcagccgcttttgtcccagctcaaaaaaattctcagcgctttgaagccatgctccaaagcattcatcagggacagatcattttactacagagtttacagattatggcacctccggactttattcctacaatagagcagtttaatgacatggtagcttggcccagcacccaaccttttcttcataaggaagacaaaggtcccacagcccaggtacctcagcatatggaggataagtcatctgaggccaccatcctagagccatttgatataggagaagaggcagaggagacacaggtgagacaggtagctgctacaactcctgagcgatcccttgcggctacttcagagccttctgcactagtggtaaacctaccctcacctcagcctgcagtagacccctccactcctcttctacagatgccagaggacccaactacaccagttctagctatggacacttctcctcccactactctagtgctttag

SEQ ID NO: 28614 - DNA, 897 bp, Glycine max
  Peptide Sequence Number=SeqID_120299
atggcggcgatatattctggtgctggccggcgaccatatctacaaaatggactatggccagatgctggccacccatgcacgcagcaatgccgatatgacgattgctgcattgatgtgccgcttgaagatgccaaaggattcggggtgctggaggtggacgccactgatcgcgtggtggcatttgatgaaaagccagcccagccgaaatccattccggatgatccggccaaagcatttgcgagcatgggcatctatattttcaacgccaagttcctgtatgagcaattgattcgcgatgcctatgcacctcactcccatcacgattttggccaggatattattccttacatcattaacaggtatcacgtgcaggcacaccggttcacagagagttgtgtcggggcgcaaagtggcaattactactggcgcgatgtcggcaccatagatgcctattgggaagccaatatggaactgaccaaagtgattcccgaactgaacttatatgacagtgaatggcccatctggacataccaggagcaactcccgcccgccaagtttgtctttaaggatgaagggcgtaccggcaaggcgacagattcgctggtttccgggggttgcctgatcagtggttcctgcgtgtctaactcggtcctgttttctggtgttcacgtcgctgattactgtgacctggatggtgccgtggtactgcctaaagtgaagatcaacgaaggcgtggtggtgaagaatgccgtgattgaccgcggttgtgatattccggcaggcatgcatatcgggattgatctgtcgcgtgacagcaaacgctttcatgtgtcggaaaaaggcattgtattagtaacgcccgatatgcttgggcaggatttgtatcgtgtgaaataa

SEQ ID NO: 28615 - DNA, 384 bp, Glycine max
  Peptide Sequence Number=SeqID_120300
atggcgcctaccagacaccctctggacccagataagtccaacagggccctgggatttccagcgctgatcacgggcctctgccagtcctacggagttcccgtcacccccagtaaagtaatccgatcgctgatcacccgggccttcatcgagaagtactgcacgcctaggcaggcgcagggtgatgcacatcaggccacagatgcaccgccaccacctcggcaggccgatccagctgggtcacaagcggccaaccaccgtgggcaggtgcagatacacgagtgtctctaccggttcagcctcagtcagcaggggcagggttccacctcttttgcatgccctactccagagaagtttggggctgaggtcgcatggcctggagactag

SEQ ID NO: 28616 - DNA, 127 bp, Glycine max
  Peptide Sequence Number=SeqID_120301
atgggtgagacttttgatcggcccctaggttcacttgaggctcatgcacggtgcccctcattgccccagtgtaaggctttgaggtttatgcatggggcctttcattgccccagtgtagggcttagag

SEQ ID NO: 28617 - DNA, 709 bp, Glycine max
  Peptide Sequence Number=SeqID_120302
cattccccaacagctctcagagatttacgaaaccattccaaaggctctgcttctccatggctacctcaccaaaagatacttcatctcctggttcaccctctgtaccatcatctccatcatccaccaaagcaccatcaaaccaggaacaacctgaattccatatccaacccatacaaatgattcctggtccagcccctgttcctgagaaactggtccccaaaagacaacagggagtgaagatttctgaaaaccctagcattgaaacaagtcctagggaagtagacacggagatggataagaagatccgcagtcttgatgttccaacatcttccaccccaaatgctgaagtcctctcttcatccagtaaagaggaatcaacagaggaagaggatcaagccacagaggagacccctgcaccaagggcaccagaacctgctccaggtgacctcattgacctagaagaagtagaatctgatgaggaacccattgccaaacacacaccaatcactcctaccacctccagatggagcaaagttgcaatcccttccaagaagaggaaagaaatttcctcatctgattctgatgatgatgtcgaactagatgttcccgacatcaagagagtgaagaaatcagggaaaaaggtgcctggaaatgtccctgatgccccattggacaacatttcattccactccattggcaatgttgaaag

SEQ ID NO: 28618 - DNA, 1224 bp, Glycine max
  Peptide Sequence Number=SeqID_120303
atgcacgacttcggagggctacacgtcctcaccttcagagggctgcatgccctcaccttcaaaggactgcacatcctcacctttaaaggactacacgtcctcaccttcagagaactacacgttcccacttttagaggactacacgtcctaaacttcagagggtttcacgccctctcctttagagggatacacgctctctcctttagagtactacacgtcctcacctttagagggctacacaccctcgccttcagagcacaacacatcctcgccataacagggtcgcgtatcctcaccttcagagggatgcacgcactcgccttcagacgactacacgttctcgtctttagagggctgctcgcccttgcctttagaggactacacgtcctcgccatcagagggctacacgtgctcaccttaagaggactacacgtcctcgccatcagagggtcacatacccacactttcagaggactacacatcctcgccatcagaaggactacatgtcctcgccttcagaagactacacgtcctcgccttcagagggccacatgtcgttgcctttacaggactacatgcctcgccattagaggactacacgacttcaccttcagagggccacacgtcctcgccatcagagggcttcatgccctcaccttcagaggactacacgtcctcgccttcagaagactacacgtcctcaccttgagaggactatacgtcctcgccttcagaggactatacgtcctcgccttcagaggactacacgtcctcgacttcagagggctacacgtcctcgccttcagagggctacacgtcctcgccttcagaggactacatgtcctcgccttcagaagactatacgtcctcaccttcagagggctacacgccctctccttcagagggctacacgctctctccttgagaggactacacgtcctcggcttcagaggactacacgtcctctccttcagagccctacatgctctcgccttcagagggctacacgtcctcaccttcaaagggctgcacgccctcgccttcagagggctgcaagccctcgccttcggaaggctacacgtccgcgccttcagagggctacatgtcctcgccttcagacgactatacgtcctcatcttcagagggctacacgccctctccttcagagggctacatgctgtctccttgagaggactacacgtcctccgcttcagaggattacac

SEQ ID NO: 28619 - DNA, 79 bp, Glycine max
  Peptide Sequence Number=SeqID_120304
atggctacacctatgagtactgcttgctatttagataaagataaaaccggtagatctatagacatcaagcaatatcgag

SEQ ID NO: 28620 - DNA, 564 bp, Glycine max
  Peptide Sequence Number=SeqID_120305
atgtgcagcgccaccgattacaaagttaaatcaatcggaggtgtgtgcatcttaatccaaatgtgggcatgggaacgatgcacgactttgactccaaagaggatgcctcccgtaatagaaaataaaccactcggacacaggtggctgcgacaaggaaatcaacatattggcaatgatgatcttagagttttccttcgcaaattggatctaattaaacgacatgaggagccatacacaacaactgtgatggcaacgttgcctcaaatttgtgtggttggaagtgtagcctggttcgcggtggtgccactgatttgtttccatgttgttgagtggcaccaacccgatagagttttacaacaatttggattgcaaaaacctattcccggatgtccttcgcaaccgcagaatctccatggcataacactgaaaggcaaacaagacgaaaattggttccacctattggccccgatcatcagtcaatggaacaatagagctgagtttagggtcgacgtttatcctcgacaggagggcctactgggttttaactcggacaacatggtgtga

SEQ ID NO: 28621 - DNA, 345 bp, Glycine max
  Peptide Sequence Number=SeqID_120306
atgaacatgaatggtgataagaagaagaagcgtcgtaggaagaagaatatgaacaagaagtgtcgtaggaagagcaagacaaagggttgtaggaacaggaagaggaagaagaaggccgtaggaagagaaagaagaaggatgcacgtatcgtatggacgaaactgtagctttatttatattattagggtgaaagacatttttgccatttcaccctacgtgcagggtgccccggcaaaaatgctgggtgcaccaagtaacaccctaagatggatcagtgctttgaagatgttcggtttttttgtctttttggtcgaaagatgcttaggcattttagtcccaaagtga

SEQ ID NO: 28622 - DNA, 1086 bp, Glycine max
  Peptide Sequence Number=SeqID_120307
atgaagttcaatccaaaatcaaaaccaccaccccacttattatactttctaataatcctctccctatcgttctttttcccgtgtgtatcctcctctagaaaacaacaattcaaagaagcccctcaattctacaactccccaaactgcccctccatcgaacaccacgacatattaagctcctccgaggaagccgtccacgtggcaatgacactcgacacgacatacatccgaggttccatggcggcgatcctctccgtcctccaacactcttcgtgcccccaaaacaccttcttccacttcgtgtgctcctccaacgccaacgccaacgccaacaccaacaccaacgcgtccctcctacgcgccacaatctccaacgcattcccctacctgaatttccaactctacccctttgacgacgccgtcgtttcaaacctcatctccacctccatccgcgccgcactcgattgccccctcaactacgcgcgcagctacttgccaaacctcctccctccccgcgtgaagcgcgtggtgtacctcgactccgaccttgtactcgtcgacgacatcgccaagctcgcgacaacctcgttgggacaaaacagcgttctggcggcgccggaatactgcaacgccaacttcacctcgtacttcactcccactttctggtcgaacccttctatgtcgctaacgttcgcggagagaaaacgaaaagcgtgttactttaacacgggggtgatggtgattgatttggaacggtggcgcgaaggggattacacgaggaaaattgaggagtggatggagcttcagaagaggatgagaatctatgaacttggttcgttgccgccgtttttgcttgtgtttgcggggaacattgtttcggtggatcataggtggaaccaacatggtttaggaggggacaattttcgaggtttgtgtcgggatctgcaccctggtccggtgagtttgttgcattggagtgggaaagggaaaccgtggatgagattagacgctaatagaccttgtcctttggatgcactttgggcaccttatgatctattgaaaacctcattttctttggactcttga

SEQ ID NO: 28623 - DNA, 858 bp, Glycine max
  Peptide Sequence Number=SeqID_120308
atgggttggcttagcagaatttttaaaggctccgatcataataagctttcggaagggcattactataaagaggatgcgggttattacttgccatccacttcgggggatgcttggaaccagagccagaaccagaacgagaatgaagatatcgatcgtgctattgcactgtctctggtggaagagactcagaaagcaaacaacaatgtaaatgactacagatcacaattagaagaagatgaacaacttgccagagctatagaacaaagtctaaatttggagtctcctcccagatatggaaatgaaaatatgtatcaaccaccaattcagtatttccccatggggtccaggatttgtgctggctgctatactgagattggttatggacgatatctgaattgcttgaatgcattctggcatcctgaatgcttccgctgccgtgcttgcaacctaccaatctctgattacgagttttccacatctgggaattacccttatcataaatcatgctataaggaaagctaccatccaaaatgtgatgtctgcaagcacttccatataaagactaaggaacgtcaaaccataagacctaaccactctcaaatttgtgtcagccaacattcccatcatcttgttaactttatccaaaccatcacaaaaaccacaacatttccagcttctgctactgtgaagcacaccctgtaccatgaccatccatctgctatatctgccaaatatcgcctacacaccctgcagcaatcacctcactgctcatcaccaccacaaagccgccttcaatctcaattctcaactaaacaacacctctcctttcacagtgagcaccacctcctcaatggatag

SEQ ID NO: 28624 - DNA, 1395 bp, Glycine max
  Peptide Sequence Number=SeqID_120309
atgttccacaacaacaacaacaacagtgtgtcgatctccgtctcggacgacgaacccgacgagctgggtcggatgcggatccgcgcgcggcggaagcggaagaaactcgggaacagacgattggtgaggaagctgctcctcaaatactggatgcttctcatcattgttcccgccctggctttgctcgttttcgaggccacccgaattgcccgaagtcccagttcaaacacagaaacgcgcaacaataaagctgatagatcgcgcaaggaaccccctgcaaacttgaatcgcctcgatcctaccacccatgttgtcgctggtgtcagagaacgttgcttgaagctcctaccacctgagaagcttgagcaactggatatccctgtggaagaagaatcttctagtgttcctgttggtgaagttttatacatgtcagagagtgataggtcttttgtaggagggagtgttacgttgtctcaattgcgtacagaggacacgaggtttaatttgtttactggaaatcaaacatttgaccagagagatcaaagttttgaggtgaaagaaacattggcggtacattgtgggttctacagtgtgaatggagggtttaagatatctgatgaagataaaagttacatgcaaggttgcaaagttgttgtatctacttgtgcatttggtggtggagatgatctgtatcaacccattggaatgtctgaggcttcgcttaagaaggtttgctatgtagcattctgggatgaaatcaccctaaaagcacaggaattagtggagcgcaggattggggaaaatggattcattggaaaatggcgtgttgttgttgttcaggatcttccttttgccgatcaaaggttgaatggtaaaattcccaagatgttaagccatcgcctttttcctcaagcaaaatactcaatttgggtagactccaagtcccaattccggagagacccactaggtgtgttggaagcactcctttggcgcacaaattcattacttgctatatcagaacatggagctcgcagtagtgtctatgatgaggctaaggctgttgtcaagaagaacaaagccaagccagaggaagttgaagtgcaactgaatcaatacagaaaagatggcttgcctgaagacaagagatttagtggaaaaaaagctctatgtgaagcctctgttattgtgaggaagcatacaccagtaactaatctattgatgtgcgtctggtttaatgaggtggttcgcttcacttctagggatcagctcagcttcccgtatgtcctgtggcggctgaaagcattcaaaaacatcaatatgtttcctgtttgtactcgcaaggatcttgtcaatagtatgggccatgtccgcaaggccaaacctttgcaaagctga

SEQ ID NO: 28625 - DNA, 723 bp, Glycine max
  Peptide Sequence Number=SeqID_120310
atggaaaaaaaaaacgtggttaggagaagagatcccattaaagatggccggtcaggtttctctgtagggattagtcatcaacaaggttggtggatactccgccccgatgtcataggtgatataatttcagatgtaggagttcttgaaaagcactggcctcttactttgttttttcttaataacttttcttatgtccagatagaaacccgcaataacaacctggaaatgcaatcagtaaataacaaatctctcattgaagagcttgataagcttcttgagcgattgcgtgtcccttctgagtatgccacaaatttgactggaggttcatttgatgaagctcgaatgcttcaaaatgtagaagcatgtgaatggttgaccagtgccttgcgtggtcttggagtgcctaatctagatcctagttatgcaaacatgagaactgttaaagagaagcgtgcagaacttgaaaaattaaaatctacttttgtcaggagagcctctgaattcttgagaaattattttgctagtttggtggacctcatgataagtgataaaagttacttttctcaggaatttattggtatcactttttcttcttcctctgaacagcgggggcagttaaagaggcctgatcatgctgacctgcggtacaagtgcaggacatatgcacgtcttctgcaacatttgaaggttaaaatttgggattcaggacctgtttacttttag

SEQ ID NO: 28626 - DNA, 303 bp, Glycine max
  Peptide Sequence Number=SeqID_120311
atggtgaatgatgtgttttatgtattgttgagttgcctgcggagggcgatatccacttccaatatcagttctgctgtcacggttttgagtggtgctagttgtttgcttggcaatgaatatcatgaagccttgcagcacaaattaataagagaggcaaaccttggtgcaaaggtacttcccgcacaggctgatcgagaaaaggtaaaatcttgtttgactgaattggcagatagcaacaatgctttcaagcaagctttgaatactggcacagaacaacttgtggcaactattaacctcgaataa

SEQ ID NO: 28627 - DNA, 75 bp, Glycine max
  Peptide Sequence Number=SeqID_120312
atgaacaatattggcacaaaacatgacccacctgtccaatatcagcattcccaaatgggtcctatattcgcctaa

SEQ ID NO: 28628 - DNA, 508 bp, Glycine max
  Peptide Sequence Number=SeqID_120313
atgtcgcaagaacaatcagttccgtttgctgggaagtggcaccactttacagtcaggactgatggagaaaaggtggttccagaaccacatggtgacgccgaacaaacagaagcctgggaatcagaggtgatgatccctttcgcagtggaaagaacagtttacgctttcggtggacccctgccagaccaagaatcactttcgagtgcaatgaacaaggtatttccctgctacccaacttgcgaacctaggatttttgatagtgagccttacaactttaattgtttaagcaaaccccacaaactctttcgatccgccccgtcaatagcccatagggattacctaccttggcttgatcgagtcgaacaagcgtatgaggatttctggaagacatatggcatctttgatttgatacaattctctcgatctggtcctgaatatcgaccagaaatgctgatagcagctatgcactttttcgagtcttctaccaacacctttcaatttaaatgtg

SEQ ID NO: 28629 - DNA, 1647 bp, Glycine max
  Peptide Sequence Number=SeqID_120314
atgggtgaagagcaccacaaccatccaccgccaccggttcaggcacctccggcaggtccaccaccgccaaatctagcactttctagaggccccgtttggcatccagctgaacaactctcgcagcttcactattgcatccactcaaatccttcatggccggtggcaattctactgggttttcagcactacattgtgatgcttggaacaacggttctgattgcaaccacactggttcctgcaatgggtggggaccatggtgacaaggctcgtgtgattcagtcattgttgtttatgtctgggttgaacacactgcttcagacttggtttgggtcgaggcttccaacggtgatgggtggatcatttgcttttttgcttccagttttgtccataatcaatgattacacagacaggacattcccttctgagcatgagaggtttatctacacaatcagaacaattcaaggatcccttattgtttcttctttcgtcaatatcttccttgggtttagtaagacgtggggaaatttgacaaggttgtttagtcccataatcattgtacctttggtagcaaactgtgtgcagattggattacctatgctcattctactggtcataatacaacagtatttgaagaggcttcatcatgctgctcttcaagtacttgagaggtttgctttacttctctgcattgctgtcatctgggcatttgctgctatccttactgtggctggtgcatacaatactgctaaatcacagacccaagtgagctgtcgcacagatcgctcgtaccttatgtcttctgctccttggattaaagttccgtatccgttccagtggggtacccccatattcagagctagtcacgtctttgggatgatgggggcagcacttgtctcttctgctgagtcaactggtgctttctttgctgcagccaggctttctggtgcaacaccaccgcctgcacatgtgctcagccgaagcatcgggatgcagggcattggtatgctgcttgaaggcatatttggttccattgttggtaccactgtatctgttgaaaatgttggcctacttggtctgacacacatagggagccgaagagtagtgcaaatatcatgtgggaaatttggagccttttttgcatcgattcccctaccgatatttgctgccatatactgtgttttatttggtatcgtggctgctactgggatttcttttatacagtttgcaaataccaattccataagaaatatctatgttctgggcctaaccttgttccttgcgatatcaataccacaatattttgtcatgaacactgcaccggatggtcatggtccagttagaacaggtggtggatggaagttcaggcaatatcttagatgcaatttaccagtccccaatgtgaagaacgaatatggctccacctggatgtttaatgacattttgaacaccatattctcttctgccccaactgtggctataattgttgggactcttgttgacaacacacttgaaggcaaacaaacagctgtggacagaggacttccatggtggggtcctttccagaataggaagggagatgttagaaatgatgagttttaccgtcttcctctccggataaatgagtacatgcccaccagatttctctaa

SEQ ID NO: 28630 - DNA, 180 bp, Glycine max
  Peptide Sequence Number=SeqID_120315
atgggaggaggtgttggaggcaaaatatggaggttggagaggtctcttgagggatgtgcaagacacgacctctcctatacttctatctcaattcaaccatcctctcatgtaattcctgtttgcactaaagattgtccaaaaggaatatgttctatgcagaagacaaattacacttggtaa

SEQ ID NO: 28631 - DNA, 588 bp, Glycine max
  Peptide Sequence Number=SeqID_120316
atggagagggtggtgggaggggaagagcgcttcccaattccgttgcttttttcttttccattttctccgcaacaacaacgttttctcttctccactcacaatcgccactccttcgacgaagccgttccaggttgcagcgccgtttaccaacacgtgctcaagttccagcgtccaccgaccattcggtggagcccgcacctcgagaacaccgctagtttcatcggcaccgtcgcccgcgaaccgacgcgcgttaactcaacaaccggtaaattcggagtttacaccgtgcttaagttagaggtgaaggagttcgagtttgttgctcaaagttctggttatctaggtgacaagaaattggaatctgttgaagtgtttttttccaatccaaatgagtggtgggatcaaagaaagagcaagcgaaatccaaaacagcctgattttaagcacaaggataccggcgaagctctgtggctaagtgagtatgatcctccatgggttaaaagacaactccaattgtttgactcaaaaattgctggaggatctgcaggtcgtcgttcacgtgtcaccaactgggtttatgatgagtag

SEQ ID NO: 28632 - DNA, 309 bp, Glycine max
  Peptide Sequence Number=SeqID_120317
atgaaggtccatgagttgggcaacataacctcgttcatgaaccttctttatagatctactcaaatggagtttgttgaccatcttagtggcaatgggagggtggcgatttctagctctagcaatggatttgtgaaatgcgctcatcttcctcccacaaaagttgctgaacaaatgcactcttccaataatgagaaaacgatgaggagaaggaggaaccaatttcttgctccaaggaagctcgtgccaaagttggtggagagtgtgaaacaaaacccgcaacttctgaaccagatgacaacattcgactag

SEQ ID NO: 28633 - DNA, 141 bp, Glycine max
  Peptide Sequence Number=SeqID_120318
atggagccaaggatgaaggtgaagatttggatgaagatatatctatcgaggagggttagtctatggatgaggaggaccatgtcatggagctggggcgatgaagaagactcttcacaagactcttctgatgagtcttactag

SEQ ID NO: 28634 - DNA, 1366 bp, Glycine max
  Peptide Sequence Number=SeqID_120319
ggctcagaaacgctcttatggagaagcttcttctatggctacaaatcttggtggtgatgaacatttttcgaaggtttatgttgttaaggaacaatccgggttgatggaaggtgacaaagtgaaggctttgccgggacaaccatctcaaggggtggattttgatcaatatgctggctatgttacggtcgatgccaaggcagggagagcactgttctactactttgtggagtcacctcacaatgcttccaacaggccccttgttctatggctaaatggagggcctggttgctcttcctttgggtatggagccatgcaagaactgggaccttttagagtcaacagtgatggaaaaacactttacagaaatcaatatgcatggaacaatggaactgatgagttacttcaacaattggcagtggcaaacgtgattttcctagagtctccagcaggagttggcttttcatattcaaacacttcgtctgactacacaaaaactggtgacaagagcacagccatggactcttatacttttcttctaaactggctcgagagatttccacagtacaaaactcgagacttgttcatcactggagaaagctatgctggacattatgtccctcagctagctgacactattctcacttataataagcttacaaatcacacagtgatcaacctgaaagggattgcggttgggaatggctggatagatgataatatgtgtggaaagggaatgtatgaatatttctggacacatgctctgaactctgatgaaacccatgagggaattcaaaggtattgtgactttgaaagcggtaacttaacaggtgaatgcagcaaatatcaaagtagaggggatactgagattggatccattgacatttatgacatatatgcccccccttgtgattcagctgcaaaaaaacctggttccagtcctgccactaactatgacagcaattttgacccttgttctgacgattataccaattcctacttaaatctcgcggaagtgcaagaggctctacatgctaaagcctcagtatggtatccttgcagaggggtgggatggacagatagcccagcaacaattctaccaactataaatagtggcgatacagatgggcgtgttcccataacatcatctaggtattcagtaaatgccttgaaacttccagtggagacaacatggcgtccatggtattctagcaatgaggttggaggatacttggttgggtacaaagggctcacactaatcactgtaagaggagctgggcacatggttccaagttaccaaccgcagagagccctaaccatgatctcatttttcctacttggagaacttcctcctgaattcacctcttag

SEQ ID NO: 28635 - DNA, 3732 bp, Glycine max
  Peptide Sequence Number=SeqID_120320
atgtatagattctgttttagaactcgaccccttcttcgcttccatcttcatcgcaacatttcttcttcaagaaaacctatcatcaatccaacaaatacaactttagaaaattcccaaattgcccctcagccaaataccgatcaccgccacacgctctctcccgtccattccaaatctctctctcgcatcttcgtagttgctctctccgccgtctccatctccgccgtcgtcgcctccgccgcgctcctctccgattccgatcgcggcggaggaacgaatccactgtacgagggcgcggagcgcgccgcgcgcaaggcggcggactcctgcgaccggatcttccaacacgcgaagcgcaccggcgtcgccgccgcggtactctggaagtcactgcggtcggtgctgtcctcggcgaaccacgaggtccgctccggcttcgagattcgcgtcgcggcgctgctcgcggacatctccgccgcgaactccggccgcagagccgcgatcgtcggggcaggcagcggcgccgtcgtggactggctgctggattcggtggcggttgcgaaggacggcggcgccacgcaggcggagtccgcgagggcgctggcttatctgattgcggaccctaacgtgtctgcggcggttcttgggagacctcacgcggttccgagtcttctgaggttcatcttctcgtgccagcctcggcgttctaagaataacaaggaaataaagagggagatggaaatggaggtggaaaatgggatggaagacaaatttattgtagaaattcaagcttcactcaagatgctgagaatagtgtcttttctgattttgacattggtgcattcaagacatagtgcatttgatatttctgattctttgaaaggcaggagcatgcttgttgctgccattatggatatcgttacatccagttgtgacaatgctgaagaggtatcttttaagccatcattgcctggaaatgctgaaatcagagacattgctgcagccctagaagttattgaggacgggggtttgcacttggatgagccacctgaaggtgaagatgatggtggtgggtcgggaaggaaagggattggaatcaagatacttgaaggtacccctgttttagggctttcaaggaccaatagtgatgcttgtcacgaagaactgaagcatcaaactcctaaaactctcatatatccaaataagtatgacaattcaccggaacaaaagaatgtgtcttctgctgttgttcctggtctctgggatgatttgcactgtgaacatgttgctgttccttttgccacctgggcattggcaaattgggcaacagcatcacagttgaatagatctcgtattcaggaactggatcgagatggaaatgctatcatgtctgctttaatggcaccggagaggtctgttaaatggcatgcaagtttggtggtgtggttgctattagaagatcgcaatacacctttgaatgaatctgtttctgattgggcttccagtcttctttctactatatctcaagcatgcaagcatgaagacgtttctttggctcaggtagcttcatctgcctttctcttatctgttgagaggagccctggagtgcagaaggtagtgatggagaagggtgttaatccaatgagagacatcgccaagcagatgacaaagcataagcaggttcaagaaccaatggcaaaggcattggagctagtttgtactggggagctgcgtttgtctcttgaagagagtcaaaaatggtcaggcattcttcttccttgggtttttggaaaattttcctctgatactatacgatcttcagccataaagattctttctcagatcttggaagactatggaccaacatgtgtaccactttctcaaggatggttagccatgatgctgtctgaagtacaaagttctataaagaaatcaaatgataaaggaaccaaccaacctaagagtgataatgtaaagacgttaatcaataatgcaaatattgcttctgctgcacaagttgccaatcaactatctagtgccgttgttaatctggcagctaaacagttgggaaatgcatctaattctggggatgcatccccactggcagattttctgtctctggaacctttagcaggaccatttagaagtttaaaaaaagataatcttcctaaattagatgctgcagattctgccttggcaaccctgaaaggaattaaagctttgactgaagtttgtgctgaagattctgtgtgtcaggacatgatagttgattttgggattttatgtttgctgaggcgctttttattgagtgatgattatgagaaactggctgctattgaggcttatgatgcatcatctagagcacatgaggggaaggagcggatatcaaatgtagatggggaaccggctatatcagatgtaaatgatccagctagtgtccgagttcctcctacagctcatatccgcaagcatgcagctcggttattgaccatcctctcactgcttcccagagtcaagaaggttatcacagttgatgaaacttggtgcaaatggcttgatgattgtgctaatgggcggattccaggttgcagtgaccttaaaatgcaaagctatgccagggcagcacttttaaatatgttttgcaatgaccagcctaatggaaaatctgaaagtggaagaggaggcccttctgatggtggtgtaaaaaattataggaactcgtgtcctcgttatgatgacatgatattcttgataaattctcatcttccccactggaaatgtcccaaagaaacagatcaacaagaagctttctcaaaggagatatctctgtttacttctactgaaatgggggatgtaatagaatccgtgaatggcagcaactgttctatttctaatgattcaactaaaaacaacccagatgcagattgccctccactagacatagtttttgtccatggtctacgtggtgggccttacaaaacttggcgtatagctgaggagaaatcctcaacttcatcacctttggtggagaagattgatgaggaagcaggaaagcttggaaccttttggcctggtgaatggctttccagtgattttcctgaggctcggatgtttaccctaaaatacaagactaatctcacacaatggtctggagctagcttgcctcttcaggaagttagttctatgctattggagaagcttgttgctgcaggaattgggaatcgacctgttgtttttgttactcacagtatgggtggcctggttgtgaagcagattcttcataaagcaaaggaagaaagatttgataatctcatgaaaaatacaataggaattgttttttatagctgcccgcattttggtagcaaacttgcagatatgccttggcgaatgggctttgtgcttcgtcctgctccaacaataggagagctaagaagtggatcttcaagactgatagagcttaatgactatattcgtcaccttcataagaaagggttgcttgatgtcctcagcttttgtgagaccaaggtaactccaatagttgaaggttatggtggatgggcctttcgaactgaaattgtaccaattgagtcagcatatcctggatttggggaattagttataaaggaattagttcaaaaattcttttttcacccaagctgtagccccaccaaaggtggaggtctgagctttaagcacccaacttcccagttgaaaaggaagccctcctactaa

SEQ ID NO: 28636 - DNA, 714 bp, Glycine max
  Peptide Sequence Number=SeqID_120321
ctgaagaagaggccagatttgaatgcatcgttgtctgatatatgcatttcaacttcggcagctccaacatatcttccagctcattcctttgaaaccaaaacccaccacggtgtcagcaaattcgaccttatagacggtggcgttgctgcaaataacccggcactggtggccatggcagaagttacgaaccaaatatgtcatgaagggccatgtgatagcttaaatgtggaaccgatgcaatacgacaagtttttggtgatatcattgggaacaggttctcagaaacaagaaatgaaatacagtgctcttgaagcagctcaatggggtatcttgagttgggtaaccacagccaatggtggcacccctttgattgatgcatttagtcaagccagtgctgacatggttgactttcatatctcttcccttgttcgtgcactcaattctgagcataactacctccgaatccaggacgatacattaattggggacatgtcttctgttgacatggctacggagaagaatttgaatgatctcgtcaaagttggggagtcattattaaagaagccggtttcaaaggttaacttgaagacgggcgtttatgaacctgttaaatcttatgaaacaaacgaagaagccttgaaggggtttgcggaacgactatccaaacagaagcaatttcgtaaatctcaaatgtccgctaatgcaaatccttga

SEQ ID NO: 28637 - DNA, 330 bp, Glycine max
  Peptide Sequence Number=SeqID_120322
atgattgcttgcttcgcttatggttttccagagacgcttaaatacgacgtcgcaaaggttgacgtttcggccaagaaaagccttaaaggtggaggtcgagtgcacgtaggagatgtcgtgtgtggtggcataatgatggtggagagggattgtgtgtgcggagccttgaaggtggaggtcacgcgcgtgcacgagctctgtgcgatagttatggtggggactgtgcatggaggagatgggataaggtggtggcgcaatgcagaggtggggatagagggagtaggtgagaagatgggggaagaggaaggaggaagcggaaggggaaaatag

SEQ ID NO: 28638 - DNA, 513 bp, Glycine max
  Peptide Sequence Number=SeqID_120323
atgtgtggtgacgtcgagatgtgtggagaaaagaaaagaaaaggggggactcatagtggttggggacaaaggaaatggagggggacatggtggttaagggcaaaggaagaagaggggtgtagtggttgggggcaaagaaggggaaggacggtggtggttgggggtggaggaaacatgaagggagaggaagagaggaggaaacaagaaggggaggagaagaggaaagagaaatgtgaagagggaggaggaaacatgagagtgccatgggtcatcgcacgtccaatggcattgtgccacgacaccctcgagcgtgtgtgtctattctatcacaagtggtcacgcacgtatgggaaaactgttctgtattggcacgggtcgaaaccaaagctggtactatccgacccggatatgattaaggagatccttttgaaaacgggtgaatggtttgagaggatagacccgaatccttcggcaaccgttttatggagaaggagaggaatggactgtgcatag

SEQ ID NO: 28639 - DNA, 1029 bp, Glycine max
  Peptide Sequence Number=SeqID_120324
atgaccaagtctcaattaattaaaacaattgcaacttatggcacaattaagatatccgaggaatcaaaatggatcgacaaggtgtacgacacatcgaacctagaacaaagcgttcaaagcgaagcacgagcgaaacgtgaggcctatgtaacagtgcttcactcctcggaaggctacgtgtgcggcgcaataacattagcacaaaccctcctccaaaccggaaccaagcgcgacctggtgctcctcctagacagctccatctccgtcgcgaagcgccgcgccctcgaactctccggatggaagatccgactcatcacccggatccgaaacccgcgcgccgagaacggcacttacaacgaatataactacagcaagtttcggttatggcagctaacggattatgagagagtgatctttatcgatgccgacatcatcgtcctccgcaaccttgatattctcttccacttcccgcagatgtccgctacggggaatgaccagtccatcttcaactccggcatcatggtcctcgaaccctccaactgcaccttcgagattctcatgtcgcgtcgccacgacgtcgtctcctataacggtggcgatcaggggttcctgaacgagatcttcgtgtggtggcacaggcttccacggcgggtgaactacttaaagaacttctgggccaacacgacgatagaggcgggtaggaagaacgcaatgtttgcggcggagccgccgaagctctacgcgattcactacctagggctgaagccatggcattgttacaaggactacgactgcaactgggacgtgcaggatcagagggtgtacgcgagcgacgtcgcgcatcgacggtggtggaaggtgcacgatgccatggacgagaacttgcagaagctgtgtaggttgacgaggcaacgaaggatggagttgaactgggaaaggagaaaggctgggaagttagggttgccagatatgcattggaagatcaatgtcacggatcctagaagagctggctcaatgttgattggttaa

SEQ ID NO: 28640 - DNA, 702 bp, Glycine max
  Peptide Sequence Number=SeqID_120325
atgggtacgcctattgttccatccgttaatagtattgttccattagaaacacaacaagttgttaatgacgcacacagcaatccggtggaagaagtagaaaattatccaaatatagaagaagctgaagatattgaaagaagtccaaataaaagaggattaacttccgctgcttggacccacttcaaaagaaagaaaatagagaaaaaatggaaagatatatgtaaatattgtgaaaagaaacttggtggtgatacaagatcaggttccttaaaatcaaatatggaattttgctcaatagttgacgatgcagacacaagaacgcgaacggatccccatgggaaggggaagacgggacagaaaatacccccaccacagcatggggacgacggggagcatgaaaggttgggggacggaaagcgtggaagtactctccgcccccatcccgcgcggctgtcagtatcaataacagactgctcccagttttccatgatcaatgttcttcacgagaagaagagaaaagagaagaaggaggatgatggtaaaaaagtagtattgaagagtggtaagggtgatgatggcaagaaagttgcagatgtgacaggaaatgaaatgaagtgtgtgcaacgtcacagtttcaattcggagcaagaagctcaagagttagagggacccatcagcctccttgattaccttctaccttaa

SEQ ID NO: 28641 - DNA, 3057 bp, Glycine max
  Peptide Sequence Number=SeqID_120326
atggaggatgttgatgacaagctgccactgccagaaccctcttcagtaagtgctgaattgaagccacaggcagaaaccactgaagaaaatcctgaagtgataaacccacccagtagtcagtcttttgttgaagctcctatcaaccaaattaataataataataatagaatggattctggcactcatttgccagtaaccgagttctctgacttaggagtgtccctaaatgcttttgatggaacagaacaaaaccaccagggagccacagttgcagattctgaacgagggccttcggaagaagatatctttaacaggcagcaggatggtgtttctactgccactgctagtggtgatgttgataatccgatgaatctctcaacttcctcttctgaaagaaaagatttgcagaccagccccatagaactaataacagaaccacctcaaattaagcttactgatgttcccgtagataattcagcttcaactccaaacattacagttcatgtaacagaacaaagtgaccagggagccatgtctgcagagtctgaagctggagctttagaagatatctcagacaggcaacagcatggtagtgatgttgataatcagatggaactcttgacttcctcttctgaggaaaaagagttgcagaatgaccataaagaactaaagattgatccatctcaaaccaaggatacagatgttgctgtaggagctgttggttcacctgctgtcgttgctggcaatggtgctgataatcagataaatcacttggattccccttctgaaaaaattgagctgcaaaatgaccacaaagaacaaaagataaaactgccccaacccaagattgctgatgtgtctagaggagctgttgattcacctgctggcagtgatgataatcaaacaaaactctcggcttcctcttctgaaaaaatagagttgcagaatgaccagacggaactaaagagagatacatctctgaccaatatttgtgatattgctgtgggagctgttgactcgcctacctatgcaaagcagattgctgcaagaagaggccttattgatacagcagctccatttgaatctgtcaagcaagctgtttccaagtttggaggcattgtggattggaaggctcatagagtccagaccgtggagagacgcaagcatgtagaacatgaacttgatttggtacagcaggagatcccggagtgcagaaaaaaatcggtggttgctgagcaagcaaaaacgcaagtactgcaggagctggatagcactaagaggctaatagaagaactaaaacttaacctagagagggcgcaaaccgaagagcgtcaggcaagacaggactcagaacttgcaaagcttagagtggaagagatggagcaaggtattgcagacgactctagcattgcagccagggcacagctggaggtagctaaagctaggtacacatctgctattacagagttaacatctgtaaaagaggagttggaaggattgcgcggggaatatgcagcattagatgttgaaaaagatgaagctattaagagagctgaaggcgctgttgcttcatcgaagcaagtggagaagacagtggaagacttgactattgagctgattgccacaaaggaggcattggaaattgcgcataccgcacacatggaagcggaggaacacagaataggaacagtcatggcaagagatcaagactatctcaattgggaagaggaacttaaacaagcagaagaagaaatccagagtctcaaccagaaaattttgtctgctaaggatctcaaatctaaattgaacatggcctccgctttgctgcttgacttgaaagctgaattaaatgcttatatggaatcaatacctaaccatgaaggtgacaaagacggagtctcaaaaggagagctagagaaaccagagaagaagacacccaatgaaattcaagaagcagttgcatcagccaaaaaggaacttgaggaagtgaagcttaacatagagaaagctaccactgaggtaaattacttaaaagtggccgcggcatcattaaaatcagaacttgaaaatgagaaatcatcttttgcctccatcaggcaaagagagggaatggcatccattacagttgcatctcttgaagcagaactggacagcactagatcagaaatggttttggttcagatgaaggaaaaagaaggcagagagaaaatcgctgagctaccgaagaaactacagcaagcagttgaagaggctaatcaggccaacttgcttgctcaagcggctcgcgaagagttgcgacgaataaaggaggaggcggagcaagcaaaggctggtgcaagtacaatgcaaagcaaattacttgcagctcaaaaggagattgaggccgccagggcttctgaaaggttggcaatagcagcaactaaagcattgcaagagagtgaatcatcatctaggaacaacaatgaattggattcatcctcttgggtgacactttctgtggaggagtactacaatctcagcaaacaagcacacgacgcagaacagcaagcgaatatgagggttgcagctgctaattctgaaattgagatagctaaggagtctgaattgaaaaccttggagaagctgaatgatgtgaatagagagatggctgctagaagggaatctctgaagattgcaatggataaagccgaaaaggcaagggagggaaagttaggcgtagagcaagaactaagaaaatggagggctgaacacgagcaacagcgaagaaatgccggtgaatcaggccaaagaggagtggtgaagcagagtagtaaaaatcctgaggttagttttgaaagacacaaggaagcaaatagcattgaccaaactcgtagtggacctattcctgcacgttacttttccactccaaagtctttttcccattcaaacagtgtagcatccgcagatgcaaaaactggaaagaagaagaagaagtcatttttcccatggtcatctgaacatctcatcctttcggaggcttctgatatattgaacctcggttttggtaaagatatgtga

SEQ ID NO: 28642 - DNA, 72 bp, Glycine max
  Peptide Sequence Number=SeqID_120327
atgacggtggacaaggaagtaggtgaaggtggtggtggaatggtaatggtgatggtagtagtggtgcaatag

SEQ ID NO: 28643 - DNA, 3684 bp, Glycine max
  Peptide Sequence Number=SeqID_120328
atggaagacggcgatacgacggaggaggcggttgtcgttccggtctccatcggcgacgagcaaccgtttcctcattctttgtcacggcaccgcgattcggaggaggaatctccgcatgaaacgttgcgtgacacgaaagcctcaatagagaacatcgtggccgagattctctctctgaagaaccagggaaaacccaaaccactcctcactctccgactcagagagctcctcactcaaacgttccttcacttcgtcactctccgccaggcaaatcgctcgatcttgatggaggaggagcgtgcgagaacggaaacggagcgtgcgaaggcgcctctggaactcgccacacaccagcttcagaacctgacttacgagaagagtcaattcgtgaaagcgataaaggcgtgtaacgattccaagtcgaagtatcctgatattgaagtggtgtcggaggaagagttttttcgcgatgcgccgcaggatatgaaggattctgttttatccaatcacagtgagcataatgtcgttcttaagaggctcaattttgagctgttccagcgcaaagagctttgcaaacttggtgacaaactggaacagaaaaggaaaacccttctggagacaattgcaagccgaaagaagttcttatctagcctcccttcacttctcaagtctcttaagaaagcatccttgccggtgcaaaatcaattaggagttcagcatactaagaaactaaagcagcatcattctgcagagttgcttccaccacctctttatgtgatttactcacagctgttggctcaaaaggaggcgtttggagaatctattgatgtggagattataggaagtgtcaaagatgctcaagcttttgcccatcatcaagctcacaaggagactggcattttcatcactgtggagagtcccaaattggaaaatgatgaacctaatgaagaagatggtcagagacagagtaaaaggccaaggaggtttcaaggcaaggagagccttgaccaggaaggaatatttcaaattcacccacttactgtcaatctccatgtgtatgatgacgagatttctgatcttgagtctgcaaaactcactactctaaagtttgagtacttgatgcagttgaatattatatgtgttggaaacaaagcatctaatgatggtcccgagaatgacatcttaagcaatttattccctgatgacacaggtctcgagcttcctcaccagtcagctaagctctttgttggggatgctataatgttcaatggtgatagaacttcacgtccttacaaatgggctcagcacttagcgggtattgatttcttgcctgaggtggctcccttgctgcttgctagccgtgaaacttcagacagtgatgaagcagccaaagaagctattgctaatgcaaataatgattatgaaatagaaggcagcaacatagagtgcccaatattgaactccaagattgttgtgaatattggagcaatcatagacttgagttctcgagtgggaaaggagcagaagacagcaatggaagttgcaatggaagatgtaaatcgccaaagttgttataagcttgccttgaacttcaataataatactcatgggaacccatctcctactatattggctgctgactttgcaaacaacaaggaagtgcaagttgtcataggaacaaaactcgatgcatcaacattattccactcaattgatgaaagctccaaagatgtccccatcatatctctaacctcaacagctagtccagaaataacaccaatcccattgccacacttcatccaaatgggcaacgatgtcaccttccacatgcactgcattgcatccatcatacaccaattcaattggagaaaggtcacagcaatttacgaacacaacaacttctttgcctctcattcagagatattaacaagactctcctattctctccgtctagttaatgctgaaatcgatcactatgttgcttttccttcaataacaaccactctttcaaacccaatagaaagttacatagaacaagagcttgtaaggctcaagaacaagagcaatagggtgttcttgattattcaatcttccttagagtttgccacattgctattagagaaggcaaagcaaatgggaattatggaagaagggtcggtgtggatcatcgctgatgatgtagctactcatcttgattcattggattcttctgtcatgtttaacatgcaaggtgttgtggggtgcaaaaccaacttcatggaaatgagtgaaacgttcaaacgcttcaaattcatgtttaggagaaagtttggattggaataccctgaagaagaaaactcccaattaccaagtatctttgctcttagggcttatgatgctgtttggaccattactcatgcattgaagaaatcacaagggaacttttccttatcagaaaatattttacatagtaatcatgagggtcttagtgggaagataagcttcaaggacaaaatgttattggaaccaccaacctttaagatagttaatgttattggaaaaggttacaaagagttagcaaattggtcaccagggtctggtttcagtgagaaccttgtagagaatatggtagtgaacacaagaagaactagtagggctggttctgctagagtgcttttaggttctgtggattggcctggtgggttgaaaacagtcccaaaaggttgggtttacaatagcactgaaggaagacctttgaaaattggggttccagccattgatccatgtcctcagtttgtgaatgtgagccatgataagagactgaatgaaacccaattcacgggtttctctatcaatgtctttgaatcagttgtgaaacgcctgccatatcacctgccttttgtttttgtgccattctatggctcttatgatcaaatagttgaacaagtgaacaataaggcccttgatgctgctgttggagatattcaagtggtggaacatagatatgcatttgctgaattctctcatccgtatgttgaatctggtatagccatggtggtgaaagtaaagccagatagatccaaggaaacctggatgtttatggatgctttcacaaaagaaatgtggatgttgatggcagtgatgcacctgttcatagcatttgtaatctggttcattgaaggtgaaaacaattcagagttgaagagtctcggggccattctctggttttctgtcaccacattattctttgtacacagagaacccgtgaagagcaacttggctcgagctgtgctagcaccttggttatttgctattctcatagtgacttcaagttttacagcgagtctttcatctatgatgacagtgtcccatcttgaaccatctgtgccagatatacaaacactgctgaggacaaatgcaatcataggctgcaacaagaacacttttttggtccattacttagttgatgaactcaaattccagccagagaatatcagggtatttgactccatccatgatttcccaagagcctttgagaacaaagaaattgtggcttcttttaccattgcccctcatgctgatgtcttcctagctacttattgcaagggctacatcaaagcaggacctactttgaagcttggtggattaggctttgtgagtttctcttctatctcatttccctacaattgtcatcctacatgttag

SEQ ID NO: 28644 - DNA, 540 bp, Glycine max
  Peptide Sequence Number=SeqID_120329
atgaaattgaagtctaagaaaggatggaaatctattgtaccacttcatttgaaaggaaaatccgcaagccgtttttctttatttcgcaaagtcaattctgctggctatggacctggcaaaacaccagtttatctgaatgtgtatgacttgacacccatgaatggttatgtgtattgggctggtcttggtatctatcactctggtgtagaagccttgtttggtagcttaatctgtaagccttattcagaaggcagcagtgagatttggcatcagagcaggtgtcatccgccgtcgcccgccgccgtccgccgcaaccgccgccgtcactttccggcggccatttctccggcgaagccagggttaggctcgccttgggaagcgcgagccagccggccaactcgcgtcagcaacggagcagccacgcgccgccacgcgccgccaccgtcctacgcgtcctccggcgcgtgcagtccacgcgccgccgtcccggcgccggaatcgcgccgcgcctccgccgttctcttggtcggcttctcctga

SEQ ID NO: 28645 - DNA, 108 bp, Glycine max
  Peptide Sequence Number=SeqID_120330
atgaatgagcctaagtttgctctgcttttttgtgtgctgacagttcagccaagttatagcaaggcaaggttgaggagggcagattgcaatgccaaggtgcatccctag

SEQ ID NO: 28646 - DNA, 525 bp, Glycine max
  Peptide Sequence Number=SeqID_120331
atggctccttctctctatcgcccaaaaccctccaaggccatgccggtgaacattgcatcactatccatccaccagagaaactccacttcaggcgtccagaagagccatgttgtagaaaatctcaatcctgtggaccttgcagtagtcaatcttgttcttgatcgatttgacaaggtagtggtctccaaccgggttttcacacggtttcgggaacgaaccggttacaaggaggacgcggggtttgttgggtctgatgaagttgttgttgaaattggaaatggattcggattattattcaggtttggtttctttgaggacgcggcgagcgcgggcagcagagaggtggtggcggatctcgttgaagtcctgctccggcgtgcgaacttgccgacgccgatggtgccgcggaggacaaccaacgtgaggaagaggcagaggaacgtcaccgtgctgtggcggcacgcgcgctgcatctgccggacgcgccgaggtcccagacaccgctccagcattgctgttcactga

SEQ ID NO: 28647 - DNA, 111 bp, Glycine max
  Peptide Sequence Number=SeqID_120332
atgaagggtggaaaggaagggaaatgtgccgttggaagtggtgctgagggaaagccatggatgaagaacaacaacaccgagaaatggaaatggaagaggaagaagaagtga

SEQ ID NO: 28648 - DNA, 1152 bp, Glycine max
  Peptide Sequence Number=SeqID_120333
atggtcgacgacggagcaacctcggcggcgacgagccggagaaagccgtcgtggagagaaagagaaaacaacaggagaagagaacggaggagaagagcaatagctgcgaaaatatactctggacttcgagctcaggggaacttcaacttgccaaagcactgcgacaacaacgaagttctgaaagctctctgcgcagaagctggttggtgcgtggaagaagacggaaccacttatcgcaagggttgcaagccacctctggccaatggtgcagggagctccatgagaaacattaccttttcttcttctcaaaatccaagtcctctgtcttcgtcatttcccagcccaattccttcataccaagtgagcccttcctcctcctctttcccgagcccgtttcgtttagatgtggataaggacaatgtatcacacctcattccatacattcgcaatgcgtccttgtctcttcctcctctcaggatatcaaacagtgcccctgtgacaccacctctttcatcaccaacatcaagaaatccaaaaccaattcctacttgggagtctattgccaaagaatccatggcctccttcagttaccctttctttgcagcttctgcccctgctagccccacacaccgtcacctttacactccgcccactattccagaatgcgatgaatctgatacttccaccggcgagtctggccagtgggtgaaattccaagcatttgctccttcttcatctgtgttgccaatttctccaacctttaatcttgttaaacctgtagttccacccgggatgcctgataactcaatccaagagatgaggacgagttcagatgagtttggggtacaggtaaagccttgggttggggaaaaaattcatgaagtggcattggatgacttggagctcacacttggaagtgggaagttcctagcagaatctcgagggtggtccgtatatttactagccaaatattggcatgaccatagtttgctacaacaaagcacatttgatgagggtacaccagaaaatgttcaagtgatctctgatgatatcattgatcgtgcattggaacatatgatgtatccgttttggctagtactatatgcagaacagaagttgttgaatgtccatgatgaagaagagaagatgtag

SEQ ID NO: 28649 - DNA, 786 bp, Glycine max
  Peptide Sequence Number=SeqID_120334
atggatagaaagataaggggagttgaggtggctggaggtgatccctcttataaggactcaatcccctcacatgaaagggatgatgctggagagaggcatcgaaggctgactgtgttagcatgtggttggcgacattcgctaacaaagctagaggcatgcccatttgacaggatcattggacctccatttggaagaggtccagttgatttgtcattgattcgatcttacacggaccattgtgttggtcatccgacggtgagggctattatgttacggttagggttatcagacatagttacggtgcagtaccctgtcgcaaacaaggtcttcgtggatgcccttgtggagaagaaacaccaggaaacctcgtccttccacctgcctgtcagagagatgaccatcactctggatgatgtgtcatgtctcatgcatcttcctatgataagtaggccttttgatcatgtcccttccatctttagtaaagaggtcatgaagtttctgctcatgactcgccttggcattttgatagagaaaaaggcaatagaagtgagcattgcaggtcccaagcctaggatcgatgctctggatgaactggtagctagcagatggaagccaacacaacgccacaagggtgttaggcctttcccccagcaaacccttttctttgacttcattaggtgcgagacaaacgaaggcttcaacgttgggtgtaacttagagaggcagaggaagagggttgtcaaggatggtggcaagggtggcaggaaaggtggcaagggcagatga

SEQ ID NO: 28650 - DNA, 3096 bp, Glycine max
  Peptide Sequence Number=SeqID_120335
atggtggaagcgggtgaggattgttgcgtgaaggtcgcggtccacgtgcgacctctcatcggcgaggagaaggtgcagggatgcaaggattgcgtgagcgtcgtgccagggaagcctcaggcaataaatgcggacacatctcttagcggggatttgaagcttggattcccacgttgtgggagactagctctttctgctagactcaactcccgattgaacctccgacttagacactgcattctggtgtcaaagcttgacccggtgccatttgagctacaagctcattgcactggttctccctcatctgccatgttcgatgaatgtgttgcatcccttgttgatggtttgttccaaggatataatgctactgttcttgcatatggtcagacaggttctgggaaaacatacaccatgggcactggctttaaagatggttgccaagagggaataataccccaagttatgagttctctgtttaacaaaattgagaccttaaagcatcagaatgaatttcagctgcatgtgtcctttatcgagattcttaaagaagaagtaagagacttgttggatccatcctctatgaacaaaccagaaactgcaaatggacatgcagggaaagtaactattcctgggaaaccgccaatacaaatccgtgagtcatcaaatggtgtcattactctagcaggatctactgaagttagtgttacaacactaaaagaaatggctgcttgcctagaacaaggatcattgagtagagcaactgggagtacaaatatgaacaaccaatccagtcgttcacatgctatcttcaccatcacattagaacaaatgcggaagctcaatagtcatggtgagatcagtttaaatgatacaatgaatgaagaatatctttgtgccaagttgcacttggtagatcttgctggatcagaacgagctaaaagaaccgggtctgatggtctgcgctttaaggaaggagttcacattaacaaaggccttctagcgctcggcaatgttattagtgcacttggtgatgaaaagaagagaaaggaaggtgttcatgttccttatagggatagtaaacttactaggcttttgcaggattcacttggtggtaacagcagaactgttatgatagcctgcataagtcctgctgatattaatgctgaggaaacacttaacactttgaagtatgcaaaccgtgcacggaacatccaaaataagcctgttgtcaatagagatcccatgtccaacgagatgctaaaaatgcgacaacaacttgagtatctgcaagcggaactttgtgctcgttctggtggctctcctgaggaagttcaggtcctcaaggaaaggattgcttggcttgaagctgctaatgaggatcttcgatgtgaacttcatgaatatcgtagtagatgctctactgtagaacaatgcgaaaaggatgcatatgaaaatagcacatgtaatgtaaagactgatgggcacaagaggggcttacctatcacagcatctgattatccaatgagtgaaacaacaggggattcaagggaaattgaagaagtagaaaaagagtgggagcatactcttctgcaaaatagtatggatagagagttacatgaattgaataaacgcttggagcaaaaagagtctgagatgaagctttttggaatacctgatgctgaggcactcaagcagcattttggaaggaagataatggaactagaggatgagaaaagaactgtacagcgagagagggatcgtcttttggctgaagttgaaaatcttgctgccaattctgatggacaaatgcagaaatcagaggatatccatgcccaaaaattaaaaacacttgaagcccagaagaaacaggagagtcaggtccagctcttgaagcaaaagcaaaaaagtgatgaagcagcgaagcgattacaagatgaaatacaatctataaaagcccaaaaggttcaactgcaacataggataaaacaagaggctgaacagtttcggcaatggaaggcttctagagagaaagagcttctgcaagtccttcaaagaaagactgaagaagctgcaatggccactaagaggttaaaggagttgttagaagctcgtaaatcttccagccgagacatttcaggttcaatgaatggaagtggaacaaatggacagagcaatgagaagtccttacaacggtggcttgatcatgagctggaagtcatggtaaaagagcatgaagttcgttttgagtatgagaagcagagccaagtgcgagctgcgcttgctgaggagttggccatactaaagcaagtaaacggggttgctgccaagggtctccctcctcccagaggaaagaatggatttgctagagcatcctccatgtccccaaatgcaagaatggccagaatagcttcacttgagagcatgctgaacatatcatctaattcacttgtagcaatggcttctcaactttctgaggcagaagaacgagaacgggccttcactaatcgtggacgctggaaccagttgcgctcaatgggagaagccaagaatttgcttcaatatttgttcaattctgttggagatgctaggtgccaactgtgggaaaaggacactgagatcaaggaaataaaagatcaaatcaaagaacttgtaggtctattacggcaaagtgaaatgaaaagaaaggaaactgagaaggaactaaaagcgagagagcaagctgttgcaaccacattggcgaccccaacttctggaaactctccaaattcattgaaacactatgcggaagacatcaaggaacctttatctccagagtctgtgccagtacagaaacagcgcaaatatatgccaggcatcactaatggccaagtgagggaatcagcagcatttgtagatcagagtagaacggatgtgagatttgctatcaatgcagatgatacccattgggcaactgtcaatgaaaaaactagcaattgtaggacaagcttctggcaagctatggagaagccatggagactttctgaacggattcggcacagtgatgagacaatcatgagagcaaggccacgttcgcaggctttgccgcatataatgtga

SEQ ID NO: 28651 - DNA, 141 bp, Glycine max
  Peptide Sequence Number=SeqID_120336
atgggtgaagttcccacctcatgtgatgttcgacatgaaaggatggatttccctttagcaccagctcctcaactccatcatcgggaatgggcgaatagtggtggtagtggaagtgtggaactaactgtgttattcccttaa

SEQ ID NO: 28652 - DNA, 453 bp, Glycine max
  Peptide Sequence Number=SeqID_120337
atgctggaaagttttaaacaacaacaagaaatgtcagttctagaattgtacatagaaaaggatgtggctggtggttcaatgtttcattctgcaaattcggttacatcatgtgaaaattatttatctaatgatgacacacaaccgccaacaaatatgagcaatttacatcttgacgaagatgatgatgatgattattattatcttgtatctaactcatacgttgaagagtctttagacgaagatgacagtgttgacggtatatctgatacagacaatgaagtcaccgaaatgattccaccagtgtacaaggaatttagaatccattttggaatgatgctttgcattataataatatcaactggagtcatcctgatgaggaggacatttgtggtttggagatgccatccagttttaatgttggccaagaattatatgttggcatggaatttgata

SEQ ID NO: 28653 - DNA, 132 bp, Glycine max
  Peptide Sequence Number=SeqID_120338
atgtcattcatcttccaagaagcaaaggaatccattgatgaagaagatcctaggcctacaagctccaatggagcttgcatcatgtggtatcaagagcatcttcatctaggttctatcaattttcattcataa

SEQ ID NO: 28654 - DNA, 48 bp, Glycine max
  Peptide Sequence Number=SeqID_120339
ggtgaatgctgtgaaattttcccggacgcccgaaatggacttggatga

SEQ ID NO: 28655 - DNA, 1097 bp, Glycine max
  Peptide Sequence Number=SeqID_120340
cgccggtggtggcttcgacgcgctggccggtcgcgttgatgcggccgttgctggcgccgatggcgttggcggcgttcagcgccacgccgtaggccttgacggtggcgccggcggcgtcggccaggatcgaaccgttctcggcgttgagcgtgacctggccgtggttggcgccggcctgcacattcttgaccgtgatgttgcccgaggtggtcttgaccgagatgtcgttgccggtggcgtcggtgcccgaggtgacgctggtcagcgccaggctgccgttgccggtgatgcgcgtttcgccattggcgaccgaggtcgtcaggccgcccagcaggttgccgctgctgtccaggtagagcgagccgtcgccggtgacggtggccgacaccgggctgttgggcgcggcgatcttgatggccgcgtcgcgcgtgccgataccgttctgcgccgtcagcgtgatggcgccggcgcccgcgcccgagagcgtgccgccgccgtacaggatgctgccggtctgggcgttcagggtcagggcgttgccggtgccgtagctgaccgtgccgaccaggatgtcgccggtggtggtggtgaccgacaggtcgccgcccgcgcgcaggttgcccaggttgatcgagccgttctgcttgagccagatgccgcccgaggcggtggcggcgatgttcttgacctgcgtgctcagcgccaggccggccgagccgatggtgttgggcgtgtcgcccgtgccggtggacagcgtcaggtcgcccgccacgatcttggacgagccgttcatgccctggatggagccgcccgtgtagtagtacgggttggtcgacagcgttaccgagccgttctgcgtgacgtcgatgtcgtgcaggttgatcgcgcccacggcctggtaggtgaagttcaggccggtggtgtcgcgcaccacggtcagcgcggtggcgttgttggagtcgccgccgctgaacgtcaggttcttggcgtcgatggtcaacatgcccgcgctgcccaggttcgagccctgcgcgttgttgcggatgatggtcaggtcggacaggtcggccaggttgtcgacgtagatgctgcccggc

SEQ ID NO: 28656 - DNA, 536 bp, Glycine max
  Peptide Sequence Number=SeqID_120341
aatatcacaaattgcctaatgatgggtgccaagcacctcacaaggaccaaagaatggtcgcaggtcatcaggcaaaggtccccggacgaaaatcagtgtatgacactaatttcgctcctctcggtttgacgagaatcgcgggtgaccatgacttgtcgttcctagaatttcacaaattgcctaatgatggatgccaagcacctcacaaggaccaaagaatggtcgcaggtcatcaggcaaaggaacaaaaggtgcagaagactgtgtcagcctctgcatgctatcaagcgttctgtcttacagatagcaaaagaatgtttatacggataaccactcggggtgcggataaccgtaaggtatctccgcgtatcatcgggtcccgccgcctctggatgatacaagggtgcagaatgaccaaacttggtctctgcttgtcatcgggcccgccgcctctggatgacaaaagggtgcgaataaccggtgcggataaccgtaaggtatctctgcgtatcatcgggcccgccgcctctggatga

SEQ ID NO: 28657 - DNA, 806 bp, Glycine max
  Peptide Sequence Number=SeqID_120342
acaactagggtaccccatgaggggagcaccgacggaagaaagcatgtctcctttccttgtgagggatctcggcgcacaaagttccaagactatacaaagaatccataaggcctgggaaaccccgttaaggaaagatcaagagcttagaggcattcgtaatggcatcattggtgggtaccacgaatggctgaaagttgatatacgaggtttagattggctcgccaagttaaaagtcgtcagcgaagagagttttgaagcaccggaagaggacgaagaagtccaaactctcaaaagcgagttaggaaaggcaaaacttgccaaggagaagttcaagttggccgctacacacgttcggaaggagtgtgccgggttacgggaagagaatgcaattactgcaagagcccttgaacaagagaccaagagggctcgcaaggaagagtatggccggaacaaaattcgcggagctctatgggttaattgcttgttcgaggtccaaaagaagcttgtctcagcgtttatgcgagacggagaccaacatgctagctatcatgccaagtaccaagaagagttaggtctagccacggcccacgagcataggatcgcggacgagtatgcccaagtatacgcggaaaaagaggctagaggaagggtgatcgactctttacaccaagaggcaaccatgtggatggatcggtttgctcttaccttgaatgggagtcaggaacttccccgattgttagccaaggccaaagcgatggcggacacctactccgcccccgaagaaattcatgggcttctcggctatt

SEQ ID NO: 28658 - DNA, 126 bp, Glycine max
  Peptide Sequence Number=SeqID_120343
atgtcatctattatgcatagtagcagtgtgatagcctccctctctagttgtgctcgcacagttggccctcctccaatatcagggggtggcccaggaaccgttaaaaggaaactactggtcccttaa

SEQ ID NO: 28659 - DNA, 306 bp, Glycine max
  Peptide Sequence Number=SeqID_120344
atgaagagagaatctcctctatccctgcattacaaactgtttgaggggacacatgtcccagacattgtctcgacatcagggaaagctgctgcttcaggtgctgtgtccaaggatgctctgattgctaaactcaaggacacatgcaagctgaggaagaagaagatccagctgagcaagaagaggcagctgaggaagaggaagatgcagcagaagagacagaatcagatgatgatgattctgaagccaccccatgaccatcagacctttatttttgcttttactagttataggggcatgtccctttga

SEQ ID NO: 28660 - DNA, 559 bp, Glycine max
  Peptide Sequence Number=SeqID_120345
atggttctatttcttattcttaatgtcatggatctcggttccgtaggaacaagtcagggccgggagaaagaagtgaggaatcctcttttcgactctgactctcccactccagtcgttgcttttctttctgttacttcgaaagtagctgcttcagcttcagccactcgaattttcgatatccctttttatttctcatcaaacgaatggcatcttcttctggaaatcctagctattcttagcatgatattggggaatctcattgctattacccaaacaagcatgaaacgtatgcttgcgtattcgtccataggtcaaatcggatatgtaattattggaataattgttggagactcaaatggtggatatgcaagcatgataacttatatgctgttctatatctcgatgaatctaggaacttttgcttgcattgtatcatttggtctacgtaccggaactgataacattcgagattatgcaggattatacacgaaagatccttatttggctctctctttagccctatgtctcttatccttaggaggtcttcctccactatcag

SEQ ID NO: 28661 - DNA, 934 bp, Glycine max
  Peptide Sequence Number=SeqID_120346
atggctgtagaagaagtagtgaaaaaatgtaagactttaaaattacaaaggagcaataggaataaaacagaaatcttagcaggggaaaatcttaacgaatttattctaaattgtaaagaacaactaagtggcaatctacttgataacaactgggagagtaatcattggaagaaaatatttaaattttctaaatttaagatgaagaatgtcaagttggactcgttcattaaagctgaagatcttgattcctcttacattggattttgcaaatcatatgtggcttatattttttgctctaatcttaaaggatttgataaactaactgttccaattgtgcttagggtgattgaaaaaaatttattagtttttactgggtctggtgatataaaatcactaaacccagtcattctcgatgagtgcttgtccgacattaataaaaactacactaaaggagttgcatatagttgtggtaaatttatggagagattggttgctttcctgaatgagaaagaattccttaattgtggattaatgaagtggagtagttacaacagaccacctgaatcaaggctgtcgatctctgataatgcagacaataccagattagcgaaactgcctaatgaaagagcattacgagcaattggtgaaatcttttcaatgcaggattatgaccttcacgaaagagacctgtttgttacttcagtgtttgcattactcatgtgcgcacccagtcgtataactgaaatattatcgcttagagctgattgcgaaattttcgaaaagaacagggaaggaaaggaatgttatggcctgagattctattcattgaaaggttttggggcaaacattaagtggatacctcaaatcatggttcccactgccagacttgccattaagagattgtcacagttatctgaaaatccaagagcaagaa

SEQ ID NO: 28662 - DNA, 216 bp, Glycine max
  Peptide Sequence Number=SeqID_120347
atgatagaccaaggccggcttgaggtcggcagtgaggaggaggaggaacaacatgtatacatgcagtcggcagatgaggaaggtcctaaaaggcctaaacctttggtaatacacttcaccagggacccgactccccaaagacctcaacacccctcggcagtgtcgagcggtagacctattccgtttccttaccatgacagccgcgcagttccgtag

SEQ ID NO: 28663 - DNA, 475 bp, Glycine max
  Peptide Sequence Number=SeqID_120348
atggaagaaccatcaaagaagcgaaaaggttcttcaagtcgaagtcaacgacattccgacactcaagaaacacagattccctcctccatttcctcttcctcattgttctcatccgaagaacaacgaatacggttagtttgcaccaaccaagtggatatgaccgaaaggcttcttgccggttcattggcttttgaaagccgcatccttcattatctcattgtgcctatcttgcttccaagatcttcaaaccttgcacaggtttctgaagaagatcttattgtcatcatccctcttgattctgaaccttatgttccaatcaagagatccttcttaatcggtgctgctgtgattgcatcttttggttaccgtaaagagcatgatggctcttgggtgaaaaaaggtgcacaacccattgatgaagaaggacacttaccaattggagaagattcctctcttcttcaaaggatttggacag

SEQ ID NO: 28664 - DNA, 153 bp, Glycine max
  Peptide Sequence Number=SeqID_120349
atgttggtcaatgttgtagaagaagacgacctcatctccaggcttcaaatgacattaaataaattgaagcctctggtggcagaacctagagacatcaatggtaaaaacatggcgcctggtggttgtggctgccctttgtcgaatagcacataa

SEQ ID NO: 28665 - DNA, 126 bp, Glycine max
  Peptide Sequence Number=SeqID_120350
atggaaaattcaaaacacttggctactcctatgaatacaagttgttatcttgacaaagatgaatccggtcaacctgttgatccaaagcaatacagagattttgtggatgaagcaacaactatctga

SEQ ID NO: 28666 - DNA, 420 bp, Glycine max
  Peptide Sequence Number=SeqID_120351
atgaacgaaatgaagatgaaagctaaaaaaacaagaaatgaattgaaagtcgcggattcgaaaacttacccgttgaagaacgaagaacgaacaaataacgaacgaagaacggatgaagaacgaggaaaaaccttcacggatttgcttatgaaaacatctcggaagcattatgccaagggggttagggatctttggaacaacctcccttcgcctatttataggaaaagggaggaggaggttgccgcccagctcgctcaggcgagctggggttatgagaattttatgaaagtgccgaaagccccgaaagccattcttttacaaaacggtggaggtggttgccgtccagcttgcccaggcgagctaggttgcttccaccttaagcaaggatatgcccagaatcctctagaagacccagattga

SEQ ID NO: 28667 - DNA, 288 bp, Glycine max
  Peptide Sequence Number=SeqID_120352
atgaacttaatcattgttatcaacggaaagggacacgctttacgacgcccttaccgaactcgtgctagagctagagtaatgggtgaagtagaggagatacaagagaagatgaaggccgacatggaggccattaaagagaaaatggccacaatgatggaggccatgatgagcgtgaagaagataatggaagccaatgcggttatagttgccgctactagcgctgtcgctaaggtgaacccgatgctcccatctggcctcaagcaaatgaatcatccaacctcaaatatg

SEQ ID NO: 28668 - DNA, 693 bp, Glycine max
  Peptide Sequence Number=SeqID_120353
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccatatggacaacttcttcgccccgttttcaccatgggcaatatatacgcaaggcgacaggtgctgatgccgctggcgattcagtggtgcttttgcatgtctttccgggttggactcaagacgatagttaccggataaggcgcagcggtcggactgaacggggggttcgtgcatacagtccagcttggagcgaactgcctacccggaactga

SEQ ID NO: 28669 - DNA, 99 bp, Glycine max
  Peptide Sequence Number=SeqID_120354
aaggctgttgcttctggaggaagcaaccctgctcgccatctcccctattttgctataaataggggaggaagtgagaaggaaaagggttcagccccttag

SEQ ID NO: 28670 - DNA, 192 bp, Glycine max
  Peptide Sequence Number=SeqID_120355
atgcgtaaggagaaaataccgcatcaggcgccattcgccattcaggctgcgcaactgttgggaaggccaatcggtgcgggcctcttcgctattacgccagctggcgaaagggggatgtgctgcaaggcgattaagttgggtaacgccagggttctcccagtcacgacgttgggaaacatcgggctaagctga

SEQ ID NO: 28671 - DNA, 225 bp, Glycine max
  Peptide Sequence Number=SeqID_120356
atggaggatttccctgagggtcctcacttaggcaatcatgaaacacaactccaaactcgaaagtggaggacacatgaacagcgcgaggcaataacattcatggggctccgaaaaagggcaatcatgaaacacagctccaaactcgaaagtggaggacacatgaacagccctaggcaatacgttcatggggctccgaaaaagggtgagaatggaggattgccttga

SEQ ID NO: 28672 - DNA, 348 bp, Glycine max
  Peptide Sequence Number=SeqID_120357
atgtcttcccacagcgatagcgtcatctctaacggttccctaagattcctccagttttttcctctgcctgctccgatagaattcccaaacgtcagagaaatggagaaaggattaaagcctccatttggactatcttcatgcgattcctttttctccctccaagaacatttgtcgcaaatcccaacggtcaaagaacatgatatccaaattctcaaaggtgaaaatgctcggcattgggttgcgaacgtggtgctcaaatttcacaacaatccaatggtgaatgagaccgagatcgtcgtttttctgagacaggtttggtgggctgcgggaaaaaagaaaaggttttga

SEQ ID NO: 28673 - DNA, 210 bp, Glycine max
  Peptide Sequence Number=SeqID_120358
atgggtctccgaataagattgagaatggagaatgggcgaacagcgctaggcaatcggggtgcggggtccagactcgatggtggtggacacatgaagagcgctaggcaatcaattcatgggtctccgaataagattgagaatggagaatgggcgaacagcgctaggcaatcaatttgcggggttccagactcgatggtggtggacacatga

SEQ ID NO: 28674 - DNA, 204 bp, Glycine max
  Peptide Sequence Number=SeqID_120359
atgtatgaatacatgcattttgatgatgccaaagaagaatcaaacaaggctacttcaaaggataagcattgcttcaagattaatacaagattgcttcaacaaacaaagccttgcttcaagattactttaagatcaagccttgcctcaaaacaaagtgattccaagacatgcaaggctctggtaatcgattaccaggtagtgtaa

SEQ ID NO: 28675 - DNA, 186 bp, Glycine max
  Peptide Sequence Number=SeqID_120360
ctcccaaatctaaagactgtgagagacgatgaggttaaagcttcggaagaaagtgatgaggtacaagccctaaaggcagagcttgaaagagccccggcaatagtgagctcaagctccgaagaggtgaaaggaatcatcacgggtcaaaggcatgatcttgaaggacgagctaaaggcttgccttaa

SEQ ID NO: 28676 - DNA, 768 bp, Glycine max
  Peptide Sequence Number=SeqID_120361
atggttagaacacgaggtttaggtcgtgctttagcgagggttatagggcgaggtagacaggatgagcatgatgttccccgaaggcgtaggcctactgcatcaacccgtaggcaacgggtacatattgcggttgatgagggtgttcctcaggtgactgaggatgttcctcatatggcggaggatgttcctcagatgactgaggatgtccctcatatggctgacgattttcctcagatgagtgaagatgcgcctcagatgactgcgggcgtagatgcgactattgcagaggacttaggtcgtgatggtgctgaggggtcatatgctgatgagggattccctggtgggccccgtgacccatcagttctgacttcatttgtggagcatgtcgcacatgccatttggactggacatgagcgttctgagctgaagttggtgtcgcacgggaggaaggtgacgctaattgggaggccagtgcctgagattgaagggctggttgccaccacaggattaagtccattgatcgggtgttcagttgtaaccggcgatcctggacttatatccgcatttgtggaaaggtggcatagggagaccaacatcttccaccttccagtaggagagttgaagatcacactagatgatgtgtcctcactcttccatctccctatcagtggcgccttccacagcttcgaggctctttccgtggacgaggcggtatttttgttgatggagttgcttgaggtgtccggtgaagaggctagagccgagata

SEQ ID NO: 28677 - DNA, 600 bp, Glycine max
  Peptide Sequence Number=SeqID_120362
atggagagaagtatgatagatgctgccagtgttggagcccttggagacatgactcctgctgaagccagaaatttaattgagaagatggcttccaactctcaacagtttagcgccagaaatgatgccatagtcattagaggagtgcatgaggtagctacaaactcagctgcatcatctgagactaagaagcttgaaggcaaactggatgcattggttaacttggtaacccagctggccttgaatcagaaatctgtacctgttgcaagggcctttgcccttccatgcaacaacctggagcaatcgagtagcctgaagcttatgctgcaaatatttacaatagacctccccaacctcagcagcaaaatcaaccacagcagaacaattatgacctctcgagcaacagatacaaccctggacggaggaatcaccctaacctcagatggtccagccctcagcaacaatagcaacctgctccttccttccaaaatgctgctggcccaagcagaccatacattcctccaccaatccaacaacagcaacaaccccagaaacagccaacagttgaggcccctccacaaccttccctcgaagaacttgtga

SEQ ID NO: 28678 - DNA, 1017 bp, Glycine max
  Peptide Sequence Number=SeqID_120363
atggagaaagccggcgagatccccggcatggacccgactaagaagctcgtactgatggcgatctgcgacgacgcctctaaggacaaccggatcagctaccccggcctgcagaagctcacgctgtggtcctcgcggtcggagcgccgcgtcaaggagatcgtcgaggacctcatctgcgacggtcacctcgcacgccgcaacttcgcccaccccggccgccgtgccgagtacatcgtgttcccgaccgacgccgaactcgcgagcctcgacgagacggatgagcgcctgaatgcgtcacggaagaggccgaaacgcccccggaaacctgtggataacttctccggaatgggtgcgaccggtcgcactccgggatctgagaatgggggcgacatctcgccgaatgggggcggcccagaccgcacccctcccgtaagcactcccaagaactcttctagtccagtccctgcagagtctcccgagacgccgggtgtggataaccgagggacgggaccaaagtcaccgaaccccaaggcactgagtacgacgcacggcaagccgctgtcgccgcctgacgtgttcgcagcggtcggacggcagctgcccgacacgttcgacgacatcggactcgagcagctcggcgccgagatcatcgcgaaggcggcctcccgggtactcgacccgaccgcctacgtcattgcgaccattcgcgggtggcaccgcccgaacttcaccggcgcacacctcgtcgacgccggcacctggctcacccgcgtcgacgagatcgaccgcgatcgccaggaacttctgatgcgcacgaacctcgaggtctactgcgtggctcaccccgaccccgacacctggatcgtctacttcccgtggacgaagaacccgctcccgctaaatggctcgcacgggcaccccctcgcccacgcccgcaaggccaagggcatccgccagcaggctcacacgatgatcgcgcatgcccgcatccctcgcctgggccgatgcacggcgaag

SEQ ID NO: 28679 - DNA, 201 bp, Glycine max
  Peptide Sequence Number=SeqID_120364
atgggtcaacttcaacggcaagccttctgcaaagcctatggtaagatttgggacctagctatcatagaagtcttcgtggaagtgattgcatcccgtacgcagtataatgatcagcccctgaggttaattaggcaagctttggaaaaggctgttttcaccttctcgctaagccaatatgttggcttagcgagtattcgctaa

SEQ ID NO: 28680 - DNA, 450 bp, Glycine max
  Peptide Sequence Number=SeqID_120365
atgccccaagagctggtagcccgcggagacaccttactgttatccgcacctcgtcattcagtaaccccaagtgtgatgggtgagcagaggccaatgtggtcatttgcgcccttaccggagatgtcagcatcttccggtggagactttttcaagtctcaaaagttatctagaactacaggcggcgggcccgatgatatgcggagacaaaatttggtcattccgcacccctttgccattcagacacagtcgtgtccgatggcgtgcagagacaaaatttggtcattctgcaccctttgtcatccagaggcggcgggcccgatgacatgcggagacaaaatttggtcattccgcacccctttgccattcagacacagtcatgttccgatggcgcgcagagacaaaatttggtcattctgcacccttcatcaatcgcggcgacaagcccgttga

SEQ ID NO: 28681 - DNA, 246 bp, Glycine max
  Peptide Sequence Number=SeqID_120366
atgtctgcaagcaaatccggttcaagaaagcgagcatccgaatccgaacgcgcaaaatctgacaagaacaagcgatcagccacggataacttcgatctcgatttggatttcgatctctcagatgacatcaaaggaatcgtctcggcgctgcaccttatcagagacaaggctcagaaggacggtcagaagaagaacgaagagactatttccaggtacctgaaacgattgcgtttcgatcgtatctga

SEQ ID NO: 28682 - DNA, 321 bp, Glycine max
  Peptide Sequence Number=SeqID_120367
atggctacctcaccaaaagaaatttcagctcctggttcacccgctgtaccatcatctccgcaccaggaacaaccagaattcaacatccaacccatacagataattcctggtcaagcttctgtccctgagaaactggttcccagaagaccacagggagtgaagattgctgaaaaccctagctctgcaacgagttctagggaagtagacccggagatggacaagaaaatccgcagtattgtgagtagcattctgaagatgcttctgtgcctgatgctgagaaagatgttccaacatcgtccaacccaatgtttctgtgcctga

SEQ ID NO: 28683 - DNA, 321 bp, Glycine max
  Peptide Sequence Number=SeqID_120368
atgcgtctaccggggaaggagagtctgctgttgaaatcccccataaccataaatgagattttggatgttagcatttcgtttctaaatgaccatttagaggaaacactgggttcgacaaaaatagaagaaatccactcaaagtgtatcaatctcgcacagggtaaggattggcattctcaccctgggtcaaggtttatggtgagtcaggattttggctcaaagcttgtagaatggccagacatgatacatgtcaaggtttggtttggttcaaggattaaagggatgccccacattatttccacgacacaaatgcaaaaatga

SEQ ID NO: 28684 - DNA, 243 bp, Glycine max
  Peptide Sequence Number=SeqID_120369
atgaggggttaccttatgatcacccgcacctttcgtcaaccaggggcaaacgagcccgttgacgcgcagagactaacatcgtcttctgcaccttttgccatccagggacagcgagtcaggtggcaggcggagataccttatggtcatctgcacctttcgtcaaccgaggggaacgaattcgatggcatcaggatgatgttttactctcgtcgtccggaaacattcaagcctggcgacgcgtga

SEQ ID NO: 28685 - DNA, 612 bp, Glycine max
  misc_feature (56)..(56): n is a, c, g, or t
  Peptide Sequence Number=SeqID_120370
atgggtagaaatgtgtcagcattgataggtaaatttgttcctcacattcctgaganatgtaaggacccagctcgaaccaagatagatgtttatgctggcacattgtctatggaatttggtgatgttgttgttcatattaacattcttgatgccatgaaacatccatatgaggatcattctgtttttcgtgctgagataattgatcaaattgttgatgattatatgtttgattttgattctgttcttcatggtaggaaacatccatttttatttgatctgcatacttgtcattccttatgcattgaatctgattctgagtttgaatttgatcctatatctgatttttatgctgagaatgaatctgaatttgagtctggttttgattttctgggtgttgtacctcttgatgttgattttttagagtcagaatgcactaaccatgttgcaggaagtacatatacttctgacttgctttatgaggtacaggctgaggaaccttcttcttctcctaccctggttcctcccactgttcagccaccacccacactggagttgaagcccttactagaaaccctcaaatatgcttacttggaggacaaggaaaaatttcca

SEQ ID NO: 28686 - DNA, 561 bp, Glycine max
  Peptide Sequence Number=SeqID_120371
atggcttgcacccacattccggtgaaagttgaaaagatgcgtttgcgagaggatgagggacaaagatatcaacttcatccatttcatttaacattgatttacacacgattctcctcaaatttcagccagcatcatttagacctcgcaccttacgcttcagagccctacaatgctcaatggaacgccccggggcttctctgcgacaagcacacgttgcgttcgagtcgtattctcggagaaatggaggttgatgaaccttggctagggatttacacacgattctcctcaaatttcagccagcatcatttagacctcacaccttacgcttcagagccctacaatgctcaatggaacgccccggggcttctccgtgacaagcacacattgcgttcgagtcgtattctcggagaaatggaggttgatgaaccttggctagggttatggctaccattgaattaccaagtagatatgggagcaagtcaacataggacactagaattggggtttatgctaaaggtggtgtatgtcattggaagtgcggtaggtaggctttgtggttga

SEQ ID NO: 28687 - DNA, 251 bp, Glycine max
  Peptide Sequence Number=SeqID_120372
gcccacttgggccctccagaatattcctccagaaggctgttgcttctggaggaagcaacctggctcgcctgggcgagctgggcggcaaccacctccgctattttgctataaataggggaggaagtgaagaagaaaaggccgaggcgcttccgaaacgtttccgtaacgttttccgtgaggaatttcgcaaaggtttcaaccgttcttcgacgttcttcattcgttcttcatcgttcttcgatcttcaacgg

SEQ ID NO: 28688 - DNA, 255 bp, Glycine max
  Peptide Sequence Number=SeqID_120373
atgcatcctccaccttcgagtctggagccccgcgaagttattgctgtagctctgttcgccaattctccattctccactttttattcggagacccatgaatgtaatttcctagcgctattcatgcatcctccaccttcgagtaggagcctcgcgaagttgttgcgtagcgctgttcgccaattctccattctctacttttttcggagagccatgaatgtcattgccaagcgctgttcatgcatggggatcctctag

SEQ ID NO: 28689 - DNA, 276 bp, Glycine max
  Peptide Sequence Number=SeqID_120374
atggcatccttcagccagatgcagtcccagcttcagtcacagatgcaatcacagggacttgcactgcctctagagcctgaggttggaccctcagctgctcatgttagcacaaatgggagttgtgttgatccctcaccgaccgatccagagatgggtgactcagacaaatgcgggctgtacatcgaagaaaatccctcccgcctggttgccctaggaagagtttatgagggattcacagttgttcacaacatcactttgttgcatggccaggtgaag

SEQ ID NO: 28690 - DNA, 126 bp, Glycine max
  Peptide Sequence Number=SeqID_120375
atgtcttttgaaggacttagagaaagacttcgagcaaaatcagtccacgaaggaggcaattttgaaatcatgaaagccacaagcataatgtcaagcaaaacgattcctttcaatttcatgtcataa

SEQ ID NO: 28691 - DNA, 210 bp, Glycine max
  Peptide Sequence Number=SeqID_120376
atgtgtggctgttttcgcacctttttcgccaagaaggtaggcccgtttgttcgctacaaggtcatcgctcgtgcgccgagaaaggaaaggcgaattgggaccaactcttacctagcatggagggggcgtccgttaattggttccctcgctggaaggaaggaagaaccgggattatgtcctcgtgcgaaggatttccaaatgttcccttga

SEQ ID NO: 28692 - DNA, 165 bp, Glycine max
  Peptide Sequence Number=SeqID_120377
atgtgggtcatcatcaatgagtataaggaaaagctaaaccaagcggtgactcacgagcaaaggctagaggatgagtacaccaagatatcagcagaaagggaagcaagggagaggatttgcctttactttgaatggaagtcaagagcttccctgactgctagctaa

SEQ ID NO: 28693 - DNA, 215 bp, Glycine max
  Peptide Sequence Number=SeqID_120378
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccctttatatgcgttcatgccatcaactccccctctcag

SEQ ID NO: 28694 - DNA, 351 bp, Glycine max
  Peptide Sequence Number=SeqID_120379
atgaccggccctctccatgagtcgatctcttgctttctcataagggtggacccttgggtactagtacctatcaccttcagaggactacacgtcctcgcctccagaggactacatgtcctcgtcttcagaggactacacgtcctcgccatcagaggactacacgtccttgcctttagagggctacacgccctcaccatcagaggactacacgtcccccattctaaagggggctacactgccctcacctttagaggagctacatgtcctcaccttcataggactacacatcctcgccttcaaaaggcgacacgtcctcgcaaccttcagagggctacacgccctcgcctttag

SEQ ID NO: 28695 - DNA, 408 bp, Glycine max
  Peptide Sequence Number=SeqID_120380
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgatagagggctatccaaagagtgtaaggacctagaagcatttcatgagttgaagggtccaatgacaaggtccaaaaccaagcttctacaagaagagatggccaagagaaccaaggatggactacttatcaaaggcaaggaaggaggaagccacaaggagctgaattggaccactttagagatttttttgaatgtcttgcttagcgagaccaactgggtaccgagctcgaattcgtaa

SEQ ID NO: 28696 - DNA, 663 bp, Glycine max
  Peptide Sequence Number=SeqID_120381
atgctccaacctcgaatcgttggtgaagaacattatgagactgcgcaaagagttaaacaaactttacaacgttacaaagaacttcaagacattatagctatccttggcttggacgaattatccgaagaagatcgcttaaccgtagcaagagcacgaaaaattgagcgtttcttatcacaaccttttttcgtagcagaagtttttaccggttcgccggggaaatatgttagtctagcagaaacaattagagggtttaaattgattctttctggagaattagatggtcttcctgaacaagccttttatttggtagtgaaggaaatcattttatctactaatagcggacaaattggagtattaccaaatcatgcgcctattgccacagccgtagatataggtattttgagaatacgtcttcttaaagaccaatggttaacgatggctctgatgggcggttttgctagaataaacaataatgagatcactgttttagtaaatgatgcggaaaagggtagtgacattgatccacaagaagcacagcaaactcttgaaatagcagaagctaatttgaataaggcggaaggcaagagacaaacaattgaggcaaatctagctcttagacgagctaggacacgagtagaggctatcaatgtgatttcataa

SEQ ID NO: 28697 - DNA, 702 bp, Glycine max
  Peptide Sequence Number=SeqID_120382
atggaacgggaggtgtcgactcccgctgctaatcggtggtgcgacgacgagccgtgtgcatacggcggtaaaaatcatccgcggtatgagcaggtgcaggcgatctatgtgaccgacgcctcgcgcgccgtgggcgtcgtgtcggcgcttctctccgccgagcagaagccggcttatatcgacggtattcgcagcgaatatgccaaggtggcagaggctcacgcccgcaacgagcgtgagaagcagcgcctgccgctttcccgcgcccgcgagaatgcgcacaagattgactggtcgagctatagcgccgtcaagccgcagttcttcggcacaaaggtattcgagacctacgacctggaagagctttcccggtacatcgactggacgcccttcttccagacctgggagctgaatggccgtttcccggccattctcgaagacgaaaagcagggagaggcggcgcggcagctttatgccgatgcgcaggcaatgcttgcgaaaatcatcgaggagaactggttccggccgcgtgcggtgatcggcttctggcctgccaacgctgtcggtgacgatatcaggctgtttacggatgagagccgtaaagaagaactggcgactttcttcacgctgcgtcagcagctttccaaacgcgatggacgcccgaatgtggcgctctccgatttcgttgcgcccggtcgatag

SEQ ID NO: 28698 - DNA, 597 bp, Glycine max
  Peptide Sequence Number=SeqID_120383
atgcttattccccggataccgtcattgcttcttctccgggaaaagaagttcatgacccgtaggccttctaccttcacgcggcattgctccgagtctgggccgtgtctcagtcccagtgtggctgatcatcctctcggaccagctactgatcatcgccttggtaagctattgcctcaccaactagctaatcagacgcgagcccctcctcgggcggattcctccttttgctcctcagcctacggggtattagcagccgtttccagctgttgttcccctcccaagggtaggttcttacgcgttactcacccgtccgccactggaaacaccacttcccgtccgacttgcatgtacaaagctgattcggaattctcttccattccaaggcataacttgtatccaggcgcttcatattcgactggagttcgctcccagaaatatagcccccccacccctcgtgtaatcccacgagcctcttatccattctcaaattattattcgatcacggcatacaaaatagaaaaaacttacattgggtttagggataatcaggctcgaactgataacttccaccacgtcaaggtgacactctaccgctga

SEQ ID NO: 28699 - DNA, 177 bp, Glycine max
  Peptide Sequence Number=SeqID_120384
atggaagacgcacccgtgagccctcgcgtcaccctcccactgaagggtaggttgcgacagttggcgactccactggggactgtttttttccctactgccgcaatatgttttttcgaaggggatgatacctctagaaaccatcaagagagatatgaccaccttgggaattatcactaa

SEQ ID NO: 28700 - DNA, 898 bp, Glycine max
  Peptide Sequence Number=SeqID_120385
atgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctggggggcggagcctatggaaaacgccagcaacgcggcctttttacg

SEQ ID NO: 28701 - DNA, 978 bp, Glycine max
  Peptide Sequence Number=SeqID_120386
atggccaatcaaggagactgggtcccgtttatggatgtgttagctttgctaatttttggggtcgtcctctttccaaacgtggatggtttgatagacctagcagcaatcgacgctttccttgcctaccaccatagcaaggaaagtccggtggtagctgtcttggcagatctatttgacacatttgaccgaagctcttggccgggaataggaggtagaacaatcagttggttcccccgatggaaggaaggaaaagaaggagtccttttctcatgtggaaggtacccaaacattccgctggtaggaacgaggggttgtattaattacaatcccacgctcgctataagacaactagggtaccccatgaggggagcaccgacggaagaaagcatgtctcctttccttgtgagggatctcggcgcacgaaattccaagactatacaaagaatccataaggcatgggaaaccccgttaaggaaagatcaagagcttagaggcattcgtaatggcatcattggtgggtaccacgaatggctgaaagttcgcatacgaggtttagattggctcgccaagttaaaagtcgtcagcgaagagaattttgaagcaccggaagaggacgaagaagtccaagctctcaaaagcgagttaggaaaggcaaaactcgccaaggagaagttcaagttggctgctacacatgtttggaaggagtgcgccgggttacgggaagagaatgcaattaccgcaagagcccttgaacaagagaccaagagggctcgcaaggaagagtatggccggaacaaatttcgcggagctctatggggtagcaataatgaactcaagttgcgaagggaagaaagggaccagtcgcgagcacatagcatggttctgaaagaggagcgatccgcttgttcaaggtccaaaagaagcttgtctcagcgtctatgcgagacagagaccaacatgttagctatcatcgcctaa

SEQ ID NO: 28702 - DNA, 102 bp, Glycine max
  Peptide Sequence Number=SeqID_120387
atgcacagctcatccttcttccagattcttcctcgcgctcagtcgaggagtgttgcgctcagcagatggctcgctaagctagaagattggtttagcgagagg

SEQ ID NO: 28703 - DNA, 291 bp, Glycine max
  Peptide Sequence Number=SeqID_120388
atgccgatctccccctgcggaaggatcgcacccacaaagacacccagtcgacctgaagaagtccaacagggccctagggtttccagctctggttacgggcctctatcaatcctacagggtgcccgtaccccccggcaaggtcacgtcatcatagggattgcgcctgcaagacacccaatggacccgaagaagtccaacagggtcttagagttgtcaagctctaattacgggtctctgtcaattctacggagtacctgtcacctccagcaagggcatcaggccccctactaa

SEQ ID NO: 28704 - DNA, 243 bp, Glycine max
  Peptide Sequence Number=SeqID_120389
atggctcaagaggaggagacttctacagaccagatcccagagccatccccagcacccatacctgatgatgccataccatctgcaccaacatctgagttagagcagcctatctctcaggattcaccagctgctcaaccattagaagagaatgagcatgtaattggaagcatgactgaaaatgttagtcagtttgtcagattgattgtgaaggaatgcattgaccgtatcttggtgagagtgtga

SEQ ID NO: 28705 - DNA, 1191 bp, Glycine max
  Peptide Sequence Number=SeqID_120390
atggcaagccaagagaagtggggcccgtttgcggatatattagctttgttgatttttggggttgtcctctttccgaacgttgatggtttggtagacttagccgccattgatgctttcctcgcatatcaccatggcaaggaaagtccaatggtggctatcttggcagatttgcttgacacctttgactggaggtgtgagaaaagcagtgcacggattgtctgttgtttacccgctctctgtgtatggttggtttcacacctattccaacaagacacaagacacccatgtccgcttcaaagctatcgctcatgcgccgaaaaaggaagagtcgattgggaccaacatttggctgggatagggggtagcgcgatcaattggtttcctcgttggaaggaaggcaaggaaggagttcttttctcgtgtggggactaccctaatgttccactgatagggactagggttggatctaggcgcgcaaggtctcaaggttatacaaagaatcacaaggcgtggaggagtccgttgaggaaagacaaggagcttagaggcatccgaaacggcgtcatcggaggtgatcatggatggctaaaaattcacacgtggggcttagattggctctccaaattgaaagttattgatgaggagaacttcgaagcaccggaggaagatgaagaagtccgagctctaaagttagagctagggaaggcgagactcgccaaggagaagttcaaatcagctgctacacacatctggaaggagtgcaccgagttacaagaggaaaacgcggccactgctagagcctttgaacaagaaaccaaaagggcccgcaaggaggaatatggccgagagaaattccgaggagcattgtggggtagcaacaatgagctcaagctccgaagagaggagagagatcggtcacgggtgcatagcatgatcttaaaagaagagttagttgcttgcgcgaggtccaaaaggagtttggctcaacacttggaagccacggagcaaagcatgttagctatcatagggcaatacaaggaagaattgaaccagtccatggcccatgaacaaaagctagtggaggattttgcacaagtgtatgccgaaaaagaagcaagagggagggtgattgatgcgttgcatcaagaagtgactatgtggatggcccatacaattactgtcagcacatga

SEQ ID NO: 28706 - DNA, 205 bp, Glycine max
  Peptide Sequence Number=SeqID_120391
gattcaacaagcgattctcctcaaatttcagccagcccgtatcaattagacttcacactttatgcttcggggtcatacaatgctcaatggaatgccccggggctcctccgtgacaagcacacgttgcgtttcaagtcgtattctcggagaaatggagactttgtggttgatttagggatggcctttgtggataactgggcggtgg

SEQ ID NO: 28707 - DNA, 282 bp, Glycine max
  Peptide Sequence Number=SeqID_120392
atgggacctctccaaatgcaagcctttcgcaaggcgtacggaaagattttagatttgaccatagcggagatattcatggagggattcgacaagagagttggatcgtgtaaagcaaactcgaaatggcatagtgggcctaccacggaagtacttggaaggcaaggcaagggatatggcgaatcaagaggagtgggtcccgtttgtggacatattagcattgctaatctttggggttgtcctctttccaaacgtggacggtttggtggacctagccgcgattga

SEQ ID NO: 28708 - DNA, 210 bp, Glycine max
  Peptide Sequence Number=SeqID_120393
atggcggcctgctgtactgaccctctctctcatgttcgtaagctgagttgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 28709 - DNA, 714 bp, Glycine max
  Peptide Sequence Number=SeqID_120394
atgagccacagtcgacagcttgacggttacatcacactgctgcagtgttgggtttacgagcatttttcctcggttgcggagtccactgctgatcaggactacgacgaggcttctccgcgtgcgtgcaggtggattgcgacaaagaagaccgtgaagagcatttgcatgccgtcgtacagggagcgtctggaccgactccggattccagatgtctgttggatcccgtatggggagcatcgggaggtctgggacttccacgtcagatcatgctattccggtctcttgcgctgggggcctgttgctgtttattaccgaccggagagggccgtgcggcagtttggttacacgcagaccattcctgctcctcctgtcgattcatgggtctcgtatgatgatatacacgacaggtggatgcactacgaggatcatatcgtacctgcaggtgagccccgagtcgtccctcaggccccacagacgaatatccctcgcgtgccagagctaggagcatcgtctgcggaggagcccagacatgcagtggaagtttgtgaagacattgttgagaggttggagcgccatctgagtctaggggtggtcacgcctggctcatcgacacatgaggtaatcgaagaatgcctcagattggccaagagtgtaacacaggaccatctagtatacgttaggtgtagacgcaggcggcgcactgatcaggcgtag

SEQ ID NO: 28710 - DNA, 264 bp, Glycine max
  Peptide Sequence Number=SeqID_120395
atgccatttttatctgtgacgtgttcacgcaagtgtgccaaaaaccatgcccccgctgtcaacgtctcaccttcaaccaccgcgaatgctagaggaatcacaccaccatttccatcttgtgatgtggccgttaagagggtcccacgatattttccgtacaaattacttgaaagcctctttacattgcccaaaagtccaaaaaaccctatgaaactgacggtgttcgcgactaaccgtattcccaccgataaaatcgtcatgtaa

SEQ ID NO: 28711 - DNA, 385 bp, Glycine max
  Peptide Sequence Number=SeqID_120396
cctcatttcaatgatgggtaatttctcccaggacaattggagatgggatttgcagtggaggataaatctttttgatcatgaacatgacttggctatgagctttatggaagacattacatctatatgtattcagagaaatgtgaaggacattatgatgtggaaagctgaacctaacggtgtgtactccaccaagtcagcttatagcctaatgctgaagctaaatgattccggttcacaagacaggctccccaccaaagggaatctgttaaggagacatgtggatattcaagatgctggttgcccactctgtggccaaggacaggaggaaggcagcaccagaggtgcttgtatttcttttattccagtaccacttgtactgctttga

SEQ ID NO: 28712 - DNA, 480 bp, Glycine max
  Peptide Sequence Number=SeqID_120397
atgacgcgttattggcacagaacaagttgctttctaagcaactggaaaattttaacagaaacacttggttgtaccatttgtgtgaggctcatgaaacagaccaatgtactcccactaaagaaacactcaagaaatcattatatgggaaatcaacagcgacagggtatacttaaagaggatttcaggctaccaacaggtgtagaagcaaggcttcgtggtgaattgatgacaacaaaagatgatgacaaaggtgatgaacaaaaacctcaaagatcaaagaacaaatcaagtgaatcaaagaacatctcaagtgaatcaagaacaagtcaagagttcaagaatcaagaagaattcaagactcaagaagaaaacctagaatcgggaatcaagattcaagattcaagatctcaagaatcaagatcaagattcaagactcaagattcaagaatgaagaaaagactcaatcaagataagtattaa

SEQ ID NO: 28713 - DNA, 200 bp, Glycine max
  Peptide Sequence Number=SeqID_120398
ggaaagtattctacctcgttggaccgtattcgctactaaaacgtagccctcctccgccttcgtttgaggaagcaggctgtgaggcaactatggaatccgccttccctgattccgatgctgttgagcggcggctggtagtgaaaggaactgacgatcttggcttagatggctttgctcctggggacatcatttatcgatag

SEQ ID NO: 28714 - DNA, 225 bp, Glycine max
  Peptide Sequence Number=SeqID_120399
cgtgactcaaatgtcagtatgacagagcttgttagcgtggaagataacgcttttcatcttacagatagcaaaaagaatgtttatacggataaccactcgggtatctctgcccgtcagcgtgactcaaatgtcagtatgacagatcttgtgagcgcggaagatgatatagcaaaaaagaaagcttatacggataaccactcgggtatttccgcccgtcaagcgtga

SEQ ID NO: 28715 - DNA, 54 bp, Glycine max
  Peptide Sequence Number=SeqID_120400
atgggtaaagcaataaaacacccagatgacggtgaagattggtttgaagcataa

SEQ ID NO: 28716 - DNA, 507 bp, Glycine max
  Peptide Sequence Number=SeqID_120401
atgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactaggaggaaggaagccatatcttttctctgggttctgtccctccacgacaagagttgccaagaaggaaggaagaatccagattctatcttcatgcgaaggatgtccaaatgttcccttgatgggaacaaggggttgtattacttataatctcgtcctcgccataagacagcttgggtaccccatgagaggagtgccatcagacgaaagcatcacgcctttcatcgcacggcgtatcagtgaccacaacgcgagggtactccaaggaagttcgcaaggcatgggatgcggcgtgaagaaaggacagagagcttag

SEQ ID NO: 28717 - DNA, 531 bp, Glycine max
  Peptide Sequence Number=SeqID_120402
atggccagagatagattacaagatgttcaagtgaataatatcaagttgaaattgattgctaatcgtgagaaagatggtcgtacatataatgtacctactgttcctgaagttgtagcactaatagtaggcgattttgatgcaaattcaaaaagagatattattattgaaactcagcatggacaactacaaaggatccatgaattacattctagctatctagctctacaataccctctcttatttccttatggggaagatggatatagacctgatattctacatagcagtcgatcagatgaaacacccaaaaaaaaacttcgaggtgacaagttttgtagcttcaacagtcattggatgatggaagtagggagaggcctaaataaagatgaaattgatcaaattatatcagcagagataccttcacagcaagatgatccagaactgtattcattagtaaaaaaacatatggttcatggtccatgtggaagtctgaatcctggatctctatgcatgaaaaaagggcaagtgtag

SEQ ID NO: 28718 - DNA, 231 bp, Glycine max
  Peptide Sequence Number=SeqID_120403
atggcagtggaatggagaaggaagagagagaggagatgccacttcaaggagaagatgagtctagaagaagctcaccaccataggagtccatggataagagcttggaggaagaaggagatgaatgaagggagaggaagagaagagcacggacttttatgctctaaaagagctctgaaatctgaacccactaatccaagatcaagtccaagattctccactcagtgtgcttag

SEQ ID NO: 28719 - DNA, 183 bp, Glycine max
  Peptide Sequence Number=SeqID_120404
atgactcctactcatgatgtcctactatattacaacgggaggtggaacatgtcatgccaacacgactttgtgggttactcgttcacaagaaaaaatccaaaaagatttgacattactttgggatgtagcatcgatggactgaaggatgtgatcaagcaactaggtcattctgagtattcataa

SEQ ID NO: 28720 - DNA, 436 bp, Glycine max
  Peptide Sequence Number=SeqID_120405
atggcttccatgatggaggccatgttaggaatgaggcaactcatggagaaaaaggtggccactgttgccgctgttagttcggctgccgaagcaaacccaactctcctagctaccgcgcaccatcctcccccaaatgcggtaggacgaggaaagagcacactggggcacaacagcaacccccatttaggatacaatcgggtggcttacccttatggattgctgcctaattacacgccgccagtcatgcaagatgatgcgggggatgtcgagttctaccccccgatccccatcgaggaactggcacccaacactttgcctcagcccaacctcacagcacaaccaatattcttgtccacagaaggaccacccccggcgaccgaggaaagaaggaaacttgatctcctcgaggagagattgagagctgttgaaagctttg

SEQ ID NO: 28721 - DNA, 360 bp, Glycine max
  Peptide Sequence Number=SeqID_120406
atgatgagacatgaggacgcagtacaaggtgtttttcatataaaagcacaaaactcaggaggagacaaagataagaagaacaacaaatggaagaacaagaaaccagctgaaagctccaacaagcaacaaaatgatacttttctgccttgtccacactacaaaaaaacaaaccactctaaaaaaaatgttggtggaggcctgacatcaagtgcaaaaaatgtgattgagttagatgagctggaaagtgtttccattctgtccatgacccttgcatgggatgaattttccttctctacttttcaagaagcccattattcacttcaagattctctagaccaggtgcctgacatgcctttttga

SEQ ID NO: 28722 - DNA, 210 bp, Glycine max
  Peptide Sequence Number=SeqID_120407
atggaggagtttgatgcacaggtggcctggccagaagaccaaccttcttcctctggagggggtggggcctccacaacccaggtgcttgtgactgaggagccaccagcaccagcaccatcaccagcagtagcagaggaggagaccactccagctcagaccccacagccatctccaccatctgctcctgctctagaggagactcagccatca

SEQ ID NO: 28723 - DNA, 602 bp, Glycine max
  Peptide Sequence Number=SeqID_120408
atgggatcaagtcaaaagccttcgcttaaaaagaggttctatcaagtcaaaatcaagagcttagagggtagaagtctccatggaaccgatgcatccctttcccagtattatgacagccctaagtgctcacattcgagactccagctagtgccgactgtgaaagagtttaaagaaatctgggatgccactgggaggaaggaagccatatcttttctctgggttctatccctccacgacaagagttgccaaggtagtgaaaatctcagcacaagagttgaaccaggcgaatgggcttcttttattgacatcttggcgcttttgatctttggagttgtcctctttccgaatatggaagggttagtggacctagcagcgattgacgctttcctcgcctttcatcatggcaaggaaagctcggtcgtcgccattttggccatgtatgacacgttcgaccggggatgcccgtctatccgctacaaggtcaccgctcgtgcgtcgaaaagggaaagggagtcaagaacttccccgattgctagccaaggccaaagcagtggcggacacctactccgcccccgaggagatccacggacttctcagctatt

SEQ ID NO: 28724 - DNA, 189 bp, Glycine max
  Peptide Sequence Number=SeqID_120409
atgagtctcagcctgcagagccagggatttacttcttttccgtgccctactccggaccagttcagggcaaaggcaggagaggcaccagcagaggcaccagcagaggctcccgacgaggcagatgaggcccgcgacgacgaggagatgaccgatttacttgatttcttaggagggagcggggccacatga

SEQ ID NO: 28725 - DNA, 168 bp, Glycine max
  Peptide Sequence Number=SeqID_120410
atgtctgagattagaagaaaacccgttcgcattgtagcttttattttcccgcagaaaccaaaaactgtctcggaatcgcatgaagacagtacaagcggagacttcgatctcttctccgtctctttgacgttcgagaattctatcggagcagtcgaaggaaaaacttga

SEQ ID NO: 28726 - DNA, 222 bp, Glycine max
  Peptide Sequence Number=SeqID_120411
atgatgacaaaggtgatgaacaaaaagctcaaaagatcaaagaacaactcaagtgaatcaaagaacatctcaagtgaatcaagaacaagtcaagagttcaagaatcaagaagaattcaagactcaagaagaaagcctacaatcaagaatcaagatctcaagaatcaagatcaagattcaagactcaagattcaagaataaagaaaggactgaatcaagataa

SEQ ID NO: 28727 - DNA, 195 bp, Glycine max
  Peptide Sequence Number=SeqID_120412
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggagagtcctcccatctttagcccttggatgcacaaaggaaaactaa

SEQ ID NO: 28728 - DNA, 570 bp, Glycine max
  misc_feature (58)..(58): n is a, c, g, or t
  Peptide Sequence Number=SeqID_120413
ggtcggaacaggagagcgcacgagggagcttccaggggggaaacgcctggtatcttantagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgaactcaccaagggaagaccttgggtttgatgagcctttgaagattcaatcgaggatagttcatcatgggtttggtgagactcaccaagggaagaccttgggtttgacaagccttggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 28729 - DNA, 276 bp, Glycine max
  Peptide Sequence Number=SeqID_120414
atggggtcatccatacttcccaaatctttgcctaccatatttgaggttggacgattcatttgcttgaggccagatgggagcattgggttcaccttagcgacagcgcttaatagcggcaactataaccgcattggcttccattatcttcttcatgctcatcatggcctttatcattgtggccatttgctcttttatggcctccattttttggccttcatcttctcttgcaccttctctgcttcacccattactctagctctagcacgagttcggtaa

SEQ ID NO: 28730 - DNA, 198 bp, Glycine max
  Peptide Sequence Number=SeqID_120415
atgggagcactatgttttagagggtttattcaactcttaaatcatggctccactgaaagtgctttgtctgagatggttgaaaggaaccagccattgggatatatttatgggccaatttgcccattagcaaaagaaacaatttcaagtttcaacaacaatcttgaagcaagtacaaagatgtatttgcaaaatcattga

SEQ ID NO: 28731 - DNA, 405 bp, Glycine max
  Peptide Sequence Number=SeqID_120416
atgggttctccacctgcctccactcctcctcctcctccttcacctccttctcctcctcctccttcggacgcatcggcttcgccatttgtcgtgaagcggacacgcaaagcctcactggtgcatgttgatcctgctaccgggaaggccgacggtccccacaggaagaaattaagaacatatttggggattgtggcgcatgataaggtggacatcaccaacgagaactggaaggagatccctactgctcagaaggacctgattttgggaggatattcagacctcacgaggaaatgggcccttgaagccgatcaggacggtgtcgaggacactgtctgtgacaaatacggcatcaacaaggaaaagtgggcccagttttgccagactcgcagagacccttcttgggag

SEQ ID NO: 28732 - DNA, 480 bp, Glycine max
  Peptide Sequence Number=SeqID_120417
gcttcgcttctacgactgcctccccagccgttgcaaagactgagcgagaacggtaaggggcgaagaatgtcgttgcgcggggatgcgattagccaagctggggcaaacaaagccgtccggccccctaccggattgggaatgcgaaggcctttccttcgaaaggagaccggggaaataaagagctatgctattgaccgaccctttcgtagtgacttcgaatcaatagctgctcgccctaccgaagtactaaaggctttcgaggcttacactccctattacacgacaaaaaaggggggagccctcttatctatcaatggaaagatctccgtgcgtggcgtgataaggaatcctagaaaagatcgattgagactccctccccggtcccacgaagatctctacgtacttgtccagtccaggacaactgagatcttccggtctgcgtgcgtgggagcagctcaaataaagaagagtctggtctga

SEQ ID NO: 28733 - DNA, 444 bp, Glycine max
  Peptide Sequence Number=SeqID_120418
atggagttcctaaaaggcatggtgaagctagtggttgccactgcagtggtgtgtttggttgtggccttgtccttctaccagaagctggggctagagctagagatggttgttgctattattggagtaggggtagttgttaccgtcttcggcctggtttttgcttttggagattttgttccatcagaaagtgttagtcctagtgaagacaatgttgtggtcaatagtaagttgtctgaggaggataaaagctactcttcagggtgtcttgacttgctgggttttctgttgagccttgacttccttgctcccactccaactcagcttcacactagtttgttggttgaattgttggtggccattgagttctttattggattgttgctctatttttggaccgtgttgctcatcatcacagtgtttttattacttgttcactgtgattaa

SEQ ID NO: 28734 - DNA, 507 bp, Glycine max
  Peptide Sequence Number=SeqID_120419
atggtggcgcgtgtaatgctcaggaacggatttgagcgcggaatgggtctatgcaaggacggcctcggaaatgccgacgtggtcgatatcaatggaaatccatacaaatatggattagggtatgaacccgggatgctggggaggaggaatgtgccgtcaagacttcgggcggatagggtatggcccggctgtattagccagtgtttcaccagtgccggaacggtgtccgaggaggaggtggccgcagtagaagaggaatatgagggtcgattctttgaggatcctaacaatgagggtttgacaatcgatttcgaccgagatgtaagccaaattatgaacgaagaagaagaagaggacgtcctttcaccggagttggagaggttgattgctcaggaagaacgtgaaatgaagcctaaccaagaaaaaaccgaattggtaaacttggggaccacggaggaaaagaaagaagtaaaggtaggaaccggtatgaccgcgcctatccgataa

SEQ ID NO: 28735 - DNA, 207 bp, Glycine max
  Peptide Sequence Number=SeqID_120420
atggccaagaaaggggttgtcgcaacctacccttcggcgggagggcgacgcgtgactcgcgggatgcgtgttccacgaaaggaatacgcgcggagtcgccaccaacgtttatttgagccaaacgtcggaaaaatcggaaaagacgcgatctacgaacttttaagtgaaaggttcgggagttgtatttacgcacggggaaggtgttag

SEQ ID NO: 28736 - DNA, 441 bp, Glycine max
  Peptide Sequence Number=SeqID_120421
atggcaagagctggtgacaatggtggtgtatatcatcaactggacgaatctcaacgcttatttctggacgcgtggactacacaaatgcaacgtttgttgaccaaatcttccttgtttactcttaaacctctatcccctagagaagtgtgtgatgaccaaatcagaatgggagaaaagagagaagaagagaaagaaaatagtgaggcaccacaaaggaatatgaaaaagaagaatgaaagctatgtgaagcaagcccacaagaaaaggaaggaagtggtacttgaacacggtgatgatcctgaacatttgaggacaaatgttttccaagaaggagggaatgatgagaatcatgaaactggccaaatacaggctaaaggcccaagtggagaagaacgaaggcccaagtggagaaggacaaagcccccgagtggagaaggatga

SEQ ID NO: 28737 - DNA, 393 bp, Glycine max
  Peptide Sequence Number=SeqID_120422
atgattgaacatgtattggcgatcaaaattgccattccctgggatacgggattgaaccaagctcatgcttttacaaaaagaaaaggacacgctttacagcgcccttaccgaactcgtgctagagctagagtaatgggtgaagcagaggaggtgcaagagaagatgaaggccgacatggaggccatgaaagagcaaatggccacaatgatggaggccatgatgagcatgaagaagataatggaagccaatgcggttatagttgccgctactagcgctgtcgcacttattttttttaatatgcacttattcccctttgctcctctattcctttgggatttagccacttattccatatttctccataccttgtccttggccccattacaaccttaa

SEQ ID NO: 28738 - DNA, 414 bp, Glycine max
  Peptide Sequence Number=SeqID_120423
ttagctgctacacacacccggaaggaatgtgccggattacgggaagagaatgcaactaccgtaagagcccttgaacaagagaccaagagggctcgcaaggaagagtatggccgtaataaatttcgcggagctctgtggggtagcaacagtgaactcaagctacgaagggaagagagggaccagtcgcgagcacatagcatggtcttgaaagaggagttagttgcctgttcaaggtccaaaaggagcttgtctcagcgtttatgcgagacggaaaccaacatgctagctatcgtcgccaagtaccaagaagagttaagtctagccacggcccacgagcatagggtcgcggacgagtatgcccaagtatacgcggaaaaagtggctagaggaagggtgatcgactctttacactaa

SEQ ID NO: 28739 - DNA, 189 bp, Glycine max
  Peptide Sequence Number=SeqID_120424
atgaagactcagctccaaactcgaaaatggaggacacatgaacagcccaaagcaataagattcatgtggctccgaaaaaaggcaatcatgaaacacagctccaaactcgaaagtggaggacacatgaacaaccctaacaataacattcatgtggctccagaaaaaggtgagaatggaggattgccttga

SEQ ID NO: 28740 - DNA, 237 bp, Glycine max
  Peptide Sequence Number=SeqID_120425
atggggacaaatcaaaacggacaaagattctatcaagtcaagatcaagggcctagatgtcactagccttagggagttgggatggttgatgggacccctccaaaggaaagccttccgcaaaatgtacggaaagattttagatttaaccacaacggaggtatttacggaagccattgtgtccctcgcccaatactatgaccagccgttgagatgcttcatatttggggacttccaaata

SEQ ID NO: 28741 - DNA, 611 bp, Glycine max
  Peptide Sequence Number=SeqID_120426
ggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgccggataacaatttcacacacggaaacagctatgaccatgattacgaattcgagctcggtacccgacaatgcataaaaagcaaaaaaggaaggtctgaggaaggacagagttgtgcagatccgaggaagacaaacagaccaattacatcaagtcatttggccacgacatcagagaagagagaggggtcaccaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 28742 - DNA, 811 bp, Glycine max
  Peptide Sequence Number=SeqID_120427
atgacgacatcggctcgcctcagctggcgggccttttcagcatatgaaggtaacgcggtgaatattcaggctcttctttccgataaagtcagtcaggcgatggtggcggcaggcgcaccggccgattgcgaaccgcaggttcgtcagtctgcaaaagtgcagttcggcgattaccaggcgaacggtatcatggccgtggcgaaaaagctcggtcaggtgccgcgccagctggctgagcaggtagttcagcatctggatctggctggcatcgccagcaaagtcgacatcgccggtcccggctttatcaacatcttcctcgaccgccagtggctggcacagcaggccgcgcaggcgctgcagctgccacgcctgggcgtcagcgaagtgacacctcagactatcgtaattgactactcggcgcccaacgtggcgaaagagatgcatgtcggtcacgtgcgatccaccatcatcggtgatgccgcagtgcgcacccaggagttcctcggccatcacgtcatccgcgctaaccacgtcggtgactggggcacacagtttggcatgctgatcgcctatctggagaagcagcagaacgagcatcatgaagatatcgcgctggccgaccttgaagccttctaccgcgaagcgaaacgcacctatgacgaagacgaagccttcgccgagcgcgcccgcggttacgtggtgaaactgcagggtggcgacgaatattgccgcgccatgtggaagaagctggtggatatcaccatgagtcagaaccagcaggtgtatgaccgccttaacgtcaccctgacgc

SEQ ID NO: 28743 - DNA, 81 bp, Glycine max
  Peptide Sequence Number=SeqID_120428
atgcaagaggcaataggcaggaacccagagaccgaagaaaaggtcggagatgctaaacagaatgagaatgaagataagtag

SEQ ID NO: 28744 - DNA, 783 bp, Glycine max
  Peptide Sequence Number=SeqID_120429
tggattccttttgacgtagatgccctcagccagttcctgggtgacccgctagtgttggaggaaggccaggagtgcgagttcagtcagaggaggaacaaggccgacgggttcaacgaggaggccattgcccaactattatgcacactggggcaggatttcgcccggaccgctgcagggaggcgggtgcggatcatgcacaccagcatgaccaccttgacccagatatggatgagattgctgctcagcaatgtcttgcctagtgatcataactccgatctccctctgctgaagtgtcagttggtgtatgccatcctgacacggatgagcgtccacgtggctccgttgattgctgacgccatctatttgtttgaaggtatgccacccaccaggcaccctctagacccggataagtctaacagggccctggggtttccagcattgatcacgggcctctgccagtcattcgggggtgatgcacctcaggccgcagatgcaccgccaccacctcatcaggccgatcccgctgggtcactaggcatggagcgttatctacaacacttggtttgccagcaggcggccaaccatcggggcctcagtcagcaggggcagggtttcgctcctttcgcgtgccttactccagagcagtttagggctgaggtcacatggcccgaggcccaggtaggggaggcgcctgcaggatcccccgacgatgcagaggaggcccgcatggatgaggagatgtcggatttgctcggtttcttgggaggaagcgaagccacatga

SEQ ID NO: 28745 - DNA, 246 bp, Glycine max
  Peptide Sequence Number=SeqID_120430
atgtcagggaaaaaccatcttgggggagaccagtcagggtcacgatgttttgtgagaatgctccaaccatatgagatcagcataggcttaaaggagcactcaaacccggtgacccccaaggcctacactccgaagggttcgtcagggcctctccctcctgattcaagtccaacccctaaaataattttgcatgcagacactgctcatgaattatacaatacccacgacctcacactcgtgttttaa

SEQ ID NO: 28746 - DNA, 687 bp, Glycine max
  Peptide Sequence Number=SeqID_120431
atggagagaagtatgatagatgctgccaatggtggagcccttggagacatgacgcatgtagaagccagaaatttaattgagaagatggcttcagactcccagcaatttagtgccagaaatgatgctattgtcattaaaggagtgcatgaagtagccacgaattcatcttcatcagctgagactaagaaccttgaaggtaaactagatgccttggttaacctggtaacccaactggccatgaatcaaaaatctacacctgtcgccagactctgtggtttatgctcctctgtcgaccaccacatagacctttgcccttctgtgcaacaatctgaagcaattgaacagcctgaagcttatgctgcaaacatctacaatagacctcctcaacctcagcagcaaaatcagccacaacagaataattatgacctctccagcaacagcaacaacaacaacagccttatttttcagaatgttgctggcccaagcagaccatacgttcctccaccaatccagcagcaacaacagcaacaactacagccccataaacagcaaacaattgaggctcctccgcaaccttcccttgaagaacttgtgaggcaaatgactatgcaaaacaagcagtttcaacaagagaccaaagcctccattcagagcttaactaatcagatgggacaattggctacatag

SEQ ID NO: 28747 - DNA, 198 bp, Glycine max
  Peptide Sequence Number=SeqID_120432
atggagtcgccaactgtcgcaacctgccctatggcgggagggcagcgcgagggctcacgggtgcgtcttccaagaaaggaaaatgcacggagtcgccaccaacgtttattcgaggaaaatctcggaaaaaccggaaaagggtgtttcccttgctcatacgtattgctcaattgtgataagaaaattagacctacgtag

SEQ ID NO: 28748 - DNA, 1498 bp, Glycine max
  Peptide Sequence Number=SeqID_120433
actcaagattgagcagttcagcgatgtcagtgcctggggtgcaccgcggatgctggcgctggatacgcagggacggctgcttgtcagcctcaccgataccggccgcattctacgcctcaaccaacaaggcgaagcagaggtcattgcacaaggcctcaatgcaccgcacgggctggcattgctgggagacgatttgctggtggctgagcaaaccggtgtggtcaagctgccaaagcaaggcgatggctggggagcgccacaaccactgatccgcaatttacccagtggtggacatagtcttaaaacagttaaagtctccccagatggttatatttttatcaatgtgggctccagttgcaacgtttgcctggaggataaccctctccgcgccaccctgttacgttatacgacagagggccgtcctgccggcgcggtactcaccgtcggccgacacgctcaaagtgctatctggagcaccgggttgcgtaatacacaagggtttacctggcatccggaaaccggagacatgttcgccaccaacaatggtgcagataaccgcagcgccattaaaaatggcaaaacagatgatgacctaccacctgaacatctcaataaaatcgaagcgggaaaacactatggctggccctattgctggggtgaccccggccagccagggcaattattccaggaccccaactttactggcgagcctgatatctgcaaacaggcacaagcacctgctttgaccatgcctgcgcacagcacgcctatcggcatgacattcctgcagcacagtcgtttgccaacgcaaatacaacaagatgcaattatcgccctgcacggctcctggaaccgcaaacaacccagcggctacgccttgctgcgtgtacaattcaggaaccaactgcctgttgcagccgtcccatttatcagtggctggctacaaggtcaaaaagcctggggaaggccagtggacgtgattgtcggtgcagatggctggctctatgtttcagatgacctgaccggctggatttaccgaatacgcagtgcgcaaccttcactggtgatccaagtcccggaagctttttatcagcatccggtacgcctgttgaatccttatttgaattactggcacaatcgggctgaggcggccgaaactgttgggctcagcagcttccagtcaaaaaactataccacctccagctgtgaggcagaagccaaaggccaggcgctggtcgtgatagaaccaaacatgttttacaacccgcaaaccggtatcttttacagcgaaattaccgcgaaggtctataaccaacccgcggctgacagcgcactgggcaagccactgatgacggtgaaaggccaaggccaatcacgcggctggttgacctataatgtagaatatttcacccatcagtcttaccagcaggcgtttgaccaagtcattcagcaattgcagcaaagcccggctttccagcagtccgttgagcaggctcca

SEQ ID NO: 28749 - DNA, 252 bp, Glycine max
  misc_feature (113)..(113): n is a, c, g, or t
  Peptide Sequence Number=SeqID_120434
atgaaccctaaaagaataaaggtcattcctaagtggcccactccaccaagtataaggaaaatttggggcttccatgacttaacaaacttgtacaaaaggtttgtcccatattnttctatacttggggaagatgcccaggatatggctattgaggaaaaaagcctagagtttcaagaaccttgggatttaaggtcaaatccttttcaaggggaagggaatgatgcaatcctaccccgcaaaggcattggatag

SEQ ID NO: 28750 - DNA, 1105 bp, Glycine max
  Peptide Sequence Number=SeqID_120435
atggccctggccggggtaatgatggtttcctcgtcggcccatgctattagcgttaccggcgaagccggcgagcactatactaacctcggcgttggcttcggaaccgaatccaccggcctggctatttccggcaactggttgcatagcgataacgacggcgacgccgcgggcttaggtctgggtctgaatattccgctgggaccattcctggcgaccgtgggcggcaaaggcatttacaccaatccgaagcagggcgatgaaggttacgcggcagcggtcggcggcggcctgcagtggaaaatcggcgatagcttccgtctgtacggcgactattactactcgcctgattcactctccagcggcatcgatagctatgaagaagcgaacgtcggcgccagctggaccatcatgcgtccgcttagcatccaggcagcgccagcttctaatcctccggcgcggccttccgccgcgccaaatttcttcgtcgccagcccgcgcctttgcgctatagtaattcgacttatcaggctggagttcataatgctacaagtggaaatgctgtccaccggcgatgaagtgctgcatgggcagattgtcgataccaatgccgcctggctggcggattacttttttaatcagggtttaccgttaacgcgccgcaataccgtcggcgatgacctcgatgcgctggtggctattttgcgcgaacgcagcgaacaggcggatgtgctgatcgtgaatggcggcctggggccgaccagcgacgatcttagcgcgctggcggcggcgacggcgaaaggagaagggttggtcctcaacgctgaatggctggagacgatgacgcgattctttgccgagcgcggtcggccgatggcggaaagcaatcgcaagcaggcggaaatccccgccagcgccgaaatgatcaataacccggtgggcactgcctgcgggttcgccgtacagctcaaccgctgcctgatgtttttcacccccggcgtgccgtctgaatttaaagttatggtcgagcaggagatcgtaccgcgtttacgtgcgcgcttcacgcttccgtcgccgcctgtctgtctgcgtttaaccaccttcggac

SEQ ID NO: 28751 - DNA, 366 bp, Glycine max
  misc_feature (71)..(71): n is a, c, g, or t
  Peptide Sequence Number=SeqID_120436
gtatccggtaagcggcaggctcggaacaggagagcgcacgagggagcttcaagggggaaacgcctgggggncggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccttggaagacgcacccgtgagtctcgcgtcgcccttcctccgaagggtaggttgcgacacacggcaatagaattgttctaa

SEQ ID NO: 28752 - DNA, 411 bp, Glycine max
  Peptide Sequence Number=SeqID_120437
atgaattgcttaaagaacttgccaggtgttcgcatgagtacatggacctctttcggtggcacagagagatttgaacaattaaagttgtccctacttgttgatggattttcaaaggttagtgtggacaagtggatggatataacagacatgggatatgtgattgcttcacggtataacgtaatccttgtatcgttgtcccaacaacaaagcatgacatttttccctcttagaagtcaaccaccacctgactcttttggccaccgcatcatatgtgtcggtcacgtgtttggaaatcattttgttcaggtttatttgaaagaccatccgttggacgtcccttttctggaggagctttgtgtacagaccaattggttatgcgaggctgaagtcaaagcatcaggaagagattga

SEQ ID NO: 28753 - DNA, 314 bp, Glycine max
  Peptide Sequence Number=SeqID_120438
gccacgcatcagatcctctgcctcatggtcacgccccacagccccgagtcgtccctcaggccccacagacggatatccctcacgtgccagagctaggagcatcgtcgacatctgcgaaggagcctagacatgcaatggaagtttgtgatgacattgttgagaggttggagcaccatctgagtctaggggtggtcacaccaggctcatcgacacatgaggtgatcgaagaatgcctcaggttagccaggagagtgacacaagaccatctagtatatgttaggtctagacgtaggcggcgcacggatcaggcatag

SEQ ID NO: 28754 - DNA, 333 bp, Glycine max
  Peptide Sequence Number=SeqID_120439
atgcaatcacagggacttgcactgcctccggagcttaaggggagttgtgttgatccctcagtgaccgatctagacacgggtgactcagacaaatgcgggttgtacatcaaagaaaatccttcccgcctggttacccttggaagagtttatgagggatccactgccgttcacaacatccctttgttgcatggccaagtgaaggttggtgttgaggaggttgaagatgtagatgctcccgttcctgtacccactgacgagattaacttagtgggacagacacttaacaccttccttgcttggtcgacgcatctcgtgaagcgtttatcagaatag

SEQ ID NO: 28755 - DNA, 156 bp, Glycine max
  Peptide Sequence Number=SeqID_120440
atggctggtatatttttcaaagagaaaaatagcttggaggttatgagtgatttgaaagaaatgaatccgaatagagttggtgtgtcctccactgtcctcgttgattatagggagcctgctggaagcctgaaaatcctccttgagtatacctttgtc

SEQ ID NO: 28756 - DNA, 178 bp, Glycine max
  Peptide Sequence Number=SeqID_120441
atggtgggttacacgccttcaagttttgcggatttggtcttcgctggcgaaatgatcaaagatgagaatgagggagaaacccatgctgtggctgccattcctatatggccaagtttcccaccaacccaacaatgtcattactcagccaataacaacccatctccttacacaccaccca

SEQ ID NO: 28757 - DNA, 207 bp, Glycine max
  Peptide Sequence Number=SeqID_120442
atgtgcacgtatgcaatttttgatagccaaagtgctttgagtatgcatgaaatggccccgaggaagctcgcctcaaagaggtctaggaaggataaggcggccgaaggaactagttccgctcctgagtatgacagtcaccgctttaggagcgctgtacaccagcagcaattcgaggccatcaagggatggtcatttctccgggagtga

SEQ ID NO: 28758 - DNA, 342 bp, Glycine max
  Peptide Sequence Number=SeqID_120443
atgactgagagggaaatgatcacgattatggtagatacgctgcctacgttctactacgagaagctgataggatatatgccgaccaactttgcagacctcgtcttcgccggagaaagaatcgagtccggactgaggaaaggaaagtttgaatatgcctccaacgctggccccaacagcaatagaagagccctagtggtgggcacacggaaaaaggaaggggatacccatgcggtcaccaccgccccaacgtggatgaaaacgccccaaaatgctcaaaactcataccaacacaaccacccgaacttttcgatccgagcgaaagttccctcccaactcaagtag

SEQ ID NO: 28759 - DNA, 273 bp, Glycine max
  Peptide Sequence Number=SeqID_120444
atggctcgcaccaacaaaactgggcagatgacatctgaggcagcaaaggaaatcgctgagaagattagcactctggtcgtgtccatgcaatacttcggatcgactccacaaacctcccgcagttcttccttcatgtctcctgaagacctacagcagctgacccaacaaatcagggaccagctggaggagttgatcatagaaaaagtgactcggcagctgatgacatccttcaaccagatgcagtctcagtttaagtctcagatgcaatcatag

SEQ ID NO: 28760 - DNA, 969 bp, Glycine max
  Peptide Sequence Number=SeqID_120445
atgatcgccgactatattcaatcgatcctcgacgcacctgcgcaggtggcggcgctggcacgggcaccgctgatgctgtcgcgtgatatgcagaacaccctcgacggccatttacagcagcagcgtcagcagccggccagcgccggtcaggttagcgtgttcggcggctatgccggtcagcatattgattatcgcggcgatagcctgctcaacggtgacgccaataccggcagcctgacgctgggattaggctatcatttcaccgataactggcaggcaggtctgctgttgtcgagcaccgcgcagcaccagcatccgtcggcgcactacgactacaagctgcgcggcaatttgctggcgctgtatagccagctgacgctgctggagcagggctggatcaatgcggatgtgcactatgccgatctcgattttgacagcatcgaacgtcgcatcaatatcggcccggcaacgcgcatcgaacagggcagtagcagcggaaaaatgctcgggctacgggtgcaaaccggctgggatctgccgataggcgaacacctttctaccggtccggttgccagctacgcactggattatgtgcggccagggggctacagcgaaaacggcgacagcagtaccgctatgcgcttttccgatcaaaccctgcattcgcaaatcggcgcgcttggctggcgtatcgacagcaaacagtggccggtgaatccgtgggcgcagctcagttataaccaccagttcggcgatacgcagaacgcggtgcgcgccgggctgaagtcaacgcagaccggctttgtacgcagcgtcagcgccggtgataaagactggctggatatatcgctgggggccagcgtgccgctgggtgaaacggtcaacgcctttgccggggtttctgcggtcggtggcaacagcgcctatcatcagctgagctggaatattggcctgaacgcgacattttga

SEQ ID NO: 28761 - DNA, 237 bp, Glycine max
  Peptide Sequence Number=SeqID_120446
atgcctggccaagtaaaggtgggtgtggaggaggttaaagatccagatgctcccgttcctgtacccactgatgaggcagctgtgtctccggcaaaaccacctcaaaagtcgtatccgaagatcgatgatccgctttatctgatgacattgaccatcctagagcttttcttgaggccttaccaggttacatgggatgctaccatgtttggggtttttaatccagacttcccactctag

SEQ ID NO: 28762 - DNA, 335 bp, Glycine max
  Peptide Sequence Number=SeqID_120447
gtatgctgcctactaggcaccctctagacccagataagtctaacagggccctgggttttccagcattaatcacgggtctctatcagtcgttcgaggttcctgtcatacttagtaaggtgattcgactgccgatcaccggggctttcatagagaagtattgcacgcctagacaggcgcagggtggcgacccggcagaggtcgcatggcccggagattggcccaaggcccaggcaggggaggcaccagcagaggctcccggtgatgcagatgaggcccgcatggacgaggaaatgacagatttactcaatttcttgggagggagtggagccacatga

SEQ ID NO: 28763 - DNA, 520 bp, Glycine max
  misc_feature (15)..(15): n is a, c, g, or t
  misc_feature (29)..(29): n is a, c, g, or t
  Peptide Sequence Number=SeqID_120448
ccaacactgcccccncacgttttgtctcngtgggggttatgaatatttggagcaaaatctcctggttgagaagactaagaagaagctggaggaagctgcacagtcaggaagcgttgatggcgtcatcgaccctctatcccttgtcagatgccacatgaagtggaagatggctcgcaccaagaaaacaggggagatgacgactaaggccgcaaaggaaatcgttgagaagattgattcctttaaggagcaggcgtcacagggatccttcgtcccccatggacgtcaggatgttctcaccgctgctattggatgtccagagcaccctggacgtgttcgtgctgctggagctggtgtcaccatcaagcaatacttcggatcggctccacgaacgtccctcagctcttcctcgctgcctcctaaagaattgcagcagctgacccaacaaatcagggaccaattagaggagtcgatcacagaaaaagtgactcggcagctcatggcatcattcagccagatgtag

SEQ ID NO: 28764 - DNA, 192 bp, Glycine max
  Peptide Sequence Number=SeqID_120449
atggacacccgtctccgtgtgattggtgatcccatgaatggagttcaacggggtgagggtcacaactcactctttgaggattcacctagtgagtgtggtggtggggccgccactgtgagatataggctaatctctaagggacactcacgaaacaagatacaagcgcaaggccgtgtaacgcgctaccactga

SEQ ID NO: 28765 - DNA, 504 bp, Glycine max
  Peptide Sequence Number=SeqID_120450
gcaatccatctgacttacaaccctttgatcctgagatagataagacatttcatagattagttaggcatcattttataccttttgatcattctgagcattccataactggtgaatctgtgcattctgttattggtgattttgaacatcctgatcttgagcattataatttcgagcattctgattctgagcattctgattttgcacattctgagaacatggcacaacctccacctcatcaagtcaagaactggttccagagtaatcctgagttccttaaacctgctgatccggagacatctttgtttctaaatcagaagtcgcaactggcagcattcttagcaagctcaaaatctaaagagagtcttgctcagaatctcaaagaagttctccaactacttcaacaggaagtggaagaagaaccttccaagaaggaagctgaatcatccgagactaatgatgaccaagaagatgatccattctaccagaatgaagatgactgttttg

SEQ ID NO: 28766 - DNA, 639 bp, Glycine max
  Peptide Sequence Number=SeqID_120451
gcaaaacaccttgcattcatacggctgcacaccttcgccttcagaggactacacgtcctcaccttcagagggctacacgccctcgcattcgaagggctgcatgccttcggcttcatagggctacacgcattcgcctttagaggattacacatcctcccctttagagagctacatgccctcgcctatagaggactacacgccctttccttcatagggctacacgccctcgccatcagagggctacacgtcctcagcaccagaggactgcacgactatacgcactcccctttagagggctacatgccctcgccatcagggagcttcacgccatcgccatacgagggctacacgccctcgcctttccttcagagggctacacgccctcttctttccttcagaaggctacccaccctcaccttcagaggactacacatcctcgcctttagagggctggatgccctcgcctttagaggattacacgtcctcaccttaagaggcctacacgtcctcgccttcagaggactgcatgtcgtagccttcagaaggctacacgccctcgccttcaaaggactacacgtcctcgcctttagaaggcaacaggccctcgccttaagaggactacacgtcctcgccttctaa

SEQ ID NO: 28767 - DNA, 414 bp, Glycine max
  Peptide Sequence Number=SeqID_120452
atgtgcagtcctctgaaggtgaggacgtgcagccctctaaaggcgaggacatgtagccctttcaaggcgaggacttgtagtcctctaaaggcgaaggcctatagccctctcgaggcgaggacgtgtagtcttcagaaggtgaggacgtctagccctctaaagacgaggacatgtagtcctctgaaggcgagggcatgtagccctcttaggccaggacatgcaaggacgtgtagtcctctaaaggcgaggacgtgtagtcctctaaaggcgaggacgtgtagtcctctgaaggcgaggatgtctagccctcttaaggttaggacgtgtagcccatggaaggtgaggatgtgttgtcttctgaaggctagggcgtgtagccctcagaaggcaaggcaagggcgtgtagccctctga

SEQ ID NO: 28768 - DNA, 1117 bp, Glycine max
  Peptide Sequence Number=SeqID_120453
aggactacacgccctcgccttcagagggctacacgtcctcgccttcagaggattgcacgtcctcgccttcagagggctacacgccctcgccttcagaggactatacatcctctccttccgagggctacacgcccttgccctcagaggagtgcacgtcctcaccttcagagggctagacttcctcgcctttagaggactgcacctcctcgcctttagaggactacacatccttgccttcagaggactacacgtccttaccttcagaggactacacgtcctcgccttcagagggctacaagccctcgccttcaggggactacatgtccacatcttcagagggctacacgccctcgccttcagaggattacacgtcttcgtcttcagagggctacatgatctcgccttcagaggactacacgttctcgccttcaaaggactgcatatcctcgtcttcagagggctacacgccctcgacttcagaggactacacatcctcgccttcatagggctacacaccctcaccttcagagggctacacgacctcacattcaaagggctgcatgccatcgccttcaaaggaatatgtgtcctcgccttcataggactacacgcccacgccttgatgcaatcctaccccgcaagggcattggatagaaaactccaagtagattgggccaaagatgcaagagaaggccctagggttcttatgagccttagggcctacaagctccaatggagcttgcatcatgccttcagaaggctacacgcgttcgccttcagaggactacacgtcctcgccttcagagggctacacaacctcgccttcagagaactacacatcctcgccttcagagggctacacgccctaggctttagagggctacatgccctcgcctacacaggactatactacctcacctttacagggctagacattctcgcctttagaggatggcacgtcctcggcttcagaggactacacgtcctagccttcagaggactacacatccttaccttcagaggactacatttcctcaccttcgaagggctacatgccctcgccttcagaggactacatgtcctcatcttcagatgcctacacgcccttgccttctga

SEQ ID NO: 28769 - DNA, 1457 bp, Glycine max
  Peptide Sequence Number=SeqID_120454
gactacacatcctcgccttcaggcggctacatgcactcgctgtaagagggatgcacgtcctccccttcagagggctacacgccctcgccaatagaggactacacatccttgccttcagaggcctacacgccctcgccttcagaagactacacatcctctccttcaaagggcttcaccccctcaacttcagaggattacatgtcctcaccttctgtgtgcagcacgccttcgcctttggaggactacacatcctcaccttcagagggctacatgccctcatctttagagggttgcatgcccttgccttcatagggctacacgccctcgccatcaaagggctacatgccctcgcctgtagagggttgctcaccctcgccttcataaggctacacgccctcaccatcagaggactacacatccttgccattagaggacttcacgtccttgccatcagagggctatacaccctcaccttcagagggttgcacgccctcacgtccaaaggacagcacgtcctccccttcagagggctacacgccctcacctatagaggactacatgtccacagcaccagaggactgcgcggcctcgccaccagaggactgcacgtcctaggcactagtggactgcccgtcctcggcaccagaggactgcatagtgctacacgccctcgccatgcctttagagaggtacacaccctcaccttcagagaactacacgtccttgccttcacaggggtacatgccctcgcctttagaggactacacgtcatcgccttcagaagactagacgtcctcaccttacgaggacaacacgatcttaccttaagaggactacacgtcctcacctttagagggctagacatcctcgccttcagaggactgcacgtcctcgccttcagaggactacacctccttaccttcagaggactacacctccttaccttcagagggctacacgccctcgacttcagaggacaacacgtcctcgccttcatagggctagacaccctcgccttcgtagggctacaccccctcgacttcagaggactgcacgtcctcaccttcagagggctaaacatcctcgcctccagaggactgcaagtcatcgccttcagaggactacacgtccttgccttcagaggactacatttcgtcgcattcagagggcaacatgcccttgccttcagaagactacatgtcctcgacttcagagggctacacgccctcactttcagaggactacacttcctggccttcagagggctacagaccattaacttcagaggactacacatctttgcctttagaggggttgacgccctcccctttagaggactgcacgtcctcgccttcagtgggctacatgccctcgccttcagatggcttgaagccctcgccttgccttcagagggctacacgcccacgccttcagacggctacatgcactcgccttaa

SEQ ID NO: 28770 - DNA, 1147 bp, Glycine max
  Peptide Sequence Number=SeqID_120455
atggccgaagatcttttgaagaaaccaagaaatggtaggactttagaagaggttggtcatgagtattttgatgatttggtttcgagatcatttttccaacgttcaagtacaaatagaagtagttggccttttggcaaatgttttgtgatgcatgacctcatgcatgatctagccacatcactcggtggagatttttactttagatcagaagaacttgggaaagaaacaaagatcaacaccaagactcgtcatttgtcatttaccaaattcaattcttcagtcttggacaactctgatgatgttggtagaacaaaatttctgagaactttcttgtccattatcaattttgaagctgctccattcaagaatgaggaggcacaatgtatcatagtgtcgaagcttatgtacttgagagttttatcatttcgtgactttcgaagtttggattctttgcctgattcaataggtaaattgatccatctgcgctatttagatctctctcattcaagtgtagaaacactgccaaagtcattgtgtaatttgtacaatctgcaaactttgaagttgtttgattgcataaagctgactaagttgcctagtgacatgtgcaatcttgttaacttgcgtcatcttgatatttcttggactcctataaaagagatgccgagaagaatgagtaaattaaatcatctacaacatctggatttctttgttgtgggcaagcaccaagagaatggaatcaaagaattgggaggacttccaaatcttcgtggtcaacttgaaattaggaacttggagaatgtttcccaaagtgatgaagcgttggaggcaaggataatggataaaaaacacattagtagtttgcggctgaaatggtctggatgtaacaacaacagtaacaacttccaacttgaaatagatgtgctttgcaagttacagcctcaatataacattgaatcgttggacataaaaggttataaaggaaccagatttccagattggatgggaaattcttcctactgcaatatgattagtctaaaattgcgtgattgtgacaactgtagtatgcttccttcacccggaccactaccttctctcaaggaccttctaatttcaagattgaataggctgaagactattgatgaag

SEQ ID NO: 28771 - DNA, 225 bp, Glycine max
  Peptide Sequence Number=SeqID_120456
atggctatatggtgggaatacctttcttgggtaaaggaagacaaggtgtttcactgtaggcctttggataattttatccagcactactcctcagcaacttcaaaggtttctaacacaagaaggacaatgtggtggatagcagctacagacctatcaaacttttacaatgggtttggtatacatcgaatgaaaatggatgaaagtgtgaggaatgaaaagagatga

SEQ ID NO: 28772 - DNA, 671 bp, Glycine max
  Peptide Sequence Number=SeqID_120457
gactgcacgtcctcgccttcagaggactgcacgtcctcaccttcagagggctgcatgccctcgccttcagagggctgcacgccctcatcttcagaggactacacgtcctcgccttcagagggtcatgtacctttatcttcagaggactacacgtcctcgccttcagagggtcatgtaccttcacctttagaggactacacatcctcgcctccagaggactacctgtcctcaccttcagaggacttcacatcctcaccttcagagggctgcatgccctcacttttagagggctgcatgccctcactttcagagggctgcacgccctcgcctttgtagggctacacgccctcaccttcagaggactacacgtcctcgcctccagaggactacatgtcctcgcctttagagggccacacaccctcttcttcagaggactacacgtcctcaccttcagaggactccacgtcctcaccttcagagggctgcacaccctcgccttcagagggctacatgccctcgccttcagagggctgcacgccttcgccttcaaaaggcgacatgtcctcaacttcagagggctgcacgcccttgcctttagagggctatgcgtcctcactttcagtgggctccatatccacaccttaagagaatttaaggtcttctgcccttaa

SEQ ID NO: 28773 - DNA, 258 bp, Glycine max
  Peptide Sequence Number=SeqID_120458
ggttcctctcggtgtgggttttcaatggagaacaatgatggtttgtggtggctaatggtggctgtgggtgatggagaaagttcttggaactttagaaatggctttggaagaaagaaagaagaagaaatgacatttttcctaagctacacgagagcaaaggctgaacttcctccagaagcttcattaagaggcttcctccagaagcttcttcgtggcttctttgagaagctttctcaagaggattctttgagaagctag

SEQ ID NO: 28774 - DNA, 505 bp, Glycine max
  Peptide Sequence Number=SeqID_120459
gttgctatccattttcattcttctttttccgcgcaaggatgacgatgttgatttaaatgcctctcctcaagcactagataggctattgggttgtttccttgcattcaaagtgaaggtgcaaccaaggttcaggaatgttgttgttcttaaatattcagatgaatcaaacttgatcaatgttgtgctggatatgcttcccgatagtgagccatgttgcaagatcgagagttcaatacttgagtcgaccgatcctacagagcttgaatatcaatctgtctctgttactgctgatgatgatcgttcaatgcttgactcgactgagcctacagagcttgaatctcaatctgtgtctattaccgcagatcatgacccacttctcaggattccattaacaccaactaagcgtgtatcttctgatgagttggatgatgagcccaaaaactttgagatttcacttgcccaagtttcctcaaataatttagccaagcattgtcaagctgaatga

SEQ ID NO: 28775 - DNA, 595 bp, Glycine max
  Peptide Sequence Number=SeqID_120460
ggctacacgccctcgccattagagaactgcacgtcctcgtcaacggagggctgcacgccctcaccttgagaggactacacgtcctcgccatcagagggctgcacgccctcacctccagaggactacacatcctcgccttgagagggctgcacgcccttacctttagagggctacgtgtcctcattttcaggcgaccaactgtgcgagcacaaccagagagggaggctatcacacagctactatgcatactggggcaagatttcacccgtgccgctgcaaagagacgagggatcgcacccacaagacacccagtggacccggaaaagtccaacagggccctggggattccaactctggttacgggcctctatcagtcctatagggtgcccgtacccccccggcaaggttatgtcatcatagggatcgcgcctgcaagacacccagtggacccgaagaagtccaacagggtcttggagttgtcaagctctaattacggcaagggcatcaggccccctactaatcgagctttcatcaagaagtactgcgtccccaggcaggcgcagggcgaaacaccacaacagcattgggatggccg

SEQ ID NO: 28776 - DNA, 676 bp, Glycine max
  Peptide Sequence Number=SeqID_120461
atacaagccaggttggagaaatcatccaaatcttagatgggcaagtcctccacaacaacaacagcctgtccctcctttccagaatgttgttggtccaagcaagccatatgttcctcctccaatacaacagcagcaacaacaacagtcacaacaaagacaacaagcaactgaggctcctcctcaaccttccttagaagagttaatggggcagatggctactcagttgaaccaagctcagtctcaaaattctgacaaatttccttcacaaactgtgcagaatccgaaaaatgtgagtgccatcaccttgaggtctggcaaccaaattcaagtgcctccaccagtagcaacacctacacctgaacctgtcaagcttcattctacacctgaaaaaaaggatgagatagttgcacaaaagagaaggcttcctaacaataattttcatgcaggtggaccttcttctagtaattctgacttaccacagcctcctatccctcttccattcccacctagagcaattccaaacaaaaaaaatggaagaagcagaaaaggagatattggagaccttcaagaaagtagaggtgaacatacctctgttagatgccatcaagtagattccaagatatgccaagtttctaaaggagttgtgcacccacaaaaggatgctcaaaggcaatga

SEQ ID NO: 28777 - DNA, 709 bp, Glycine max
  Peptide Sequence Number=SeqID_120462
gcaagatgtgcgcaaaaaggcacaagccatccagaagcagaacactgccccccacgttctgtctcgtgggggttatgactatttggaccagaagttcctggctgagaagaccaagaaaaagctggaggaagttgcacagtcaggaagcgttgatggcgtcatcgaccctccatccccggtcagaggccacgtgaagtggaagatggcccgcacgaagaaaataggggagatgacgactgaggctgcaaaggaaattgctgagaagatcggatccttcgtcccccatggacgtcaggatgttctcgccgctgttattggacgtccagagcaccctggacgtgtccgtgctgctggagccggtgtcaccatcaagcaatactttggatcgactacacggacgtcccgcagctcttcctccctgcctcctgaagaattgcaacagctgacccatcaaatcagggaccagctagaggagtccatcacagagagagtgacgcgacaggttatggcatccttcagccagatacagtaccagcttcagtcgcagatgcaatctcagggacttgcactgcctcctgaccctctggttggtccttccggtcctcgagtgagcacaaaggggagttgtgttgatccctcaggaaacgatcctgagacagatgactctgataggtgcggcttgtacatagaagcagatcatgcccgcctg

SEQ ID NO: 28778 - DNA, 429 bp, Glycine max
  Peptide Sequence Number=SeqID_120463
atggcttctttgaatcagtttgcaatatatcatacaaaggagcatgtgcttgttgaaagactcttgtccaagatcatgaatcatatcctccaagcgatctcccatttctacatcaagcggtttagattgggacccattttacatgtctatcaattcaccatgccatatccatgttgtataattcttcttaatcccatcacacaacaaatgctctcgtatgtcatcaagtatttgttgtctccctttcaaacaatttatgcacggacaaaaaaaatttccatcctcattcggttgacttctttcaaaagcaaattgcaagaactgttccacgccttcctcataagcagggctcatgcgactttcattcatccaacttcgatccatctaaataataactctatgatactcaaaaagttattcgatgcatga

SEQ ID NO: 28779 - DNA, 682 bp, Glycine max
  misc_feature (41)..(41): n is a, c, g, or t
  Peptide Sequence Number=SeqID_120464
ggtcggaacaggagagcgcacgagggagcttccaggggganacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctgatcgcgcagtttatgcagtacgtcgagcagttgctgaatatcggcgaagtgcagaccggtgttcacgcgccagcttcacgcgctgggcttcaccgcctgaaagggtggttgcggactgccccagtcgaatgtacgtcaggccaacgtccatcaacgtttgcagcttacgcgccagtgcagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 28780 - DNA, 345 bp, Glycine max
  Peptide Sequence Number=SeqID_120465
atgacgttgctacttagcaacattatgcccagcgaccgcaatgtcgatctccccctacggaagtatccgttggggtcgtgcccacaagatacccagtggacccgaaggagcccaacagggctctggggtttccagctctggttacaggcctctatcagtcctacagggtgcccgttccccccagcaaggtcacaccatcgtgacataggtaaggatcgtgcccacaagacacccagtggactcggaggagcccaacagggccctagggtttccagctctggttacgggcctctctgtcagtcctacaaggtgcccattccccccagcaaggtcacgccatcatga

SEQ ID NO: 28781 - DNA, 791 bp, Glycine max
  Peptide Sequence Number=SeqID_120466
acttagccgccattgatgctttcctcgcatatcaccatagcaaggaaagtccagtggtagctatcttggcagatttgtttgacacctttgaccggaggaagagtcgattgggaccaacatttggctgggatagggggcagcgcgatcaattggtttcctcgttggaaggaaggcaaggaaaagttcttttctcgtgtggggactaccctaatgttccattgatagggactaggggttgtattaattataatcccgcactcgccataagacagctagggtaccccatgaggggagcgccaaccgaagaaagtctctcgcctttccttgtgagggatctaggcgcgcaaagtctcaaggttatacaaagaatccacaaggcgtggaggagtccgttgaggaaagacaaggagcttaggggcatccgtaatggcgtcatcggaggttatcatggatggctaagaattcacacgcgagggttagattggctctccaagttgaaagttatcgatgaggagaacttcgaagctccggaggaagatgaagaagtccgagctctaaaattggagctagggaaggcaagactcgccaaggagaagttcaaatcagctgctacacacatccggaaagagtgcaccgagttacaagaggaaaacgcggccactgcaagagcccttgaacaagaaactaaaagggcccgcaaagaggaatatggccgagaaaaattccgaggagcattgtggggtagcaacagtgagctcaagctccgaagagaggaaagagaccggtcacgg

SEQ ID NO: 28782 - DNA, 138 bp, Glycine max
  Peptide Sequence Number=SeqID_120467
atgttagtctctgcgcgtcaaagggctcgtttgcccccggttgacgaaaggtcaggacgaaaaaaggtgtcggagacgatgttagtctctgcacgtcaacgggctcgtttgcccccagttgacgaaaggtgcgggtaa

SEQ ID NO: 28783 - DNA, 369 bp, Glycine max
  Peptide Sequence Number=SeqID_120468
agccagacccacggccaggccggccgcgcccagcacggcgatcaggctggccgtctgcacgccgaagcgcgcgagcaccgcgatcaccgtgaagatgcgcaccgtccagaccacggtgctgtagaacatgggcacgatagtgggatcgatcttgctggaacgcgtggccgcgcggcgcacccagctgcccagcagggacgacacccaccagccgatgatgaggatcagcaaggcgataagcagattgaggcccaggtccaccagcctgggagcccaggcgctaaattctttcaaggcttcttccatggatactcctgcgcaaaagttgaggccgcgcggcggccccgcgacgggcgcctggcggcctga

SEQ ID NO: 28784 - DNA, 828 bp, Glycine max
  Peptide Sequence Number=SeqID_120469
atggctacctcaccaaaagaaacctcatcccctgtttcaccctctgtaccatcatctccatcatcctccaaaactccatcaaaccaggaacaacctgcactcaatatccaatccatacaaatgattcctggtccaggccctgttcctgagaaactgcatttgaaaaatgcttctgtccctgatgctgataaagatgtcccaacatcttccaccccaaatgctgaagtcctctcttcatccagtaaagagaaatcaacagaggaagaggatcaagccacagaggagacccctgcactaagggcaccagaacctgctccaagggcaccagaacctgctccaggtgacctcattgatctagaagaggtagaatctgatgaggaacccattgtcaaaaagttggcactttgcattgcagaaagattacaaaacagaaagggaaaaacccccattactaggtctagacgaatcaaaactattgcacagaagaagagcacaccaatcacccctaccacatccagatggagcaaagttgcaatccctttcaagaagaggaaagaaatttcctcatctgattctgatgatgatgtcgaactagatgttcccgacatcaagagagccaagaaatcagggaaaaaggtgccaggaaatgtccctgatgctccattggacaacatttcattccactccattggcaatgttgaaaggtggaaatttgtatatcaacgcagacttgctgtagaaagagaactgggaagagatgccttggattgcaaggagatcatggactggactgctgaaaacagtcaccaagttgggagattgttatga

SEQ ID NO: 28785 - DNA, 610 bp, Glycine max
  Peptide Sequence Number=SeqID_120470
atggatttccaggctggtgctgtcggtggcgctgcccagcagcttgatcgcctcgtcactcttgccggtggccaccagcaggcgggccacacgctggtcgaccacgcgctgcaggtcaccttcgaccttcacgccgcgcagggtggccagggcttcttcgttcttgccggcgtcgacctgggccttggccagctgcagcgccgcgaggtcgccgtagatgctggacgggccggcttcaagcgccttgaccgccttggcggcgtcgtcgagcttgttctgctgcaggccaacgagcgccttctggtactcgacattggccgaggccagcttgccgccctgatccttctggtaccactgccagccggcaatggcaccgatggcgatgactacgccaccgaggatgctggcgccattcttccgcagccagctgcggacgcgttcactttgttcgtgctcgtcgagcagatcgtcgatcgccatgcgtactctcgccccgcccatcgggagggaccattgggattaatcgaaggtggtgaaccgcgcctcagtgcgaaaccgggactacggagccttcagaggatacctgaaagcgtgccacgttggctcgctg

SEQ ID NO: 28786 - DNA, 210 bp, Glycine max
  Peptide Sequence Number=SeqID_120471
atggcaatcggagacaagtcaagttcatgtaatcataaaagcccacggagcggtacgagacaggcaatggatattgttcggggtaggactattcgaggggcaaggcaagggaaggctagagctgacaagcgaatacctgcttcccgtggcgagcataaacctttggctcgttggttcatactcaatctgacttcttccggatcgacttga

SEQ ID NO: 28787 - DNA, 768 bp, Glycine max
  Peptide Sequence Number=SeqID_120472
atgacggcagagccgaacagaatctgtgaagagggagaagagaagaaattgaatgctggttatgtgaccgggactatttacacaatacagaattattatcttccgtctttgaggaagagccttcgtcttcttcttgttggagaagctcgcgcatccaccgctaagcgcaatcttagcgtgcttagcgtgacaaaagaatctagcagagcatcaatatcagggccgcacactaaatgcaagatcagtgcgctaagcgcaacggttgtcttcagtcaggctcagcgcacaactaacgctaagctcaaatcacttactcgccctaggcgcgagggtggcgctaagcgcaatgtggcagtgcctattatgggaaaagagctctggaggcagcaagaggagcagcttttgcagagatacctagaagtagcagcaactacagaagaagaacctcgatcttccgaggaatcttctagttttcctattatagggcattctcatatagaacctattgaagacccaaccatgggtgaagagtcaagaagagtaaccctggaggattgttcaaattctactgtgccacaatttttcactagtattgcacagccagaagttcaagctcagacaattatatatgcaatactatcatgctggctagcgggtgtgcctgtggatgcaattaggttgagtctgttctcattttctttagctggagaagctaagaaatggcttcattcttttaaaggaaatagcctgaagtcatgggatgaagtg

SEQ ID NO: 28788 - DNA, 202 bp, Glycine max
  Peptide Sequence Number=SeqID_120473
atgtcgctgcatgttctttatctttatgcgtttctggatttcccccagggatttcctgatcatcttgagctaccttctggggtggggacaaaacatggacagcagaaaccaatcaaggaacggatgcaagtggggatggggtcacgaccgactgatcgttgccctttctctgcgctagacaagcagagaacgtcgctgcaag

SEQ ID NO: 28789 - DNA, 435 bp, Glycine max
  Peptide Sequence Number=SeqID_120474
atgccctcaccatcagaggactacacgtcttcgccttcagaggactacacagcactacacgtcttcgccatcagagggctacacgccctcaccttcagaggactacacgtcctcgccatcagaggactgcacgccctcaccttcagaggactacacgtccttgccatcagaggactagacgtcctcacctatagaggactacacgtcctcgccatcaaagagttgtacgccctcaccttcagagggctatacgccctcaccttcagaggactaaatgtcctcgccatccgaggactgcacgtcctcaccatcagaggactgcacgtcctcaccatcagaggactaaatgtcctcgccatccgaggactgcacgtcctcgcctttagaggactacacgtcctcaccttcagaggactaaatgtcctcgccatctga

SEQ ID NO: 28790 - DNA, 480 bp, Glycine max
  Peptide Sequence Number=SeqID_120475
atggccagtaacgatgattctttgcacatgtttttcttccccttcctagctcatggccatatgatacctttggttgacatggccaaactatttgctgcaaaaggtgtgagagccaccatactcaccacaccactcaatgcacctatcatctccaaagccatagaaaaaaccaaaactcatcaaggcaaaggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 28791 - DNA, 131 bp, Glycine max
  Peptide Sequence Number=SeqID_120476
atggcggaaccatcaaagaagcgaaagggcacttcgagtcggagtcaacggcatttcgggtcacaggaaatgccgattccttcctctattccctctggatcattgttttcatctgatgaacaacggatacg

SEQ ID NO: 28792 - DNA, 207 bp, Glycine max
  Peptide Sequence Number=SeqID_120477
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggacatgggttgtagcgcttgaacttcccggcggaggtccgggtatagtcccgagatga

SEQ ID NO: 28793 - DNA, 303 bp, Glycine max
  Peptide Sequence Number=SeqID_120478
atggcaagagctggtgacaatggtggtgtatatcatcaactggacgaatctcagcgcttatttctggacgcgtggactacacaaatgcaacgtttgttgaaccgtaacaaagaagagccctacagacgaatagtcaaatcttccttgtttatactcttaaacctctatcccctagaaaagaatttaaagatgtcttttccaaggagattcctcatggactgcctaccttcaagaagcatagtacatccagttgatctccttctagaagcttcattgcctaacaagcctacttactacagctag

SEQ ID NO: 28794 - DNA, 330 bp, Glycine max
  Peptide Sequence Number=SeqID_120479
atgtccgtttgcagccttgggctctatggctcagatcacatctatcccccacatggaaaagggccacggtgcggccaatacattcaatggcaagggcggagcgttgacattgtttgcaaacgtctggcatttgtgacacttccttacatggaggcaacagtcgctttccatggtgagccaataatagcccgccctcaggatcttcctagccatggcgtgcccgttagcgtgggtaccaaaagagccctcatggacctcctccagcatgcgtccagcttccttagtgttcacgcatcgaagcaacaccatgtcatggtttctcttgtatag

SEQ ID NO: 28795 - DNA, 762 bp, Glycine max
  Peptide Sequence Number=SeqID_120480
atgggtcagctccagcggcaaaccttttgcaaagcttacggtaaaatctggaacttagccatggtagaagtctccacagaggccattgcctcccttgcccagtattatgatcagccgttgaggtgcttcacctttggggacttccagctatcacctatggtagaagaatttgaagagatcctagcgatcgacgcttttcttgcctatcataaccacaaggaaatcccagttgttgctatgctagccgacctatatgacaccttcgaccgaagaattgaaaagagcaatacaaggattgtttgctgtactccaactctctatgtatggttagtttcacacctttttcgccaagaggtgaggcatgcttgcccgctagaaagccaccattcatgcacagagaaaggaggggcaaattgggatcaactcttagcaagcaaagaagaagcatctgtcaactggttccttcgatggaaggaaggaagaaccggagttcttatttcatgtagaggatttccaaatgttcccttgatggggacgaggggttgcatcagctacaatcccgttcttgctataagacaacttggctaccctatgagaggggtgccactagaggatgagctcacgcctgtcatttcacgaggcttcaataagaccaacgtggagacacttcagaaggtccgcaaggcatgggaggtgttgcaaaagacaaggaactcaggggcaataacaatgggcccatcggtggctatcgtaagtggttaa

SEQ ID NO: 28796 - DNA, 405 bp, Glycine max
  Peptide Sequence Number=SeqID_120481
atgaccatgattacgaattcgagctcggtacccccacccaggaatagacgtgttaatgaggcagtttctgatgaggcttctgctcaaccccaagatgtagctccaagaggccgtggacgtgatcgcggtcgtggacggggaagacttggtaggggtggtggaatgccagaggttgaggttcctagggctacacgcaacaacaggcaggggcaacaacaacctgtttctgagattggtcaagagggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 28797 - DNA, 219 bp, Glycine max
  Peptide Sequence Number=SeqID_120482
atgcatatgacacagatgcattttatgaatatgggagctcgggaaattgtccccttcttagatacaacattcggacagcctggcgcccgacgtatgcatttaagaaggcgacacggaccctccgtcggtttgacaaaatgcgaaaggcacaacacggggatgtacatagtacgacaatatccacaaacaactataagcaaaggcgtacatgacatttag

SEQ ID NO: 28798 - DNA, 138 bp, Glycine max
  Peptide Sequence Number=SeqID_120483
atggctacagccagacccaacgtttccaagtatgtcttcatcagttcaatgcatcatcatcctatctcggtcatccggaaaataaactctagcatcagtcccttgtttccagaagatgcgtttgctctttacgaatga

SEQ ID NO: 28799 - DNA, 309 bp, Glycine max
  Peptide Sequence Number=SeqID_120484
atggcgaggacgtgtagtcctctaaaggtgaggacgtgtagtcctctgaaggtgagggcatgtagccctacaaaggtgaaggcatatgaccctttgacggcgaggacgtgtagtcctctgaagttgaaggtacatgaccctttgaaggcgaggacgtgtagtcctctgaaggtgaaggtgagggcgtgcagccctctgatggtgaggacgtgtagtcctctcaaggcgaggacgtgtagtcctctgacggtgagggtaactagtacccaaggtgagggcgtgcagccctctcaaggcgaggacatgtag

SEQ ID NO: 28800 - DNA, 186 bp, Glycine max
  Peptide Sequence Number=SeqID_120485
atggctgttaagcagctgtttttgagagggtttattcgtgataggtggcgtacgcgcttacccaacaggctgcgcctgtgggcatctttctggagcgccgcggtctccagcgaggctgcgctggccgagagcgacgattgccgcggcttccaaggcctgcctgcgataggcgatcagtccggacag

SEQ ID NO: 28801 - DNA, 249 bp, Glycine max
  Peptide Sequence Number=SeqID_120486
caatcaggcccacttgggccttccagattcttcctccagaaggctgttgcttctggaggaagcaaccttgctcgcctgggcgagctgggtggcaagctcctcccctattttgctataaatagggggaggagtgaagagggaaggggttcagccttcttggcacttcttattctttcgaaattgctgaggaaaattgtttccgtgaagaaaatccaagccgagtgcttcgttttcttcagtcttcaattg

SEQ ID NO: 28802 - DNA, 294 bp, Glycine max
  Peptide Sequence Number=SeqID_120487
atggaaatttatgtgagagatcgactaggaaaaactgtcatcatcaaaaagggggatattgtagaagcaaagcttcatgatgaatcaagattgattcaaagatgttttgatgataacaaagatgatgacaaaggtgatgacaaaaatctcaaaggtcaatcaaagaatgagttcaagatgtttaagaaagaatcaagaacacttcaagattcaagaggaaagttgaagaacacttcaagattcaagaggaaagttgatttcaagaatcaaaattcaaggatcaagcttccatga

SEQ ID NO: 28803 - DNA, 122 bp, Glycine max
  Peptide Sequence Number=SeqID_120488
gatgtttctaccctacagcagttggaggattgagatgctatgagaatccaaagaataagattactgcagtacctgctgaggaagaggaaatctggggtgcattcttcaaggaaacgagatga

SEQ ID NO: 28804 - DNA, 501 bp, Glycine max
  Peptide Sequence Number=SeqID_120489
atggtgggagcaggtttgaaaaaggatcttagagtgtctagggttgtgccaggagggtctcttaatgccttcctttttcttctcatcggagttatttcacaaagacttgccatggaatctattgattctctcccaattggttggactgtaggtgcgatgatttacttcacgggcgaggtctctgctcagttggtagagctccgctcttgcaattgggtcgttgcgattacgggttggatgtctaattgtccaggcggtaatgatagtatcttacgggctgtcaagaacgtagaggagggtttcctcatttgggatcctggggaagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 28805 - DNA, 399 bp, Glycine max
  Peptide Sequence Number=SeqID_120490
atgaacacaagaatagtttccaagttgaacctcactatcattccctacccaaaacctaataaacttcaatggcttaatgagcaaggagaaatgatagttaaccaacaagtgaaggtagctaaggatcaagtacaaataaaactcaaatgggatgagggaaagaatagaaaaagaaaagaagaacaacctttaatggttaagaaggaatgtaaggaggtaagtgtctcctccaagaggttaactaagatggaaagtcattttgcaataaagaaaaactttaaagaaacttcccttcttaaacaaccttcacatcttctcctttgtaaaagaacacttgttagcactgccaaacctcttgagcttgaggctattcctcaagtaaaggaccattttgcctaa

SEQ ID NO: 28806 - DNA, 258 bp, Glycine max
  Peptide Sequence Number=SeqID_120491
atgaaggattggctgacttgtatcccttgggaagttccatataaacttcttcaaacaaatctccattcaaaaaagcatgagaatgtgtcgcaacgtgcccttcgcgggcgagcgagggcgaagctcacgggtgcgctttccaaaggaggaaagatgcacgaagtcgccacgaacgtttatttgtggaaaactttggaaaaaccgaaggaaaccggtcaaaataaaaattctaagttcgggagttgtatttacgcttga

SEQ ID NO: 28807 - DNA, 300 bp, Glycine max
  Peptide Sequence Number=SeqID_120492
atgttggaagagaagcttgttactattattgatgctagtagcaatgaagagaaagtccattataaaacttgggaaagatctaacagactcagcctaatgttgatgagaatgactgttgcaaacagtattaagacaactctccctaaaatcgaaaagtgctctcaaacaactgataagtctgttgctgggacattaatgagtacattgaccaccatgaagtttgatggttcacgtactatgtatgaacatgtcattgagatgacaaacattgcagcaagacttaagaccttgggaatataa

SEQ ID NO: 28808 - DNA, 77 bp, Glycine max
  Peptide Sequence Number=SeqID_120493
ggacgccacattctacaccgtgagcaaatccgtgaaggttttccgtcgttcttcatccgttcttcgttcttcaacgg

SEQ ID NO: 28809 - DNA, 289 bp, Glycine max
  Peptide Sequence Number=SeqID_120494
aagtgctaaagttgatgtctcgctaagcgagctaaatgcgcttagcgagtgtcatccgctaagcgaggcatcaacgcgcttagcggataggaggaatctagaagggaatctatcacgcaggcacgcgctcagcgcatcatcagctcactcagtgagtcgtttgtcacctttcaggcttagcgcgagtttggcgctgagcgaaaattcacttactcgggctaagcgcgacgtcgaggagcttccttgctatggaaggctaaatcctcagttggggattcttgctgagtaa

SEQ ID NO: 28810 - DNA, 834 bp, Glycine max
  Peptide Sequence Number=SeqID_120495
atggtttgtaccaaccaagcggatataactggaaggctttttgccagttcattggcattcgaatgctgcatcatgcactacttgattgtgtgcatcctactccctaaatcatccaaccttgcacaggtttctgaggaagatttgataattatgtgggttttcctaaccgatcgtcaaatcgactgggcccttcttgtgagatatcccatgcataaggcattgcgatcaaatgctccactcccttatccccatctgatcaccttgtttctacaacattttaatgtccctcttgactctgagccctttgtcaaagtcaagagatccttctctatcggtgcgaatgtagtctcctttttcggataccgcaaagagagggatggctcttgggtgaagaaggatgctccagtacaggccgctgaagaccactctccatcaccatattctcagagagatgactcttcatctcttatgcacagcattcttgacaagttggatggactccaaaccttcatcggtgaacactttgactcgttggatagccgtattgatgccatggatgcacgatttgtagggatggacacacgtatcaccaaacttgaggaggatgattattatcatcaaaaagggggagattgtggaagcaatgccttccaagattattttgatgatgccaaagaatcaagagtcaaacaagtttcaagaatcaagatcaagattcaagattcaagaataattaagatcaagattcaagattcaagaataatcaagatcaagattcaagtaaagaatcaagaatcaagaatcaagagaaaactcaatcaagataagtattaa

SEQ ID NO: 28811 - DNA, 147 bp, Glycine max
  Peptide Sequence Number=SeqID_120496
atgcatgaaatggctccgaaaaagctttccacgaagaggtctagaagagacaccgtagcagaagggtccagtgccgcccccgagtttgatagccaccgtttccggagcgccgagcaccagcagtgcttcgaggccatcaaaggatga

SEQ ID NO: 28812 - DNA, 500 bp, Glycine max
  Peptide Sequence Number=SeqID_120497
atgactagaggcaatccatctgacttacaatcctttgatcctgagatagataggacatttcatagattagttaggcatcattttataccttttgatcattctgagcattccattactggtgaatctgtgcattttgttattggtgattttgaacatcctgattttgagcattataattttgagcattctgattttgaacattccgagaacatggcacaacctccaccccgtgagaggactctaagggaaatggctgcacctgatttcacctacgaaagcttgtgcatccaataccctgatgaggatgtcccatatgtttttaaaactggactcatccatttgcttccaaagtttcatggccttgcaggtgaagacccgcacaaacatctgaaagaatttcatattgtctgctccaccatgaaactctcagatgtccaagaggatcacatatttctgaaggcttttcctcattctttagagagagtggcaaaggactggat

SEQ ID NO: 28813 - DNA, 168 bp, Glycine max
  Peptide Sequence Number=SeqID_120498
atgaatgtattgcctagcgctgttcatatgtcctcccttgtcaagcgcgaagtctctgaagaaaaaaagaaggagtggagacgagagtcgtcatcacagaaagggcaggacggacgaaaacagtgtcctatctttgctttcctcttatctccgatgagaggtaagtaa

SEQ ID NO: 28814 - DNA, 495 bp, Glycine max
  Peptide Sequence Number=SeqID_120499
atggaggaaccaccatggaaatcaattcatagagatcaaggtggacagtccacaaggccacaacaacaagggcctagtctctatgatcgcacaacgaagctagaagagactctagctcagttcatgcaggtttctatgtccaaccagaagagcatagagtttgccataaagaatctggaggtccaagtgggacaacttgcaaagaaatttgcggatagatcatcaagcagttttatagctaatacagagaaaaatcccaaggaggagtgtaaagctgtgatgactagaagcagaatgccaatccatgtggataagagtgaagctgagaagaagatggaggaacataaacaacagctggcacctaagccagcacttgaacccgtttctaattttgtagaacttgaagagattaatgaggaggctaaagatgataaggaagaagagacaccaataaaagagaaagaagaaaagaagaagaaaaagaaaaaaagttga

SEQ ID NO: 28815 - DNA, 261 bp, Glycine max
  Peptide Sequence Number=SeqID_120500
atgtttggaagcaaaagcaagagtcttggcagcaccaacgcggaggcacttcagaaggtccgcaaggcatgggagatggtggaaaagaaggataaggaactcagaggcagtagcaacgggggctaccataggtggttgaaagcctacacgcaagttctggattggctcccgaatttgagaaccactaagggggtggcagttgaagctccggaggagggcaaagaggttcaggctctcagggcagaactccagaaagcctaa

SEQ ID NO: 28816 - DNA, 210 bp, Glycine max
  Peptide Sequence Number=SeqID_120501
atggctaagttcggaaggcctgcttcagagattgaaggccttgtagctgccaacagactaagtccttcgattacatgggtgttccatagcttcaagcaacttcatgtcgacgacactgttgatatgttggtggaattactcgaggtcaacgctgtagaggcaaaagataagatgattcaatgtcatggctcttatgttcgactattgtag

SEQ ID NO: 28817 - DNA, 992 bp, Glycine max
  Peptide Sequence Number=SeqID_120502
atggctacctcaccaaaagaaactgcagcttctggttcacccgctgtaccatcatctccgcaccaggaacaaccagaattcaacattcaacccatacaaataattcctggtcaagcttctgtccctgagaaactggttcccagaagacaacagggagtgaagattgctgaaaaccctagccttgcaacaagtcctagggaagtagatacggagatggacaagaaaatctgcagtattgtgagtagcattttgaaagacgcctctgttcctgaagctgatgaagatgtccaacatcgtccaccccaaatgtttctgtgcctgatcaaagagagatcaacagaggaagatgatcaagccgcagaggagactcctgcaccacgggcaccagaacctgctccaggtgacctcattgacttagaagaagtcgaatctgatgaagaacccattgccaacaggttggcacctggcattgcagaaaggttacaaagcagaaaagggaagacccccattaagaggtctggacgaatcaaaactatggcccagaagaagagcactccgatcactcctgccacatccagaagaagaaaggttgctatcccctccaagaagaggaaagaaatttcctcatccgattctgatgatgatgtcgaactagatgtctcgacatcaaagagggccaagaaatctggaagaaaggtgcctggaaatgttcctgatgcaccattggacaacatctctttccactcaattggcaatgttgaaaagtggaaatatgtgtatcaacgcagacttgcggttgaaagagaattgggaagagatgccttggattgcaaggagaccatggacctcatcaaggctgctggactactgaagacagtcaccaagttgggagactgttatgaaggtctagtcagggaattcattgtcaacattccctctgacatatcaaacagaaaaagtgatgattatcaaagagtgtttgtcagaggaaa

SEQ ID NO: 28818 - DNA, 79 bp, Glycine max
  Peptide Sequence Number=SeqID_120503
atgatgggagatgaatccaaatttactcatatatctcccaagaaaagtggacatgtgacctatgaagacaacaacaaag

SEQ ID NO: 28819 - DNA, 540 bp, Glycine max
  Peptide Sequence Number=SeqID_120504
atgccgcctaccaggcaccctctagacccagataagtctaacagggccctgggttttccatcattgatcacgggtctctaccagtcgttcagggttcccgtcacacctagtaacgtgattcgatcgccgatcacccgggctttcataaagaagtattgcacacctagacaggcgcagggtggtgcaccgcaggccccagacgcactgttgccacctcatcaggctgatccagctgggtcatttgacacggagaggtatttacggcatttggttcgccagcaggcggctaaccacagggcgcacgtgcagacccatgactatctctaccagcttagcctcagtctacagagccagggtttcgctccttttccgtgccctactccagatcagttcagggcagaggtcgcatggcccggagattggcctgaggcccaggcaggggaggcgcccatagaggctcccgacgatgcagatgaggcccgcatggacgaggagatgacaaatttactcgatttcttgggagggagcggagccacatga

SEQ ID NO: 28820 - DNA, 297 bp, Glycine max
  Peptide Sequence Number=SeqID_120505
atgctcgaaagttttcaacaacaaaatcaaatgtcagttttggaattgtacgtaaaaaaggatgtggttggtggttctatgtttcattctgcaaattctcttacatcatgcggaaataatttatctaataatgaggcgcaaccgccaacaaatgtgagcaacttacatggtgatgaagatgatgatgatgatgattatcttatgtctaactcatacgttgaagagtctttagacaaagatgatagtgttgacggtatatctgatactgacgatgaagtcgccgacatgattcaacca

SEQ ID NO: 28821 - DNA, 189 bp, Glycine max
  Peptide Sequence Number=SeqID_120506
atggcctttcttataaatagccatgcaggagaaggggtagaggggttcagaactgaaggaatagaggaaaaagcgcaaaaggagaaaaaggagagggaaagaattaatgaaacattgggcttaatccggattttggttgtggacttgaagagggcaaataaagcagcgcttaccttagttaatttctaa

SEQ ID NO: 28822 - DNA, 75 bp, Glycine max
  Peptide Sequence Number=SeqID_120507
atggaagaaggatattctaccagcaaaccaccttccttcaaaggagttaaccaatggatggatgagcaaaaataa

SEQ ID NO: 28823 - DNA, 438 bp, Glycine max
  Peptide Sequence Number=SeqID_120508
atggtgggagcaggtttgaaaaaggatcttagagtgtctagggttgtgccaggagggtctcttaatgccttcctttttcttctcatcggagttatttcacaaagacttgccatggagaatcgctcccgaaaaggatctattgattctctcccaattggttggactgtaggtgcgatgatttacttcacgggcgaggtctctgctcagttggtagagctccgctcttgcaattgggtcgttgcgattacgggttggatgtctaattgtccaggcggtaatgatagtatcttgtacctgaaccgatctagtatggatcgtacatggacggtagttggagtcggtggctctcctagggtttcctcatttgggatcctggggaagaggatcaagctggcccttgcgaacagcttgatgcactatctcccttcaaccctttga

SEQ ID NO: 28824 - DNA, 121 bp, Glycine max
  Peptide Sequence Number=SeqID_120509
atgggttttagccaactaagggttttagcctttcatggcaaggaagctccttcttacaccaaagaagaggaatcaagagaaattgcttgcttacaaaggagtggggatgtctcctccacct

SEQ ID NO: 28825 - DNA, 355 bp, Glycine max
  misc_feature (9)..(9): n is a, c, g, or t
  Peptide Sequence Number=SeqID_120510
cccgtcagngcgcgtcagcgggtgttgccggtgttcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgagtatatttcagctttttgatgaatcatttcaggaagttgatgaatttgacagcttttacaaagggaacatgcaggacctaggatattcttctatttatatgaagagaagtgggcaaaagcgtgatgggtgtgggctgttttacaagcataaccg

SEQ ID NO: 28826 - DNA, 612 bp, Glycine max
  Peptide Sequence Number=SeqID_120511
atgggggaaatcgacatccccattcagataggcccccacacttggcaatgtggtttttcaagtgatggacataaatcccgcctacagctgccttttggggagacgagtccgttgctacctcgtctctctaatgcggccctaatggtggcacgggtaatgctcaggcacggttatgagcccggaatgggtctgggcaaggacagccacgggaatgccgatgtggtcgacattagggggaacccgtacaaatatgggttggggtatgaacccgggaaaccgggaagaaggaatgcaccgttaagacttcgggaagatagggcatggcccggccatgttagccagtgtttcacaagtgccgggataatgtttgaggaagaggaagtctataccgctgattcaatgtgtgagggtcgattctttgaggatcctaacaacgagggtttgataatcgattttgaccgagaagtaagtcaaacaataaacgaagaagaggaagaggatgtcctttcaccagagttggagaggttgatcgctcaggaagaacgcaaaattaagcctcaccaagaggaaatcgaactgataaacttagagaccagggagggaaagaaataa

SEQ ID NO: 28827 - DNA, 318 bp, Glycine max
  Peptide Sequence Number=SeqID_120512
atgaaaggtcagattagggtttcgttctctaccgaaactgcaagccaagttggaagattccgctccaatcgacgggttcctctcgttggggagtttcaatggagaacaacaatgcttcgagcacactccagagatctactcaaagatcccaacggtcagatagtggaaaagtgtcttgtgaagctgcagaccaaagttcgagaagatccaacggttaacaaaggctgggcagcgtttttaccgaggcagcttcatgtagctttctctagaagcttcattaagaggcttcctccagaagcttcctcgtggcttctttga

SEQ ID NO: 28828 - DNA, 303 bp, Glycine max
  Peptide Sequence Number=SeqID_120513
atggttcgatattctggtgtcctaggcgtagaggaaccacaccaatccatcccgaacttggtggttaaactctactgcggtgacgatactgtaggggaggatactcccggggaacagatatccagtggagatgacggggtggggcctgtagctcagaggattagagcacgtggctacgaaccacggtgtcgggggttcgaatccctcctcgcccacaaccggccaaaaaagggaaggatttttccctctgggggtaggaaaatcatgatcgggctagcggacccaaagctatggaacttgtga

SEQ ID NO: 28829 - DNA, 267 bp, Glycine max
  Peptide Sequence Number=SeqID_120514
atgggggtgcaaatagcaaccaggcccacttgggccctccagaatattcctccagaaggggaggaagtgagaaggaaaagggttcagccccttagcacttctctctcgttcgaatttgcttggaaaatcgtttccgtgaagaaatctaagctgaggcgcttccgaaacgtttccgtaacgttttccgtgaggaatttcgcaaaggtttcaaccgttcttcgacgttcttcattcgttcttcatcgttcttcgatcttcaacgggtaa

SEQ ID NO: 28830 - DNA, 183 bp, Glycine max
  Peptide Sequence Number=SeqID_120515
atggcaattttgatcgccaatacttcaacaacatttcatagggatgaaagactcgagaatacgcatgctatgcatggaaaatgtaattatgagattgagatgcccgaagagacatcctttcttaatcaaccacgcattagaaatgggtttatgatcccaacatggttggctcatggtacctaa

SEQ ID NO: 28831 - DNA, 640 bp, Glycine max
  Peptide Sequence Number=SeqID_120516
tggtggtctactttaaaaacccggaactgaacctgttcaaagagtcctggcaggagctgccgcagaacaagctgaccattcgtctgcagccggacgaaggggttgatatccagatcctgaacaaagtgccgggcctggatcataaacacaacctgcagaccaccaagctggatctgagctactccgaaaccttcaaccagacgcacctggcggatgcttacgagcgtctgctgctggaaaccatgcgcggtatccaggcgctgttcgtgcgtcgcgatgaagtggaagaggcatggaaatgggtcgactccattaccgaagcctgggctgccgatcaggatgcgccaaaaccgtatcaggctggcacctggggacctgttgcgtcggtggcgatgatcacccgcgatggtcgctcctggaacgagtttgactccgtgtggattcacccgcggagctttttttattacactgccggaagtgattttgcccctgagctccggacagcaagcgtttcagcgttgttaacaactgccagcgactttgtcactcccgagcccggacagataaatgagaggagcttttatgaatccgacattgttacgcgtaacacaacgcattatcgagcgctcgaaagagaccc

SEQ ID NO: 28832 - DNA, 252 bp, Glycine max
  Peptide Sequence Number=SeqID_120517
atgtcaggactcctacgcgattctcctcaaattttagctagcccgcatcaattagaccttacaccttacgcttcagggccttacaatgctcaatggaacaccccggggcttctccatgacaagcacacgttgcgttcgagtcgtattctcagagaaatgggggttgatgatccttggttggggttatggctaccattgaattatcaagtagatatgggagcaagtcagcataggacaccgaaattggggtga

SEQ ID NO: 28833 - DNA, 134 bp, Glycine max
  Peptide Sequence Number=SeqID_120518
atgccgatcccgcctcatcatcattgtcaggatatcggagtcagtggaatctttatgctcaaaaccccgattctcaatagtcatatatttggtacccctcaaggagcaggaactgctattctaacacttctcgg

SEQ ID NO: 28834 - DNA, 351 bp, Glycine max
  Peptide Sequence Number=SeqID_120519
atggcaagagctggtgacaatggtagtgtatatcatcaactggacgaatctcagcgcttatttctggacgtgtggactacacaaatgcaacgtttgttgaaccgtaacaaagaagagccctacagacgaatagccaaatcttcctcgtttactcttaaacctctatcccctagagaagtgtgtgatgaccaaatcagaatgagagaaaagagagaacaagagaaagaaaatagtgaggcaccacaaaggaatatgaaaaagagtgatacacccaaggataagagtgatacacataagagagagagtgatacacatgagagaaaatttaattattttgcagaggcgagtgaa

SEQ ID NO: 28835 - DNA, 182 bp, Glycine max
  Peptide Sequence Number=SeqID_120520
tgattgtttctgattcatcagaaagtgaaaattctgaatccacacaaggttcaagttctaattttatgactcctttcgaggattgtcaatctccaactaatcagcctgtaatcaacactgaaggtaatgactataattctgatttcctgtttcagatgctacagtacatgttcttaaattaa

SEQ ID NO: 28836 - DNA, 382 bp, Glycine max
  Peptide Sequence Number=SeqID_120521
atgactagaggcaatccatctgacttacaaccctttgatcctgagatagataggacatttcatagattagttaggcatcattttataccttttgatcatcctgagcattccattactagtgaatctgtgcattctgttattgatcattttgaacatcctgattttgagcattataattttgagcattctgattctgagcattctgattttgaacattttgagaacatggcacaacctccaccctgtgataggactctaagggaaatggctacacctgatttcacctacaaaagcttgtgcatccaataccctgatgaggatgtcccatatgttcttaaaactggattgattcatttgcttccaaagtttcatggccttgcag

SEQ ID NO: 28837 - DNA, 515 bp, Glycine max
  Peptide Sequence Number=SeqID_120522
cggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctgaggctttttttatggttcacaggggtgagtggatgaatgaacaagaatcatttgagtggcacggtgttaggaacggtaccaagattgcaacttttgttggacgtcttaatgattcagtaacacctatacttcgtcccaagtcacctagctag

SEQ ID NO: 28838 - DNA, 252 bp, Glycine max
  Peptide Sequence Number=SeqID_120523
atgattcatctcatacagaggaacctatttcatggattaccaaatgaggacccctatgcacacttagcaacatacatagagatttgtaacactgtaaagattgcaggagtgccagacgatgccatcaggctcagtgaaaaaaaggctaagtttattgcaaaatgtagcagttgggctaagcgtatatccaccgctaagcgcagcttcagcgcggttagtgcaaaggagaatctagtagagcatcagcattaa

SEQ ID NO: 28839 - DNA, 307 bp, Glycine max
  Peptide Sequence Number=SeqID_120524
atgttggtgtgcacgatccgcactcgtctctttgtagcggcacgggtgaaatcttgccccggtatgcacagtagctacgcgatagcctcctcctctggttgtgctcgcatagttggtcgtcctccaggatcaggggggcagaagaccttaaattctcttaaggtgcggatgtggagcccactaaaagtgagggcgtgcagccctctgaaagcgagggtgtgcagccctctcgaaggtgagggcgtgcagccctctgaaggtgaaggcgtgctgtcctctgaagatgaggatgtgcagtcctctgaag

SEQ ID NO: 28840 - DNA, 330 bp, Glycine max
  Peptide Sequence Number=SeqID_120525
atgtctaaggttgtgtttcaatggggtcttttatcgtgggaacccaatcttgacatctggggcgaaacaaatttgggtgtcaaggtgtcgatttcgggccgagcttccatattgttccatgaggcacgcgtgacaatgatgattcgaaaacaacgtgcaaaattagtcatggctacagccaggtgggcactcaagcatcccgtttatggcattgtgatactacggttgggaatttacacaaacagacccaatgtttccaagttatgttctttcatcagtttaatgaattcatccattcttatctcggtcattccggaaataaactcttag

SEQ ID NO: 28841 - DNA, 135 bp, Glycine max
  Peptide Sequence Number=SeqID_120526
atggagaataagatgaataacaaggaattaaaaatgaatggcagcggaatggagaaggaagagagagaggagacgccacttcaaggagaagatgagtctagaaagaagctcaccaccataggagaccatggataa

SEQ ID NO: 28842 - DNA, 264 bp, Glycine max
  Peptide Sequence Number=SeqID_120527
atgtgcaaaatcagaatgctcagaatcagaatgctcaaaattataatgctcaagatcaggatgttcaaaatcaccaataacagaatgcacaaattcaccagttatggaatgctcagaatgatcaaaagaatcgctttttttggacgatggagacctcagccggcctatggcaggctgccacagtgtaggaaattttattctaccccaaatgcatatataataattgcgattctgataaccggagcaaaagttatggccgtttga

SEQ ID NO: 28843 - DNA, 309 bp, Glycine max
  Peptide Sequence Number=SeqID_120528
atgacgatcgtggacaaatgttgcggttcagatcatggtcgcggaggattgtttttgaaaaaccttgagttgagttactgggttttgaagaagaagggaattatgtggatgaatggccgtgtgcctttaaattttaagggaaggggtaatgggagaaactatatgtgtgaggggccggcttggtttactaagaaaatgccaagtggtgctgtaaaaaacaatggtgacttgttctattcggcgtctctaatgaactacgaagtaaagcacggttgtgtttggtcgtttgggaaaacattctgggggtga

SEQ ID NO: 28844 - DNA, 453 bp, Glycine max
  Peptide Sequence Number=SeqID_120529
atgtcagggatcattcacaagattgaggaaacccttcatgtgggagggcacaagaaagaggaggagcacaagggtgaacaccatggtggagaacacaaaggggagcaacatggggaagaacacaaagagggtttcgcagacaagatcaaggacaaaattcatggcgagggcgagaagaagaagaaggagaaaaagaagcgtgaacatggccatgaggatggccatgacagtagcagtggcaaactcgttcacaatcacgagtgggatgctgaagctctcttagcagcatacccttcttctaattttaccataacctcatcatcttgtgctgttgctgcgaaaaaaacattaaaagatgaaggtttcatgcagaagaacacccagaaaaccgaagatatagtggtggaaaatccattagagtcgagggtgtgtgtggatctcgtttggccttga

SEQ ID NO: 28845 - DNA, 609 bp, Glycine max
  Peptide Sequence Number=SeqID_120530
atggcgatgaaactcaagtatctgtcttccattgccgaggatgtcatcaagagatgttcacagaaactggacacttcagtagagaaattggtggaagattttgaaggaggatggaaccctgaaatgggaaactattgcagaaaattagttgaattttgcagtgggaagggtgtgaatgaaatgtgccacaacatagagggaaacatcaatgatagctcatttagcaggttgacatatgacatgatgcttgcttgggagagacctagctactacgatgaagaaccaatgaaacatgcaacaccaaatggggttgaactggctgaggatgaatatatattacatgtagatggaacagccagcacacagagagtagttcggcacattggaacaacaagttggcctggtcagccgcttcgtctctctgatcgtaggcttacactgaccaattactctctttactttgaggcttccggagtaataaggtatgaagatgctctcaaaatagacctctccaagaatgttgagcagagtgttaaacctgctgccacaggtccatggggagctcaactttatgacaaagccataatctatgattcaactgatttgtaa

SEQ ID NO: 28846 - DNA, 1023 bp, Glycine max
  Peptide Sequence Number=SeqID_120531
atggcttctgtttgtggaggttgcttagcattgcaagatgctggggttcctattaagtgttctattgctggaattgcaatgggtatggtactggacaccaaggaatttggtggagatggaactccacttattctgtctgacataactggatctgaagatgcgtctggagatatggatttcaaggttgctggaaatggagatggcataactgcatttcaaatggacattaaggtaagaccggatagaataaatcttataattggttctggtgggaaaaaagtgaagagcattattgaggaatctggagtagacactattgatacagaagatgatggcacttgggaagatggctggaaagaagatggggtcccattgctggaaaaatatcctagactgtactgtatctcaaagcagcaacagcattatattcagcagatgggattggtgtcaagtggggtgtgggaatggcagctcaagtggaggagactgctaatggagggagagatggatgtggcagcacatttcctggaggatattgacgggatggcagttcaggtccaacatcaagatagcgggtcatgggagggagatccgggaggggagtactcagtgggaagtgcatatcgggcacttaatgaatatgcaattgaagaagatgatgagagggcattttctatcctttggaaactaaaaattcccagcaaggtaaatgaaaaggggcagctgcgccttagtcaccgagcactgcttcctgatacagaagcttcaccaaaagatggtttagtggaagaaaagactgaacagtctaaggataagtctagcactcccaatgtcacagcctcttctaaaagaagttcagaggatgattctgtacttccttctaaaaagtttgtcaggagattggtaagctcttcccaggataagcctttcactaacaaagacaagagaaagaagagtagcaacaaagcagttggtagtgtgtctggcgaagatgaaagcagtttggttagtggagaagcctaa

SEQ ID NO: 28847 - DNA, 642 bp, Glycine max
  Peptide Sequence Number=SeqID_120532
atgaggatgtcctttcaggataaggtgtgggatcaacaagtaccctttccaaggaaggaaagggggttatggaggattattggaggatacaatgtcatagacataggacacggtttcttcatggtaaaatttgacttggctcaagatagggagaaggtgattcttggagagattgacttgagcaaaccagtggtgaggaaggtctggtttaaaaatcattggttccatgttgagtatgaggggttatatttgttatgcaagacgtgtggactatatcataaggactggccgaagttgaagaagggagacatgctagttgttgggaagtcaaaatgtgggggagatagagaggatttttatggggattggctagtggttacgaaagaggaagaagggagatattctcatgggcgtgcaagtgtgacagtgtctgaacatcacatggagtcacaatggcaggaaaatgaaggtcaagggaagatgcacatggtagaggtgacgtccaaccaggatggtaggttgaaaaaggaaaagccactagatataactcagaatgaaatgatggtagagggagtgattggggacgccacactactaagccgtggaagtggcgacgacgatgaaggtggtggcactcgttag

SEQ ID NO: 28848 - DNA, 849 bp, Glycine max
  Peptide Sequence Number=SeqID_120533
atggaggcaacaagtttggtggagaggggtagagagagagttggacatgttaacaaggttagttatgtgagaagggtcattgcaaagaagaagaaacaactttatcgaaggcttagaaggcctgagttgagtgtttcaaagactcttcagcagttatttgattcatgcagagaagttttcaaaggccctggcactgttccttcaccacaagatgttcagagattgaggcacatactcaataacatgaagccagaagatgtgggactaagtagagatttgcagttcttcaagtctgggaataaggtgaaagagaaacaaagggtcacttatacaaccgtgtacaagtgtaacaatttctcactctgcatctttttcatacctgaaggaggagtcattcctctccacaaccacccagacatgactgttttcagcaaacttctattaggactaatgcacattaagtcctatgattgggttgtccatgaggcctctgatgacaacttgttgcaaccacaatctcaattgagattggcaaagttaaaagctgataaggtgttcacatcttcatgtgacacttctgtgctgtatccaacaactggaggcaacatccatgaattcacagccataaccccatgtgctgtgcttgatgtcattggccctccttattccaaagaagatggcagggactgttcctactacagggatcacccttatgcttcttttcctaacgaaaggattattggtgaggcaaaagaggaaaatgatagttacgcgtggttggaagaaattgagatgccagagaactctgaaatggatggcattgagtacctgggtccaacacccttttag

SEQ ID NO: 28849 - DNA, 411 bp, Glycine max
  Peptide Sequence Number=SeqID_120534
atggtggtttggatagaaactgaagcgagtgggaatgtgcaggcaattgctggtgatgagttagtaaaagttcttcaaattagaaacaaaatacccagaaggaaagccctttcatcattagaagaaaaggttctgaagatactcacagaaaatgggtttgtctcaaatgattcaacactgaggagtaattctgagaccattgcggagattcttgaggttgaggatgaagacgaggaagtaattgttgatggtgaagttgacgaaggtgatgttcatataaagccaactccacgtaaaccagcccttttatggtgcatatatggtatcttaggctcagtgctctctgttcatggttactttttatgggtgtttctaggcaagtcacgcaaacagactgggttgctcaaatga

SEQ ID NO: 28850 - DNA, 1776 bp, Glycine max
  Peptide Sequence Number=SeqID_120535
atggcagccttcatcctcatctccaagtccaagcttcaatccacagtacttgttcttgtcctaaacctatctttcttcttcctcttctgtctccttctaaaggcttattatctccaccctcctaactcaaattctcaatctaatggccccctcaaaaccttcaaccatgaaagattgttcagagatgttagtgttgaaggctgcactgacctccacaagtactcagattatgagtccaaatgtttgtatgtgaagagccatcttgactgcagctttgggaaattccaaattttgggacaaaccatccttgccttgtggcttgtggttttgttctatcttttgggagacacagcttcaaactacttctgcaactcattggaaggtttgtccaacatcttgagactctccccaaccattgcaggagtgacgcttctctcattaggaaatggtgctcctgatttctttgccagtgttgtgtctttcacaggatcatcctcaaatggtgccgttggactcaacagcatccttggagggtctttctttgtgtcatgtgctgtcttggggatcataagcattcttgttggcccaaaccaggttcaagttgataaggccagtttcattagggatgttcttttcttccttttctctcttctcatccttctcatcatcctttacattggtaaaatcactttgttggcttcaatctgctatgtttccatctactttctctatgtctgtgctgtctcagccacacatctcatctatggaggggacaaaatgattaatgaaaggcaataccaatactctgatgatgagtcatcatcatcatcactagaagctagcatacctttgttaggctacgttgatgaagagaaacaaagtttggcagagatagtggtggtggttgaagagaaggaccaaaaccaaaaccaaaagcaagatagtcatagtagtagtactttttttgggggtaacaattcattgtttgattgtatttacttgggaaagatcctacaagtgctagaactaccacttggcttaccaagaaggcttacaatcccagtggtgagtgaggagaaatggtcaaagccatatgcagtaatatctgtcacactagcacctgttttgttggcaattcttttcaacacacaaagtgaaaacgtgggttcaaggagtggtattgtcacatacatagtagctgcattgattgggatagttttgggcaacatggcatgtgtgacaactgaaaggtgcaacccacccagaaagtccttgttcccttggcttgctggtggctttgcaatgagtgtaacatggacttacataattgctgaggagcttgtttctctcttggtatcaattgggagcatcataggggttagcccttcaattctaggactaactgtcctagcttggggtaactcacttggtgacttgatagccaatggtgccatggcaatgaatggtgggcctgatggggtccaaatggcaatttctggctgctatgctggcccaatgtttaacaccttgatgggcttgggcttgccacttgttctctcagcttggtccgagcatccagaaccttatgtcactcctaaggacacttcactctatgagacacttttgttcttgatgggaggggtgctttgggcacttgtgattttgcctaagaagaatatgaggcttgataaatccttgggagcagggctattgagtgtgtacatgtgttttttggtcataaggatagctatggcagttggaattgtgaaattttag

SEQ ID NO: 28851 - DNA, 69 bp, Glycine max
  Peptide Sequence Number=SeqID_120536
atggtggcagcacagggagttgaggtcgtcgcagcgaggatttggaagatggcgatgaaggtggcgtag

SEQ ID NO: 28852 - DNA, 555 bp, Glycine max
  Peptide Sequence Number=SeqID_120537
atgaatcaaccaagtaacatcttgctagttagctgtaactgttcagcttggacaatactatcaagatcttttgcagaatattgcatagtggggtgggaaaatttgccaaggaccctcctcctctactacaccaactttgtgtcatccccagaaggatatttccaaacagttatatgcaactctgaagactacaagaacacaactgttaaccatgatcttcactacattacttgggacaaccctccaaaacaacaccctaggtctctagggcttaaggattataggagaatggttcttactagccgcccgtttgccagaaaattcaagagaaatgatccagttcttgataaaattgatagagaacttctgaagaggtatcatgggaaattttcctatggaggatggtgctctcagggtggaaaacacaaagcatgctcaggtttgcgaactgagaattatggtgtgcttaagcctggtccatcctcaagaagactgaaaaatctgctaacaaaacttctctctgataaattttttcgcaaacaacagtgcaggtaa

SEQ ID NO: 28853 - DNA, 312 bp, Glycine max
  Peptide Sequence Number=SeqID_120538
atgctttcgggcgctaatgttgagtatgatttacctatacctataaaagatgaatcagaaactctctctgatattgatgatgcagagcttgatgtgtacattcacaatgaggaggagaagaatatgaagaagacactctgggaaagagcttaccgagagtatcttgaggagctgctggcagctgaaaaagcagctgcggctgcagcaggaattgggacagatcgatatgggcctctggccaaacgactaacgaaacaaggcgttatggctgtcatggcagtgtttttgccaacagccataggcaatttgtga

SEQ ID NO: 28854 - DNA, 4623 bp, Glycine max
  Peptide Sequence Number=SeqID_120539
atggtttcatttcaacagcaactgcttagaaaaccagaagggaatgaagcttttttagcttatcaagcaggaattcagggcgtatttgggagtaacaatttctcatctcctagtgccatgcaactgcctcagcagcctcgaaaattgcatcttggttccaaccaggatatccagctaaggggtcaaggtgttgagcagcaaatgctaaatcctgtccatcaagcataccttcaatatgctctccatgctgcgcaacaaaggcctactttaggaattcagtcacagcagcaaactaaaatgggaatgttaagctctgcatctctgcaggatcaggagatgcgtatgggaaatttgaaaatgcaggacattatgtctatgcaggcagcaaatcaaggtcaaggatcatcctctaggaattcatctgagcgtggtgctcgtggtgacaagcaaatggaccaaggacaacaaatgacacctgatcagaagagtgaaggaaagccttcaactcagggaccaaccattggacatttaattcctggaaatatgataagacccatgcaaggaccggaaacacagcagggcatccaaaatgttgtaaacacccagattgcagtatctgctcaattgcaggctatgcaggcatgggcacgtgaacgtaatatagacttatcacatcctgcaaatgcacacttaatggcgcagctcattccactgatgcagtcaaggatggtctcacaatcaaaggtcaatgagagcaacattggtgctcagtcatcacctgttcctgtttcaaagcagcaggttacttctccagcagttgcaagtgagagctcagcacatgctaattcatccagtgacatgtctgggcagtcaggctcttcaaaagccaggcagacagctccatccagccatcttggctcaataacgaatgctggtatagctggtaactctagtgacatggcaacacagcaattcaatgttcatggcagagagtctcaagctcctccgaggcaaccagtagtagttggaaatggtatgccctctatgcattctcagcagtcttctgctaacacaaacttaggtgcagaccatcctctgaatgcaaaaacttcatcatctggtccagaacctcctcaaatgcagtacacgaggcagttaaaccaatctgctcctcaggctggaggtccaacaaatgaagggggtttgggtaatcctgcaaaatctcaaggacgaccagctcagatgcctcagcaacgaaccaattttacaaagcaacaactacatgttctgaaagcacagatactagcatttaggcggctgaagaaaggagaaggtactctgcctcaagaacttcttcgggctattgttccaccacctcttgagatgcaggcgcaacagccaaatcattctgcaagaggacaaaaccaagacaaacctgctggaaatattgcggcagaacaaataagcccaattgagtccagtgccaaggagccacagtctatccctagtattaatggtcagagttctttaaagcatgaatcctttgccagagatgagaaatccattgtacccccagttcatgttcaagctgttgcaccacctgtgtcaaaggaatctgctccaacgttatctgctggaaagaaagaccagaaatcaattggatgctctgttaagtctaaccaggatggtgaatgtgtaaataatactactgttagaaacgagttagcattagataggggaaaggctattgcaccgcaggctcctgtatccgacacaatgcaaattaagaaaccttcacaaacgagcactggtccccagccaaaggatgtgggaccaaccagaaaatatcatggacctctatttgattttcctttctttactaggaaacatgactcctttgggtcatcaatgatgctaaacaacaacaataacttatcactggcatatgatgtcaaagatcttctttttgaggaaggcatggaagtacttaacaagaaaaggacagaaaatttaaaaaagattgaaggtttattggcagtaaacttagagaggaaaagaattaggccagatcttgtgctgaggctccaaattgaagagaaaaagcttcgcctagtagatcttcaggcacgtttaagggatgagattgatcaacagcaacaagagataatggcaatgccagataggccatatcgcaagtttgttaggctgtgtgaacgtcagcgcatggaacttgctagacaagtgcaggcatctcagagagcagtaagggagaagcaactcaaatctatatttcagtggcgtaagaagcttcttgaggctcactgggccattcgtgatgcccgtacagcccgcaacaggggagttgccaaatatcatgagaagatgttgcgggagttctcaaaacgtaaagatgatgacagaaacaaaaggctggaagccttaaaaaacaatgatgttgacagatatagggagatgttgctggagcagcagactagcatccctggtgatgctgcagagagatatgctgttctttcaactttcttaacccagactgaagagtatctacacaaattaggaagtaagataacggctgctaaaaatcaacaagaagtggaggaagcagcaaaggccgctgcagccgctgctcgattgcaggcatgcttcataaaattgcctcccccctcccccctcctcttcttccaatgttttgagaaaagtctttatggtctttctgaagaagaagtccgagcagctgcagcttgtgctggagaggaagtgatgattagaaatcgttttctggagatgaatgctcctagagacagttcatctgtcaacaagtattacaaccttgcccatgctgtgaatgaaacagtcataaggcagccatcaatgttacgtgctggaacattgagagactatcagcttgttggtttgcaatggatgctttctttgtataacaacaagttaaatggaattttggcggatgagatgggtcttggcaaaactgtacaggttatggcattgattgcttacttgatggaatttaaaggaaactatggcccacatcttataatagtcccaaatgctgttttgagtgagttttataattggttgccatctgtttcatgcattttttatgttggaagcaaggatcatcgatcaaaattattttcccaagaggtttgtgctatgaaatttaatgtccttgtgactacttatgagttcatcatgtatgaccggtcaaaactttcaaaaattgactggaagtatatcataattgatgaagcacagagaatgaaggatagagattcagttttagctcgtgatcttgatagatatcgttgtcaaagacgtcttcttttgacaggaacaccattacagaatgatttgaaggaactctggtctctcttaaatttacttcttcctgaagtttttgataataagaaagccttcaatgattggttttcgaaaccatttcaaaaggaaggtcccactcaaaatgtagaggatgattggcttgagacagagaagaaagtcattattatccatcgacttcatcagattcttgagcctttcatgctcaggcgtcgtgttgaagatgttgaaggctcacttcctcctaaggtcagcatagttctgaaatgtaaaatgtcagctgtccagagtgccatttatgattgggtcaaatcaactggtacccttcgtcttgatcctgaggatgagaaacacaagcttcataggaatccagcataccaggtgaagcaatataaaactttaaacaacagatgcatggagctgcgcaagacttgcaatcatccattgcttaattacccattcttcagtgatctatctaaggaattcattgtaagatcttgtgggaaattgtggatcctggataggatcctaataaaacttcaaagaactggacatcgagttctacttttcagtaccatgacaaaacttctagacatcttggaagaatatctacagtggcgaagacttgtttacagaagaattgatgggactactagtttggaagaccgtgaatcagcaatagtggacttcaatagccctgattcagattgtttcattttcctgctcagtattcgagctgccggacgaggccttaaccttcagtctgctgacacggttgtcatttatgatcctgatccaaaccctaaaaatgaggagcaggctgtggccagagctcatcgtattggacagaaaagagaagtcaaagttatatacatggaagctgttgttgacaaaatcgctagtcatcagaaggaagatgaactgagaagtggaggcactgttgatatggaggatgaacttgcaggtaaggatcgctacatggggtccattgagagcctcataaggaacaatattcaacaatataagatagatatggctgatgaggttattaatgctggacggtttgatcaaagaacaacacatgaagagaggcgtttgactttggagacattattacatgatgaagaaaggtatcaagaaactgtccatgatgttccctcactacaggaggtaaatcgcatgattgccaggagtaaagaggaaattgaactgtttgatcaaatggatgatgaacttgattggatttag

SEQ ID NO: 28855 - DNA, 558 bp, Glycine max
  Peptide Sequence Number=SeqID_120540
atgccagaccgtgaggtgaatgagtcggtgaatggaaacttgggtggggggaatgatgcaatggaagcgggggaagagtttgatggagggaaaatgtctaaagagcaggtggtggatgtgttggatggggcgaactacagtgtggctggattgttgagtggaggcgagaagtgtggcgacaatgatggtaagggcttggtgatggatccacctggtggggatagtgatgatcgaaagaggaagagagacatgttggatttgtctgatggggatagtgatagttctgattgtaagaggatgcgagagtctgcgttggatatgctgagctgggttacaggtgctgcaaagaatccctgtgatcctgaagttggttcaatacctgaaaaggcaaagtggaagtctcaaagtaatcaggaggtgtggaagcaagtgctgttgtttcgagaggcagcgtttctcaaaagaggttctgatacaagcagtgaacaacgtagctggcagtgtttttatgttgaattaccaagtaaagagtatttgcatatttctgaaaaaggataa

SEQ ID NO: 28856 - DNA, 3603 bp, Glycine max
  Peptide Sequence Number=SeqID_120541
atggcgagtgatccgatgcaacaagtggccctaatcctgggcccggactcagcccagctggaatccctaatctcccaattgatgtcttcgtccaaccaccaccgctcccaggcggagtccttattcaacctctgcaagcaggcccgcccggaggccctccttttgggcctggcccatctcctccactcctccccgaaccccgagagccgcaccatgtccgccatcctcctccgccgccacctcacgcgccaccacgactccttcctctggcccctcctctcccctcccgcccgctcctccctccactccctcctcctctcctccctccacaacgagcctctcaaatcaatcaccaagaagctctgcgacaccgtctcagagcttgccgccgccaccctccccgacgacgccgccgcctggcccgacctcctccccctcctcttccagtgggtcacctcccccgacccgaggctccaagaaatctcgctcttgatattcgctcaattggctcattacatcggccaaaccctactccctcaaatttccactctccactccgtcttcctccgctccctccactcctccaccccctccgacgtccgcatcgccgccctcgctgccgccatcaacttcatccaatgcctcaccaactcctccgacagagaccgcttccaggacctcctccctctcatgatgcagaccctcacggaggcactgaactccggccaggaggccgtcgctcaggaggctctcgagcttctcatcgagctcgccggcactgagccgcgcttcctccggcgacaaatcgccgatgtcgtcggttccatgctgcaggtggcagaggccgaggccttggaggaaggaacacggcacttggcgattgaatttgtcgttactctcgctgaggcgagggagcgtgctcctggaatgatgaggaagctgccacagtttgtgagaaagctttttggtgtgttgatgaatttgttgcttgatatcgaggatgatcctgcgtggcacggtgcagaggatgaggaagaggacgcgggcgagacgagtaactatggctttgggcaggagtgcttggataggctctcgatttcactcggcgggaacaccattgtgccggttgcctctgagctgttgcccacctacttgtctgctcctgagtgggagaagcaccatgctgccctcattgcgcttgcccaaattgcagagggttgttcgaaggtgatgataacagtatgtgattcgtggagaagacttcctttaacctggaatgcagcacgtggtatggtgaatttggttatgataaagaatctggagcaggtattgtcaatgattttaaattcatttcacgatcctcaccctcgagtgcaatgggcagctataaatgcaattgggcagttgtccacggatttggggccagacttgcaggttaaatttcaccacttagtgctgccggctttggctggagctatggatgattttcaaaatccaagagtacaggctcatgctgcttctgcagtgctaaatttcactgagaattgtacctcagatatcctaacaccttacttagatgggattgtgagcaaacttttggtactcctgcagaatgggaagcaaatggttcaagaaggagcattgacagccttagcatctgttgctgattcttcacaggagcaatttcagaagtattatgatgctgtgatgccatatttaaaagctattctggtgaatgcaaacgataagtctaatcgtatgcttcgagccaaagcaatggagtgcattagtttggtaggaatggctgttggaaaggagaagttcagggatgatgccaaacaggtcatggatgtcttgatgtcactgcaacaatctcaactggatgctgatgatccaactgcaagttacatgctacaagcatgggcgcggctttgcaagtgccttgggcaggattttctcccatacatgggttttgtcatgcctcctttgctccagtctgcgcaacttaagcccgatgtgaccattacatcagcggattctgatactgaatttgatgaagaagatgacagcattgaaacaatcacacttggggataaaaggattggcattaagactagtgtcttggaggagaaggctaccgcttgtaacatgctatgttgctatgctgatgagttgaaggaaggatttttcccttggattgaccaggttgctttcacattggttcctcttcttaaattttacttccacgaagaagttaggaaggctgcagtttcagccatgccagaactgttgtcctcggcaaaatcagctgtagagaagggacagtcgcaaggtcgtgataagacttacgtaaaacagttgtctgattatataataccaaatttggtggaggctttacacaaggagccagaagtagaaatttgtgcaagcatgttggacgcattgaatgaatgcatacaggtctctgaatcacatctagatgaaaagcaagttcggagcattgttgatgagattaaacaagtccttacggccagttcatcaagaaaacatgaaagagcagagagggccaaagaagaggactttgatgctgaagaaagagaactactcaaagaagaaaatgagcaagaagaggaactttttgatcaagttggtgattgcttgggaactttgataaagacattcagggcatctttcttgcctttctttgatgatctgtcctcatacctaactcctatgtttggtaaagacaaaacctcagaggaaaggagaattgccatttgtatatttgatgatgttgctgagcatggtcgtgaagctgctcttaaatattatgattcttttcttccattcttactagaagcttgcaatgatgaatatccagatgttcgacaggctgctgtttatggtgttggtgtttgtgctgagtttggtggatctgttttcaaaccccttgttggagaggcactttcaaggttagatgctgtgataaggcatccaaatgcactacattctgataacataatggcatatgacaatgctgtttcagctcttggaaaaatatgccaattccatcgtgatagcataaatgcagcacaggttgttcctgcctggctaaattgcttgcctataaaaggtgatttaattgaagccaaggttgtgcatgaccaactttgttcaatggttgaaagatcggatagagaacttataggtcccaacaatcaatatctttccaaaattgttgcagtttttgccgagattttatgtgcgggaaataatctggcaaacgaacagactgttagtcggatgattaatttattgaggcagcttcaacagactttaccaccttctacacttgcttcaacctgttttggatcgtcaccttcagaagatgcgtgtctattgtcatgggatgtcatagttaccttttcagaagctgctttgtcaggtcaaattcattcctttggcatcttcggagtgtctttttttgaagcagctgtgtctggttcgtgtttcatgattgttgaatccatacttggttttgcaagccaggacttgagtaaggctttgttgcagaggcagagcagtgtcgagttggttggatag

SEQ ID NO: 28857 - DNA, 1596 bp, Glycine max
  Peptide Sequence Number=SeqID_120542
atggcacttttgaaaacaataggttgggtgaaggagttgaatgcagatagaaccaagagcaacaataacatagtgatgccatcaacacctctgatggacctgcgcgcacatgcactcacactcccacgtgagagagcaagaaaaaatgttgatatgcattcaagagaaagaaaggatattcatttggtgttgcttatatcatatatagttaagcttaacaacctccattcaaagttaaagatgcctcgtaccagcactctggagtgctccggttgccctccgcttcgcgctctaacctttgacgcgcttggtctcatcaaagttgtggaggcccgcgataagcaacgaggagctccccaggtcgtagagaggtggggcgaccttgaatcatccaaatgtgtgatggctgtttcaatgattgaccgagagtctcaccctttattagctgtagcgaggaaaaacaaccagattgaagttttgagccctgttaatggagatattcaggctacaatcacggatgccaatgatttagatgttcaatctgaagtgaataatattgttggattgcatttatttgcaaaacaaaattcggaattagcttccagggattgtactctacttacatgcacaaccaaaggaaatgcaagcataaggtccattgaacttgttgattcatctacagtatcctcctgtattgactctccaaaaatatggaatgtatgttctggtggtaacatcttgtgttgcaaggtggatggaaatgagaagtttgctttatttggagggaaaggtgttgaaatgaatatttgggatcttaacaacttcactaagatctggaattccaaacctccgccgaaggataacctcggtatatttacaccgacttggttcacatctgctacatttcttatgaaagatgaccatcgaaaatttgttgctggcaccaacagccatcaggttcgcctttatgacatgtctgctcagaggaggcctgttctctcatttgatttccgtgagacaccaattaaagcattggctgaggatatagatggctattcaatctatgtagggaatgggtctggtgacatggcttctgttgatatacgcacaggaaaaatgctaggatgtttttctggaaaatgctctggaagcatcagatccatagtcaggcaccctgagctacctgtaatagcttcttgtggactggacagttatttacgcctttgggatacaaagacaagacagcttctttctgctgttttcctgaagcaacatattatgcacgtgctttttgactctaactttgatgttaaagcaaatatatcctcaggagtggattcgctaccatgcaaggaacaaactccaactgagatcttggtcagcgaagaagttgaagaatcacctttgaaaagaaaaaaatcttccagaaacaaagagcatataccagatgggggtgaaagaaagaaaagatctaaacagagtaaagagcgcaagaaatctgaaggaaatgatggaggtgagaagattgcatcaagagatgagggaagcaggtcagcatccaagaaaagaaacaagagatcaattccagtgttgtga

SEQ ID NO: 28858 - DNA, 1074 bp, Glycine max
  Peptide Sequence Number=SeqID_120543
atgcctcaagaaacagtggtgaaaaggtcaccttttcaagaaaattgtgggaggcttcaatttgcaataaggctattagtggtggtattgcttctaggttggattttcattcggataatgtcgcctacaaatacttttagacaaacatggctgcctcgatacaaagcaaagactaataatacaacttatattggttcaaaaggtgcttatcttctcttgtacactttcccaatcttgctcctagctactttgggatgtgtctaccttcacataggcaaaaaagtaatccattccaacacggagagctgcaatgcaaagaagtgtggggtaaccatatggaagcgtccagtgcttataaaaggccctcttggcattgtttctggcacagagatagccttcttgtttttgttcattgccctcctagcttgggtcttttcaacttctgtacaaaacagctttgcaacaatcaccccacaatttgcagcaaaggatggccagaaaatatgggaagagaagctagatagagtagcaaaaaggttaggtgtggttgggaacatatgtttggcattcatgttttttcctgtggctcgtggctcatctgtgctgccactgcttgacctcacctcggagagttgcatcaagtaccatatttggcttggaaacatagccatgacactttttacttctcatggcctttgctacatcattctttgggcagttactgatcatacttctaatatgctggaatggaaaaagaatgatatatcaattgtggctggagagatagctctgctttctggtttgttcctatggattgcaaccattccccgcattaggcgaaaagtctttgagctgttctattacactcatcacctctacatcctcttcatagtcttcttcatctttcatgttggcattacctatgcctgcattatgctccctggtttctacctgtacttggttgatcgttacttaaggtttctgcaatcaaggtgccaagttcgtctggtttctgcgcgggttttgccatgtgaagctgtagaactcaacttctctaagggctatggtaactaa

SEQ ID NO: 28859 - DNA, 1050 bp, Glycine max
  Peptide Sequence Number=SeqID_120544
atgtctgctgttgagtcagctgaacacaacaacatcagaggagtaccaactcatggtggacgctatgttcagtacaatatctatggcaatctcttcgaagtttccagaaagtatgtccctcctattcgccctgtcggtagaggtgcttatggtattgtttgcgctgctgtaaatgcagagacaggcgaggaagttgccattaagaagattggcaatgcattcgacaacagaatagatgccaaaaggaccttacgggaaattaaacttcttcggcacatggatcatgcaaatattatgtccattaaagatattatacgtcctccacagaaggaaaacttcaatgatgtgtaccttgtttctgagttaatggacacagatctgcatcaaataattcgttccaatcagcaattgactgatgatcattgtcggcctagtaatttgctattgaatgccaattgtgaccttaagattgcggactttggtcttgctagaaccacatctgaaactgactttatgactgagtatgtggtcactagatggtaccgagctcccgaattgcttcttaattgttcagaatatacagcagccattgatatatggtctgttggttgcatacttggtgaaatcataacaagacaaccgctctttcctggcaaagattatgttcatcagctgagacttatcacagagctgataggttcgccagatgatgccagccttggatttctacgaagtgataatgctcgtagatacgtaaaacagcttccgcagtatccaaaacaaaacttttctgctagatttcccaccatgtctcctggtgcggttgacttgctagagaagatgctcatctttgatccaaacaggcgtattacagttgacgaggcgttgagccacccatacatgtcacctctccatgacatcaatgaggaacctgtttgcaccagacctttcagttttgactttgagcaaccatcattcactgaagaagacatcaaggaactcatctggagagaatctgtgaagttcaatcctgttccaccagtctactga

SEQ ID NO: 28860 - DNA, 1482 bp, Glycine max
  Peptide Sequence Number=SeqID_120545
atggaaagagtagcatcagtatctcggccactgaaaatatacttcctcccattcttctcaccggggcacctaatccctctggtccagctggctcgcttggtggcggcacgaggccagcacgtgaccatcatcaccacccccgccaacgctcaactcttcgaccagaacatcgacaaggacaccgcctccggccaccacatccgcgtccacatcatcaagttccccaacgcccacgtagggctaccggaaggcatcgagcacctctccgccgccaccaacaatgaaaccgcctacaagatccacatggcggcgcatctcatcatgccccagctcgagtctctggtcaaacactctccaccggacgtcttcatccctgacatcctcttcacctggaccaaagacttctcccagaaactctccatctcgcggctagtcttcaaccctatttccatcttcgacgtctgcatgatccacgccattaaaacccaccctgaagccttcgcttccgactctgggccttttctaattcctgatctaccccaccctttaactctccccgtcaagccttcccccggtttcgccgccttaaccgaatctctcctcgacggggaacaggacagtcacggcgtcatcgtaaacagcttcgccgatctcgacgccgagtacactcaacactaccagaaacttacagggcgcaaggtgtggcatgttgggccaagctccctcatggtgcaaaagacggtgaaaagtagtactgttgatgagagtagacacgattgtctcacgtggcttgactcaaagaaagaatcttcggttctctacatttgtttcggaagcctttctctcatctccgacgagcagctttaccagattgctaccggactcgaagggtcagggcattgttttctttgggtggtgcatcgcaaaaacaaagacggagaagaaggagattcttcttcttcttccggaaagtggttgccggaagggtttgaggaaaagatagctaaggagaacagaggcatgctgattaagggatgggcgccgcagccgttgatcctgaaccaccctgcggtgggaggatttttaacgcactgcgggtggaacgcggtggcggaggcgatcagctccggggttccgatggtgacaatgccggctttcggggaccagtactataacgagaagctgataacggaggtgcacgggttcggggtggaggtgggggcggcggagtggagcatttcgccgtacgaggggaagaagaaggtggtgagtggggagaggatagagagtgccgtgaagaggttgatggatgatggagagaaagggaagagaatgagaagcaaggccaaagagatgcaggagaaggcttggaaagctgttcaagaaggtggttcttcttacgacagtctcacggctctgattcatcatttcaagactcttgtgcctaatcatgtgaatgggaatgggaatatcgatcactga

SEQ ID NO: 28861 - DNA, 171 bp, Glycine max
  Peptide Sequence Number=SeqID_120546
atggggaatggtttctactgtcaagagatgtatctcaacgaggatggacaactctcatggttcaatgctggtgttagagttggtgttggaattggccttgggatatacgttcaggtagatttgcagatttgcatttcttgtaaattttatctgatcctcggacaacaatag

SEQ ID NO: 28862 - DNA, 2715 bp, Glycine max
  Peptide Sequence Number=SeqID_120547
atggctgagaatgcaattcatgtagtgatgcttccatggtcggcctttggccacttaataccatttttcaaactttccatagccttagccaaagctggtgttcatgtctcctttatatccactcccaaaaacattcaaaggcttcccaaaattccttcaaatttagctcatttggttgatttggtgcaatttcctttgccatcattagacaaagagcacttgccagaaggtgctgaggccactgtagacattccatctgaaaaaattgagtacttaaagttggcatatgataaattgcaacatgctgtcaaacaatttgtggccaatcagttgccaaattggataatttgtgattttagtcctcactggatagtagacattgttcatgagtttcaggtaaagttgatcttctataatgttttatctgctcctgcattaacagtttggggaccaccaggtacaaggaaaactcccttgtctccagaaagtttaacagcaccaccagaatgggtgacatttccatcttcagtggcttatcgaatacacgaggcaatagcgctttgtgccggtgccaacccggtaaatgcttctggggtaagtgattttgaaaggcttcacaaggtatttaatgcctctgaagctgtaatttttcgtagctgctacgagattgaaggagaatatctcaatgcataccagaagctagttgggaagcctgtgattcctataggtttattgcctgcagatagtgaagaaagagggagagaaattattgatgggagaactagtggtaagatatttgagtggcttgatgagcaagcatcaaaatctgttgtatttgtggggtttggcagtgagttgaagctgaacaaggatcaagtttttgagatagcttatggaattgaggagtatgaattgccatttatatgggcactcagaaaaccaagttgggcaatcaatgatgaagattttctaccttttggttttattgaaaggacatctaacagaggagttgtttgtatggggtggataccacagcaagaaatattggcacatccatctattggagggtctttgtttcactctggttggggttctgtcattgaaaccctacaatttggtcatatcctagttgtattacccttcattatagatcaacctcttaatgcaaggtttttggttgaaaagggtctagccattgaagtgaaaaggaatgaagatggatcattcactagaaatgacattgccacatcccttagacaagctatggtattggaggaaggtaagaagatcagaattaatacaggagaagctgctgcaattgtaggaaacttgaagctgcaccaagatcattacattgctgaatttgttcagtttcttaagaatggaatccggaaagtggaaacagatgaaatggctgagaatgaaattcatgtagtgatgcttccatggtctgcctttggccacttaataccatttttcaaactttccatagccttagccaaagctggtgttcatgtctccttcatatccactcccaaaaacattcaaaggcttcccaaaattccttcaaatttagctcatttggttcattttgtgcaacttcctttgccatcattagacaaagagcacttgccagaaggtgctgaggccactgtagacattccatctgaagaaattgagttcttaaagttggcatatgataaattgcaacatcctgtgaagcaatttgtggccaatcagttgccaaattggataatttgtgattttagtcctcactggattgtagacattgctcaagagtttcaggttaagttaatcttctattctgttttctcggctgcttcaatgaatattttcgcaccaagtacgaggaaatttcctgtaactcctgaaagtctaacagtgccaccagaatgggtgacatttccatcttcagtggcttatcgaatacacgaggcaatacctttttgtgctggtgctaacgacgtaaatgcttctggggtgcgtgactatgaaaggatggccacggtatgttgtgcctctaaagctgtaatatttcgtagctgctacgagattgaaggagaatatcttaatgcattccagaaactagttgggaagcctgtgattcccataggtatattgcctgcagatagtgcagacagagagagagaaattattgatgggagtactagtggtaagatatttgagtggcttgatgagcaagcatcaaaatctgttgtatttgtggggtttggcagtgagttgaagctgaacaaggaccaagtttttgagatagcttatggaattgaggagtctcaattgccatttttatggggactgagaaaaccaagttgggcaaccaatgatgaagattttctaccagttggttttattgaaaggacatctaacagaggagttgtttgtatggggtggataccacaacaggaaatattggcacatccatctattggggatcaacctcttaatgcaaggtttttggttgaaaagggtctagccattgaagtgaaaatgactgaagatggatcattcactagaaacgaaattgccaaatctcttagacaagctatggttttggaggaaggtaagaagctcagaattaatacaggagaagctgctgcaattgtgggaaacttgaagctgcaccaggatcattacatagctgcgtttgttcagtttcttaagaatggaagctag

SEQ ID NO: 28863 - DNA, 504 bp, Glycine max
  Peptide Sequence Number=SeqID_120548
atgaagaagtttgtactcaagttagatttgcatgatgacaaggataagcagaaggccttgaaaacagtttcaactctttcagttcaaactgatcaactttgctccaattttaatcaagacaaaggaattgatgccatcgccatggatatgaaagagaagaaattaacagtgattggaacagttgatccggtaactgtggtgagcaaattgcgcaaaaactggaaggcagacatagtagcagttggaccagtgaaggagcctgagaagaaagaggatcccaagaaagtagaggcaaagaaagagggagaaaagaaagaggagggaaagaaggaagaagggaagaaagaagagaagaaagaggatgagaagaagaaagatccacccccagtcccagatcctgttttggaatgggtcaaggcttatagggcatataacccctacatgaccacacactactatgctccaagcatggaagagaatcccaatgcctgtgtcatttgttaa

SEQ ID NO: 28864 - DNA, 628 bp, Glycine max
  Peptide Sequence Number=SeqID_120549
atggagattaatgttgcgggagtcgagccattttgtggcgtaaaagatgagggggaaagagtggtcgagctctttgccgcggctaaagtgctccttgcggaccccaaaaatggtgatcccgcgatggtcgaaggacatgtgggggttgctgttggcaatgagggaaacaaccacaatgggaagcggacccggcgtggtgctgtgccaacgcgtggtgggggtgcggaattggtatgggtgcagagcatggagactgcgaaggatagtggtggccgggtcgccaaggcagtcggaggagaagggcgtccaccattgaagcttcgtttggcgatgagtagtgtgggtggtggtagtggaaggtggaagtttcgtacggcgagtggcagccatggaggacagtcatggaagctccgtttggtggttgctaaaatgaaggaagggttctctcgggatcaaacaagctcagcaatcattggcgggtactctcaaaatcaatcccaagggattgagctggatgtacaaagggaggaggggtgtgcggcaacgaagatgtgtggagatggggataaagacactagcattcgaggcctagtgctacctccagcaactacaaaggaagaagagaatg

SEQ ID NO: 28865 - DNA, 703 bp, Glycine max
  Peptide Sequence Number=SeqID_120550
atggatgctgtgtcgtccgcactaatagagccggtaactaattctgtcttggatctggttaaaaagcatgtggattacatccgttacaggcaaaacgttggtgaactatacgagtgtgttgaacagcttgaacttgataaagaaagggtagatcatcaatgtaatagagctgtcaaaaatggacacaacattcatgttaaggctagagaatggtcacggaaagtgggtgaatttaagacagaagtggagaactataagaatgatgaaggccacagaaaggcagggttaaccaattgtttatttccttactttaggtatagactaggcagactagcaaagaagaaggcagtggagggtaaaaagctaatcgatggttgccccaagcctgatgaaattgcttttcggggaaacgtaacatttaatgatgccattttgtctaatactgatcttatggaatttgattctagaaaatccataatggaagacataatggaaaaacttgaagatcccactgtgaaaatgattggagtgcatggcccaggtggggtgggtaagagcactttaatcaaagcaattgctggcagtgctcaagtcaagaaactgtttaatgtggtggctttttcagaaataacagccaatcccaatgtaaaaaaaatccaggaagatattgcttacgtgttaggattgacattggaaggggaag

SEQ ID NO: 28866 - DNA, 969 bp, Glycine max
  Peptide Sequence Number=SeqID_120551
atggaaagccaagatccacaaaactctcctcccttccttttcactcccatgtcaatgatgcaaaacccaaatttggaacctcaaggcttgcatgatgacatagactgggttagccttttctctggccagagcaacttccttgcggatgccaatgcgatgatggaatgcgcttcttcttcttcttcttcttcgtcctcctcgtgtgctttgatggctgaaaagagtgataaagagacaatgaaagggggtagattgaggaagacaacacgacccaggtttgcgtttcagacgagaagtgaagatgatattttggatgatggttatcgttggaggaagtatggacagaaagctgtgaagaacaacatgcatcccagtgatgatcattgccaaaagggaggacacgtgcgacacgtatcatcacgtgtcggtatgcgagaggcgacggtgaacacgtgtgaggagcagcatcctcgtattgacatagttggatacaaggtgtgtcgtttaaaaatgtcgcagttgctggataaagccaagaacttcgtgtcggagaaggtaaatgatatggccaagccggaggcgagtgtcactgacgtggacttcaagcgcgtgagcaaagataatgtcgagtacttggccaaggtctctgttcgtaacccttattcaacttccatacccatttgtgagatcaactactctttcaaaagcgcatccagggagatagcatcagggaaaattccagacccaggatcgttgaaggcaaaggacacaacaatggtggatgtgccagttaaggttccatacagcatattgatgagcttggcaaaggacattggtgctgactgggacatagactatcaattggatcttggtctggttattgatgttcctgtcattggcatcttcaccattcctctctctcagaaaggagagatcaagctaccaaccctctctaccatgttcgcctaa

SEQ ID NO: 28867 - DNA, 1737 bp, Glycine max
  Peptide Sequence Number=SeqID_120552
atggctcttctaatccactccctggaaatgtccgttgccccccaaatttctcaaaaccctaaccctaagctgagcaaactccacagcttcaaaccctaccccaagggcaaagcgattgggtcaacgcgcggtgtgagaatttcctgcaaggtgaaagattgtgtggttttggatgagaacgtgaattcgtacggtcaattttcggttccggtgaagcaagggtcgaagcagagcaaagaggaggaggaagagaagcagaattactatgtgaatgtgggatatgctatccgaactctgagggaggaattccctgatcttttctacaaggaacttagctttgacatctacagggatgatattgtgttcaaggatcctatgaacacattcattggtattgagaattacaaatctatcttctgggcactacgatttcatggcatgatgtttttcaaagctctgtgggtggaaataagtagtgtatggcagcctgttgagaatgtcattatggttcgctggactgttcacgggatcccacgagttctatgggaaagtcgtggtaggtttgatggaacctctgagtataaacttgacaagcaaggcaagatttttgagcaccgggttgacaacattgctatgaattcacctcctcggttcaaagacttgggagagatcagagatgtgagaaacatggatttaacagccataattgctcaacctgtgattgggtatccttgcgtcttcaacgatggctacgaattcgattacctcatcctccttccgaatagtctcaaccagaatccgtctctctctcttctgcaaaacctcacttttccttacattccccacaaaagtctttctcaaaacccatcaccttccacagatttcaaccatcaccaccaccctcatcatcatcaccatcagcatcccttcaacccatcgaagaccttcctcccaagctccaagggccaatccgtccccgaaccaaaagccaaatacgaacagctcatcttctacggcaagaacctcaaacccctcgaaccccaattcaaaaccaacgacaacaaggtccaaggctgcgtctcccaggtctgggtccgagcctacctcgacccgaaccgaaacgtcgtctacgaggcggactccgactccggcctcaccaagggcctcgccgcgctacttgtccaaggcctctcgggtcgacccgttaatgaaatcattcgggttacgcctgatttcgtcacgctgttagggttacagcagagcttgaccccttcgagaaacaacgggttcttgaacatgctgaaattgatacagaggaaggctcttatgttgtacgtggaagctgaaaagggtggtgaatctgatggcattgttaagaattcttcaagtggtggagaaagttctgaacttggtggtgattctaagataccattattggaattgggggggagggggaagaggggcattgttgagaattcaagtggtggagaaagttatgaacttggtggtgaatctgagataccgtcagtgtcagcatcacgtggtgatgagaatttggaattgggggggagggggaagaggcatgcggggcatgctggggttagagggagtgatggggagacacatttcaatgtgagagtggtgtctatagagtttgcagggaagagtttggttaagaggcagacttatctatggcctgctacaagagcagttggatgctggactgcacacgattga

SEQ ID NO: 28868 - DNA, 3000 bp, Glycine max
  Peptide Sequence Number=SeqID_120553
atgggttccttggaatcagggatcccattaaagaaagggagcttgtttggttctcagttcagcagaaaagagaagaaccctttttcacacaggtttagatcgagcttctcgaggttgctcttcaagaagctcgattacgtgcaatggatttgcaccgtggttgtgttcctgtgcttggtcgttgtgttccaaatgttccttccaggctcggtcgtgcaaaactccggggaggagttcttgaaagatgtgagaatgcggtctgataattttttgcaatatggagacattcacaaggttttgttggacattggggaagatgctgtttttttgcctaagatttcggagaaattcagcagaggtagtgggggtagagatgtggatttcttcaaccacacagtgcagcattatgggtacaggaagcctcagttggcattggtgtttggagagctgttggttgattcgcaacaattgcttatggtaacagttgcatctgctttgcaagagattgactatgaaattcaggtcttttcacttgcagatggaccagggcataatgtgtggagaaatttaagagttcctgtcattgtccttagagcttgtgataagcgcaacaacatcgtagactggctaaactatgatggtataatcgtgagctctctagaagccaagggtgccttttcttgttttttgcaggaacccttcaagtctatcccacttatatgggccgttcatgaaaatgctcttgcttatcgatcaagacaatatactactaatgggcagattgaagttttgaatgattggggaagagttttcaatcgttcaacagttgttgtctttccaaactatgccttgccgatgatttactccgcatttgatgctggaaatttttatgtcattcctggttcccctgctgaaacattagaagcagaagcatttatggccttacagaaagataatttgcgcgtcaatatgggctatggcccagaagatgtaattattgcaatagtgggcagtcaatttttgtacaagggcctgtggttggggcatgccattgttttgcgggctttagaaccacttctggcggacttccctttaaacaaagataattctagtgcacaactacgaatcattgttcatagtggggaattaacaaataactacactgtggctcttaagaccatggcgcatagtttgaaatatccaagaggtattatagagcatatagcaggagatttgaatgtcgattctgtacttggcacatcagatgtagtgatatatggatcctttcttgaagaacagtcttttccagagattttgatcaaagctatgtcctttgagaaaccaattattgctcctgatgttcccatgatcagaaaatatgttgacgacagggtgaatggctatcttttcccaaaggataatattagagttctgagacaaattttattagaagtgatctcaaaagggaaaatatcacccttggctcgcaacattgcctcaatagggagaagcactgcaaagaatcttatggtttcagaagcaattgatggatatgcatctttacttgagaatgttctcaggcttccatcggaggttgctccacctaaggctgtttcagaaataccccccagtgctaaagaacaatggcagtggcatttgtttgaagctgttcctaatatgacatttcaaaatagagtattaagaagtaacacgtttttagataaatacgagggccagtggaatcattctcaaaaaactagatccaccccttcagttgcagctaatgatatatttgtatatagcatatgggaagaagaaaaatatactcaactggccattaccaaaaaaaggagagaggatgaagagttgaaggatagaacggagcagtcacatgggacatgggaggatgtatataaaagtgctaagaaggctgatagattaaagaatgatttacacgaaagagatgaaggagagcttgagcggacaggacaaccgctatgcatttatgaaccttattttggggaaggatcctggtcttttctacatcaaaaatctctttatcgaggaattggcctgtccggtaaaggtcgaagaccagggagagatgatgtcgatgctccttctcgtcttccactgcttaataatggttactatcgagatttacttggtgaatatggagccttttttgcaattgcaaacaggattgaccgtttacacaaaaatgcttggattggattccagtcttggagagcaacagcaaggaaggcatctttgtccataactgctgaaaatgcattattagatgctatccaatccaaaaggcttactttctcaaaagccatgaggagaatgtatggggtaaaagatgctgtggattctttgcctcccatgcctgtagatggtgacacatggtctgtcatgcagagttgggctctgcctacgagatcgtttatggagtttgtaatgttctctagaatgtttgtggatgcattggatgcgcaaatgtatgatgaacaccattcaacaggacgctgttctttgagtttgtcaaaagataagcattgctattcacggcttctcgagcttcttgtgaatgtgtggacataccacagtgccagaaggatggtgtttgtggaccctgagacaggtctaatgcaggaacaacacaagttcccgagccgcagaggtcaaatgtggatcaaatggttctcatacagcacacttaagagcatggatgaggacttggcagagttatcagattctgaggatcctgcaagacattggttgtggccgtcaacgggcgaagtattttggcaaggtatatttgacagagagagaagcttaaggcagaaggagaaggaaaagaggaagcagaagagtatagagaaacaaaacagaatgaggaagcgtcatcgccaacaagtgatagggaaatacattaagcccccaccagacgaggaaagttctaattcatctatgcttgcagtaacagcatcatga

SEQ ID NO: 28869 - DNA, 645 bp, Glycine max
  Peptide Sequence Number=SeqID_120554
gattgggagagttttatgcagattgtaatagcattggagatatttatgaatgcatgctcatatgcaggcaatgctgagttatacagtaaggttggggtgcccttcgtgatgggaaccactggtggagatagggacttgttgcataagaccgtgttagattcaaacatttatgctgtgatatccccacaaatgggaaagcaggttgttgcttttcttgcagctatggaaattatggcagagcaatttcctggagccttctctgggtattccttacaggtattggagtcccatcaagcaagcaaagttgatgcatctggaactgcaaaggctgtaatttcttgcttcaacaaactgggggtgtcttacgatatggatcagataaaattgatcagggatccccggcaacaacttgaaatggttggagtcccagaggagcatctatctggtcatgcatttcatatgtatcatttgacatccccagatgacacagttacattcgaatttcaacataatgtttgtggtagatcaatatatgcggagggcactgttgatgctgtgctgtttcttgctaagaagattgaaacaaaggatcccaagagactgtataatatgattgatgtcttgcgagagggtaatatgcgatga

SEQ ID NO: 28870 - DNA, 963 bp, Glycine max
  Peptide Sequence Number=SeqID_120555
atggcccaaaataattcattgcaaccgacccatccaaaccttataaaacactgtctaatcgctctcactctttccctaaaccccaaagagactcaggcgctgctgcccttcagtccttcagcaatggtttacgtgaagtcacagaaatcaaaagcctacttcaagaggtatcaagtcaagttcaagagaagaagagagggaaaaaccgattaccgtgccaggattcggttgattaatcaggacaagaacaaatataacaccccgaaatatcgctttgttagcaacaaagacattgttgcacaaataatatctgctagcattgctggcgatattgttcttgctgcagcatatgcacatgagctgccacgatatggtcttgaagtagggcttacaaattatgctgcagcttattgcactggtctcctgttggcccgaagagtcctcaaaacacttgaaatggatgaggagtacgaaggaaatgttgaggctactggagaggactattcagtggaacctgctgagagcaggaggccattccgtgctctccttgatgttggtcttattaggactacaactggcaaccgtgtctttggtgcccttaagggagctctggatgggggtttggatattcctcatagtgacaagaggtttgctgggtttgataaggagaagaaggagcttgatgctgagatcttggcggaagatgaacctgagaaatatcagtcacacttcagtgaatacatcaagcgtggaatagaagctgatggtattgaggcactgtacaagaaggttcatgctgccatccgtgctgatccttctctcaagaaatctgagaagcagcccccgaaggaacacaagaggtacaatctgaagaaactcacttatgaggagaggaaggctaagttgattgctcgtgtggcggctatcaactctgctgctgataatgatgaagatgatgagtga

SEQ ID NO: 28871 - DNA, 888 bp, Glycine max
  Peptide Sequence Number=SeqID_120556
atgggaacatggtgggttcttagtgcaattgtggggtggatgccatctgcaggagctgggggtatgaaattgtcctatctaggtggaaaatcacaagatgaggtagttcatgacaaaggtgatctttatattatgaacgcatcctttgttccagcaagtgctaagctaggctacttcatcttccaattgaaaaccacccaaccttcttcgaatctcatatttgccattggacccaatggtcaatttccagattatccaaactatgccttgccccaacatatcgatcagacatccattaccatagattattcaaaaggttctacgagtggaaattctaacctaaatcttcttagaagtcatggagttctgaacatcatgggatggagcattctaatgataataggatccataattgctcgctacttcaagcaatgggatcccacttggttttatttccatgcttccattcaagcatttagctttgtggccggcgtaattggaattatatgtggattggtcttatctaagaaactcaacactaaagtgactcatcacaaaaatataggaatcgtcattatcatccttggattcctacaggtattagccgttgtatttcgaccaggaaaggaatcgaagatacgaaagtattggaattggtaccatcataacgtggggaggattttgattatctttgctgtgcttaacaccttttatggactccatttaggaggggaaggatctaagtggtttcttgcttatggagtcattattgctgtcttagttattatcgttgtcattttggagataagaatgcgtatcattgcaagaagagagactccctccaaagataactcatcatatcctcaagccgtggagttaccttattaa

SEQ ID NO: 28872 - DNA, 195 bp, Glycine max
  Peptide Sequence Number=SeqID_120557
atggggcgaaagagtcaccgatgcaaaagatttcagttgcacatttgtagcttaacagggaatagatcttctttcttgggagatccttctatccctactccagatggtaagggtaaaaattcctatcctaggtcaaggtttatagccaatgagttaaggtttcggctcaaaaggcttgtagaaggccgggcatga

SEQ ID NO: 28873 - DNA, 245 bp, Glycine max
  Peptide Sequence Number=SeqID_120558
ctagtgacgttgcaataaatttggatgaatccacttttgatgaagaaactcaagaccttgagactatgatcaatcaatgtggctatcgtaataagatggatatcaacaatctaatgaactacccaggtgaaaatcaagcatgtttggaggttcagagtttagaagatattgtgggtactatcattgataacaatgcagaggatgacgacgaagatgatacggtgtctttggagcctgttacgtga

SEQ ID NO: 28874 - DNA, 899 bp, Glycine max
  Peptide Sequence Number=SeqID_120559
gaaacaatcctgagacgggtgactctgacaggtgcggcttgtacatagaagcagatcctgcccgcctggttgccgtggggagagtttatgagggatccactcttgttcataacactcctttgttgcctggccaagtaaaggtgagtgtggacgaggttaaagatgcagatgttgtagttcctgtacccactgctgaggtttccttagtggggcaggcacttcacaccttccttgcttggccgacacatctgatcaagtctttatcaaaccaggtagctatgtctccgccaaaaccacctctgaagcccgatccggaggtcgataatccgctttatctgatgacattgaccatcccagagcttttcttgaggccttatcaggttagatgggacgccaccgtgttcggggtagttaatccagatttccccatgtacataaagcacgaagacctctctgaaattgcacacggtggtcaatgtctcagcatatcagtgttacagttgtggattatgcatctcactgaaacatgtatgcgagcggggaattctgatatctatggattcctcgagcctcagtccattcagaggtctgggcaatcgcagtttgaatctgaaagttacataaagagttggatgcagagttcacaacgcgatgtgtatcttggagcctacctaaatgggttccactgcagcggacattggcagatggtggtcatcctgcccaaggaacacttagttgtctggttttgttcattgcataacaggccagacaactaccttaaggggattattaataggttagtgttcttttcaatacatttgcattctactcccctcccccgtacaacaccagtttttaaattgttactcatatggaacagtgctatcaaggggtcttga

SEQ ID NO: 28875 - DNA, 501 bp, Glycine max
  Peptide Sequence Number=SeqID_120560
atgggcgtggagctggtccctttcctagtgaaacatattactagggctttgggggttaggggaaccttctttttcttccgactgcatgcaaatctgtggttcttccttccctcctttggacacttcgagatgcccccagtccatgagccgttgaagcaattcttccaccgcgggacaggcaggagtcaatgttgtgtccgggggctccactatggtacgcacacttggcatccgagttgtaccacttggggtatggtggctggaagaccttcccgggtattggccaccaccaaatcattttccaataatgaaggccacaactcggagtatgccatgggaataggagagaaatcatctttcgggggggagctcccggctcggattgaaaagttcgggaggttgggctggtatgagttttggatatttcggggtgctttcatccatgtaggggcggtggtgacccgcgtgggtatctcctatttacctcgtgcccactactga

SEQ ID NO: 28876 - DNA, 268 bp, Glycine max
  Peptide Sequence Number=SeqID_120561
atggggaagaagatcggaaattacatatcagatgagctatccccacgtatcaaggggaagaacaaattccagagcaaatttttccttttcttcgacaatctggccggaaacacatacgttcacatgagatgcggagagtgtattattactctccaagacttctctgtattgttaggtataagtgtggatggtttaccattagtcggtccaacaaatcttgattgggctgatttatgtgaggaattattgggagtcagactacaagaag

SEQ ID NO: 28877 - DNA, 348 bp, Glycine max
  Peptide Sequence Number=SeqID_120562
atggctctggaatggtggtcccagaggaagcatcctgtacctatcggggttcctgggctatgggaccttcatcttccctatgaagagaaggttgggccccaggctaggctaccctctctagaaactgctcaatggaaggaatggatcctggaggcgccaccacctgtaaactctgaagccaaattaatgaccgggctcaggcgctcaaaagtgaggctgtcaaagacaacccctctggctcgacatagggcggtgatcagagtaggaaacccaagtctagaagagttagactgggctatagaagtcatctggccagaaatgagcgctcctatgttcatctccatgtga

SEQ ID NO: 28878 - DNA, 717 bp, Glycine max
  Peptide Sequence Number=SeqID_120563
atgattattacgctagataatgcttaccagtctgaactgttgcttcagcctgcccgtaatagcgcaggtgagctgaaaggtttagacattgtggttaactttactggcgtcggcagcgaagtgaggatccctactgaactcgttatcccgcggctttccgaggcggaagagttagcgctgtttaacgaaaaactgcaattgcttgatacctgtaaactgttttttattcagcatcagttaattgcatggatcaatattacacctgtaattgttgagtttttattaagtaatggaaacgctgtttcaattcttgagcgctatccgtttctggagtttactgttaatgagaattatccaggtttaaataacggaaaggacgatctgcagctggcaagaatggcgatccatttcccgctggtcctggcaaactttggcgcaggcgcggcatcgctcaaagcggtctatgatggattattcaaacgggtcattctcgataaaggattcattcagcagcgtgctcaggaactctcctttgaaccctttatgcgcgctatcctctggcaaatcacgccgcactgccagtcggtgatcgtctcgggcattgacgatcacgccctgttgcagcgcgtcctgtccttcaattttggtgccatgcagggggcgctgtggcctgccgtctctgctgaacacgtcaccacgctggttcagcagcgataa

SEQ ID NO: 28879 - DNA, 339 bp, Glycine max
  Peptide Sequence Number=SeqID_120564
atggtgcaaaagaaggatgaagaacttaggggaagtagcaatgggcccatcggcggttaccataagtggttgaaagcctacgcacaaggtctgggttggctcccgaatttgagagccactaaagaggtggaggttgaagctccggaagaagcgaagagaaagtacaaagaagaattagatttggccaccgcccacgagcacaaagtggcggaggaatacacccgagtgtacgtggaaaaggaggctaagagaagggtgattgactcattacatcaagaagtgacgatgtggatggaacggtttgcttttactttgaacaggagtcaagatgttccctga

SEQ ID NO: 28880 - DNA, 576 bp, Glycine max
  Peptide Sequence Number=SeqID_120565
atgtgtttgcgaagccagcgtagtcgtcgggatggctggcccgcgcgagcggcaccggggagatggcccctgttgccgccgccgcacaatccccaatcgctcccccacattgcatttcatggaacaatagggagcacatggttctcgagttccgttatgtcccccgtgttgctaaccgtcgatcaggctgcccagcagctccgcctgcaccccaaaaccgtcctgcggcatatccgtagcggccaactgcgcgcgacccgcatcggcaagtcctatcgcatcaccgctgaagacctcgacgtgttcaccggcaccgtgcgtgagccctccgctgcgcgcccacagctgaccacagtggtggatattcccggatgcggtgcggcacgtgccgccgacctggtgcgtgccctgcatgcgcgcgtcaccggccgcgaggccgacgatgagccgctgcgcatggagacgatctattcgcctgagcacgatgtgctcaagctgatcgtgatcggtggcctggcgggttccgcagcgctgctggtcagcctgcagcgcctgctgcaggaccgcagcgcatga

SEQ ID NO: 28881 - DNA, 1351 bp, Glycine max
  Peptide Sequence Number=SeqID_120566
gctgaccagccgttccgcatggtcccggaagacttcgacctctggtccgtgaagaacgacaagggcgagatggtgccgttcagcgcgttcgccaccaagcactgggactacggctcgccgcgcctggagcgctacaacggcgtgtcggcaatggaaatccagggcgaaccggccccggttggccaagcagctgccggcgggcttcggcatcgagtggacggcgatgtcctaccaggaacgccaggccggctcgcagacgccgctgctgtacacgctgtcgctgatgatcgtgttcctgtgcctggccgcgatgtacgaaagctggagcgtgccgaccgcggtgctgctggcggccccgctgggtatcctcggcgccgtgctggccaacaccttcaagggcctggaacgcgacatctacttccaggtggcgatgctgaccacggtgggcctgaccagcaagaacgcgatcctgatcgtcgagttcgccaaggagaacctggagaagggcgccagcctgatcgagtcgatcatgcacgccgtgcgcgaccgcttgcgtccgatcgtgatgacctcgctggccttcggcatgggcgtggtaccgctggcggtctccaccgctgccggttccggcgccaagcaggcgatcggtaccggcgtgctcggcggcatgatcgtcggcaccgtgctcggtgtgttcttcgtgccgctgttcttcgtggtggtgcagcgcgtgttcaagcgcaaatccgcgactgccggccgctggccggcatcgcctcctgccatccggcagtaccgatggaagtcattcccatgaaaagtgcatccctgttcctttccattgccgccgcgctcgcgctggccggctgctccactctggtgccgaagaacaccgccgtcgctccggcaattccggcgcagtggccggccgaggctgtacagggccaggtggccgatgtcgccgccgtcggctggcgcgacttcttcaccgatgcgcgcctgcagcaggtgatcgagcagtcgctgcagaacaaccgagacctgcgcgtggccgtgctcaacgttgaacgcgcgcgcggccagtaccgcgtacagcgcgccgaccgcgtgcccggcgtggccgtcaccggccagatgcagcgccaaggcaccgacgccggcgtcaccgagcagttcaccgccggtgtcggcgtggccgagttcgagctggacctgttcggccgcgtgcgcaacctcagcgaagcggcactgcagcagtattttgccgtggctgccaatcgtcgcaacgcgcagctgagcctggtggccgagacagcgacggcgtggctgacctacggtgccgatgcccagc

SEQ ID NO: 28882 - DNA, 62 bp, Glycine max
  Peptide Sequence Number=SeqID_120567
atggtttctgggacttccgcgacttccggtagtacttcccgtaaaatttccgaaaaccttgg

SEQ ID NO: 28883 - DNA, 435 bp, Glycine max
  Peptide Sequence Number=SeqID_120568
ggctacacgccctcaccttgggtactagttaccctcaccgttgagaggactacacgtcctcgccttgagaggactacacgtcctcaccatcagagggctgcacgccctcaccttcagaggactacatgtcctcgccttgagagggctacacgccctcaccttggaggactacacgtcctcgccttcaaagggtcatgtaccttcaactttaagaggactacacgtcctcgccgtcaaagggtcatgtgccttcaccttgtagggtacatgccctcaccttcagaggactacacgtcctcacctttagaggactacacgtcctcgccatcagaggctacatgttccctcaccttttcaaagggggcatgtccctcaccttgcagagggctacgtccttgccatcataggactacactccctcgccttgaaggctga

SEQ ID NO: 28884 - DNA, 750 bp, Glycine max
  Peptide Sequence Number=SeqID_120569
atgtacggcgggcgcatgggcaatgacgcgcctggtgatgcgctgaagtaccacggccgcggctatctgccgttggtcggcaaggagaattacgagcgtgccggcaaggcgctggatctggacctggtgaatcagccggaactggccgcgcagcccgagcacgcaggccgtattgcggtgtggcaggggcagacacgtgtgccggaagccgcgcgcgaggatgtgcgcgaagcaacgcatgcgctcaatggcgccctcaatggcatcgaggcgcgccggcaacgcttcgaggtctggcagcagaagctgacgccggacgtgatggcgcggctggagcggggtgaggtcggtgcgccggcgcagagtgttgcccgagacatgtcgcagactggtgagcccggcaacccgttgttcgaggatgcacgccgacgcctgcagcagatgggagcacagagtggactgcgcagcatacaagagctcgacaataccgctggcgcattggcgctgggggcgcataaagccggcctgtcgcgcatcgatcatctcctggccggcaatgacggtcgcacgctgtttgcggtacagggtgggctgggcgatccggccatgctgcgcgcatcggtcgatcgcgaacaggcggcgcagcagccactggcgcagagcagccagcagttggctgccagcgtcgcccagcaggacccggcggccacgctcgcgcgcgagcaggagcagcgttctcgatccctgtaa

SEQ ID NO: 28885 - DNA, 309 bp, Glycine max
  Peptide Sequence Number=SeqID_120570
atgaagtcaggtgacatgcggggttaccttatggttacccgcacctttcgtccaccaagggcaaacgagcccgttgacgcacagagactaacatcgtcttctgcaacttttgtcgtgttgacccgtgaaggtaacattatggttacccgcacctttcgtcaactaggggaaaacgagcccggtgacgcacagagactaacatcgtcttctgcaacttttgtcgtgctgacccgtgaagtatggtggcatacgtggttaccttatggttacccgcatcattcgtcaaccaggggcagacgagtctattga

SEQ ID NO: 28886 - DNA, 417 bp, Glycine max
  Peptide Sequence Number=SeqID_120571
atgacattgctacttagcaacattctgcccagcgaccgcaatgccgatctcccccctgtggaaggatcacacccacaaagacacccagtggacctgaagaagtccaacagggccctggggtttccagctctggttacgggactctgtcggccctacagggtgcctgttccccccagcaagttcatgtcgtcgtggcatagggatcgtgcccgcaaaacactctgtggacccggagaagtccaacagggtcttggagttgccagctctaaatacgggtctctgtcagttatagggagtgcctgtcgcccccagcaaggtcatcagcccccccctactaatcgagctttcatcaagaagtactgcgtctccaggcaggcgcagggcgaaacaccacatcagcattgggatggccggtag

SEQ ID NO: 28887 - DNA, 588 bp, Glycine max
  Peptide Sequence Number=SeqID_120572
atgcagcctgacctgctcgatttacacgttttacaccacttccgaacccgttctccgcttacgcatttgcagtggcggcaggcaaaccctggacgctggacccggtgccgtgggcgccctggcgttccgcactcgtttttgccatcaaattcttgccctgaaaccggcggccattcgtggcaatgcctccgaaatcctggctcttgccgggatgagcgcccggcgggcgcggcgtcgatacgaccgataccgccgccagccgcggtgcctgcagcccaggcgctggcccggcagatcaatacgattgtggtcgtcaccggtgaggtggattacatcacggacgggcaacgtacccgaacggttaccggcggtgaccagctgatgacgcgcgtggtgggcaccggatgcgcgctttctgccgttgtggcggcgagctgttcgctgccgggtgaccggctggataacatcgctgccgcctgcggatggatgaaacgagccggaacggtcgccgttgcgcagtcgcgtggcccgggcagttttgccagcgcgttcctggatgcgctctacacgctggaggagcatgcatga

SEQ ID NO: 28888 - DNA, 576 bp, Glycine max
  Peptide Sequence Number=SeqID_120573
atggcatccttcagccacatgcagtcccagcttcagttgcagatgcaatctcagggacttgtagtgcctcctgagcctctggttgatccctccggtcctcgagtgagcacaaaggggagttgtgttgatccctcaggaaatgatcccgagatgggtgactctgacaggtgcagcttgtacatagaagcagatcctgcccacctggttgccgtggggagagtttatgagggatccactgttgttcataacactcctttgttgcctggccatgtaaaggtgagtgtggtggaggttacagatgcagatgctccagttcctatacccactgatgaggtaactgtgtctccggcaaaaccacctccgaagcccgatccggaggtcgatgatccactttatctgatgacattgaccttcccagagcttttcttgaggccttatcaggttagattggatgccaccgtgttcggggtctttaatccagatttccccctctacataaagcacgaagacctctctgaaatcgcacacggtggtcaatgtctcagcatatcagtgttacagttgtggattctgtaa

SEQ ID NO: 28889 - DNA, 402 bp, Glycine max
  Peptide Sequence Number=SeqID_120574
atggagtccataatgagcataaaggagataatggaggtcaatgcggctgcaatagccgctaccagcaccattgctgaggtggacctgacccccccatatggcctcaaccaaataaatcatccaacctcagatatggtaggtatggaaggcaaagagttgggaggggccttaatttcgcccccaaccacaacccttctatggaaaatggtgggttacacaccttcaaactttgcggatttggtcttcaccgatgaaaggatcaaagtgggtctggaaaaaggaaaatctgatcatcctgctttgatgaatgcgaaaactggggcaaatgaaaaggataagaatgagggagaaacccttgctatgactgccattcctacacaatcaaatttcccatcagcctaa

SEQ ID NO: 28890 - DNA, 135 bp, Glycine max
  Peptide Sequence Number=SeqID_120575
atgggagtgtttttgagctactccgaggatgatgaggtcgggaaacctgtcgtgccagctgcattaatgaatcggccaacgcgcggggagaggcggtttgcgtattgggcgctcttccgcttcctcgctcactga

SEQ ID NO: 28891 - DNA, 357 bp, Glycine max
  Peptide Sequence Number=SeqID_120576
atggttatgggggatttcatcaacatactctccttccccgaaaacaccgagactttttcaagtctcacaagttatccagaactacgtaggtctgagttcctcattggaggatacgtaggagcaagagcctcgcttttgtcgaccacaccgctttttgttaccatgactcaaaagctgagcttgcggagacaccttacggttatccgcgtctcgtcattcagtgaccccaagtgtccgattggcgcgcagaggcaatatggtcatttgcaccctttgtcaccggagatgcacatttccgggagacaaaatttttccgcacccctccattcagacacgagtcgtgttccgatggcgtag

SEQ ID NO: 28892 - DNA, 886 bp, Glycine max
  Peptide Sequence Number=SeqID_120577
aagacgaagaagaagttggaggaagctgcacaatcaggaagcgttgatggcgtcatcgaccctccatccccggtcagacgccacgtgaagtggaagatggtccgcgagaggaagacagaggagattacaactgaggccgcaaaggaaattgctgagaagattgattcgtttgaggagcaggccacacagggatcgttcgtcccccatgcacgtcaagaggttctcgtcgctgctattggacgtccagagcaccctggatgtgtctgtgctgctggagctgcagctgacccagcagatcagggaccagctagaggagtccatcatagagaaagtgacgaggcagtacctcctgagcctctagttggtcccttcgttcctcgagtgagcacaaaggggagttatgttgatccctcaggaaacgatcttgagacgggtgactctaacaggtgcggcttgtacatagaagcagatcctgcccgcctagttgccatggggagagtttataagggatccactattgttcataacactcctttgttgtctggccaagtaaaggtgagtgtggaggaggctacagatgcagatgctccagttcctgtacccactgatgaggtttccttagtggggcaggcacttcacaccttccttgcttggccgacacatctggtcaagtctttatcacagcaggtagttgtgtctccggcaaaaccacctccgaagcccgatccgaaggtcgatgatccgctttatctgatgacattgaccatcctagagcttttcttgaggccttatcaggttagatgggatgccaccgtgttcggggtctttaatccagatttccccctctacataaagcacgaagacctctccgaaatcgcacacggtg

SEQ ID NO: 28893 - DNA, 781 bp, Glycine max
  misc_feature (749)..(749): n is a, c, g, or t
  Peptide Sequence Number=SeqID_120578
atgaggggagcaccaacagaagaaggcatgtctcctttccttgtgagggattttggcgcacaaaattccaagactatacaaagaatccataaggcatgggaaaccccgttaaggaaagatcaagaacttagaggcattcgtaatggcatcattggtggctaccatgaatggctgaaagttcatatacgaggtttagattggctcgccaagttaaaagtcgtcagcgaagagagttttgaggcaccggaggaggacgaagaagtccaagctctcaaagagaatgcaactaccgcgagagcccttgaacaagagaccaagagggctcacaaggaagagtatggccggaataaatttcgtggagctctgtggggtagcaatagtgaactcaagctgcgaagggaagagagggaccaggcgcgagcacatagcatggtcttgaaagaggagttagttgcctgttcaatgtccaaaaggagcttgtctcagcgtttatgcgagacggagaccaacatgctagctatcatcgccaagtaccaagaagagttaggtctagccacggcccacgagcatagggtcgcggacgagtatgcccaagtatacgcggaaaaagaggctagaggaagggtgattgactctttacaccaagaggcaaccatgtggatggatcggtttgctcttaccttgaacgggagtcaagaacttccccgattgttagccaaggccaaggcgatggcagatacctactccgnccccgaagaaattcatgggcttctcggctatt

SEQ ID NO: 28894 - DNA, 206 bp, Glycine max
  Peptide Sequence Number=SeqID_120579
atgcagctcccgggagacggtcacagcttgtctgtaagcggatgccgggagcagacaagcccgtcagggcgcgtcagcgggtgttggcggatgcgtaaggagaaaataccgcatcaggcgccattcgccattcaggctgcgcaactgttgggaagggcgatcggtgcgggcctcttcgctattacgccagctggcgaaagggggat

SEQ ID NO: 28895 - DNA, 537 bp, Glycine max
  Peptide Sequence Number=SeqID_120580
atgactaaagcacgtcaaaagggggtacgaaaagtaaacgaaatgaaaataaaaaatgaattgaaaaagctcgatttcgggaacttaccggttaaagaccgaagaacacgaagaacaaacgaaaaacgacggaaaatcttcacggaattacctacggaaacgtttcagacacgttacagaagaaaatgggggaggagcttgccacccagctcgcccaggcaagctagaaggcccaagtgggcctggttgctatttgcacccccctgtttactaaatacaccccctgtcttttttgctgattctttttccgtaacattacataaatttatgaattccgtaactgatgaggacatgaccaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaaggttgtgagttgtatcatggcccaaatggaggaggactaa

SEQ ID NO: 28896 - DNA, 489 bp, Glycine max
  Peptide Sequence Number=SeqID_120581
atgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaaggaagtacggatgaccccaagatgtgcaaattcaaaacaagcacgccttcccgccatatggcttgcctcccaaaactatacaccacccaatgtggcgtacattcccaatgaggatacccatgaaattccccatcacaatctagccgacttcgagccttggctcgagtataccactgaagggcaagcagttggcggtatacccctacaaaaccctttggagggccctcagtatcacccacaattgcacctcttgcattccacagcggttaaaaaccctcatgactatggcaggaatgggaaaggcggatcatctaaaggaaaggctcagggccattga

SEQ ID NO: 28897 - DNA, 129 bp, Glycine max
  Peptide Sequence Number=SeqID_120582
ggagagatattccaagagaacttcattgtcaaatgctctctcaacaactcttgggcaaacacttgcaaatctattaagagttcatccaagaattcttcttattcaaagagattgattaagggactgagg

SEQ ID NO: 28898 - DNA, 420 bp, Glycine max
  Peptide Sequence Number=SeqID_120583
atgacggtgaaacctctgacacatgcagctcccggagacggtcacagcttgtctgtaagcggatgccgggagcagacaagcccgtcagggcgcgtcagcgggtgttggcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggggattgaagccaaccttaacaaatacactaccatactggagatgcacagcctaaccaacattcaagaagttcataaactcaacggtaggctagcatccttgtccagattcctcccaaagctcgccggaaaggcaaagccattttacaaactgctttag

SEQ ID NO: 28899 - DNA, 288 bp, Glycine max
  Peptide Sequence Number=SeqID_120584
atggcggtgctcaaggtggcattgtcgtcagtccggatttattgttttcgaattattatggccaatagtcacaagagtaggaaaagttcacctagtcatctgctcccccgaacacaaagttcaagatcatcacaggatccaaacacaaacaacaaactgggaggagaccagtcagggtcactcaaacccgatgacccccaaggcctacactccgaagagtccgtcaggcctctccctcctgattcaggtccaacccctaaaatcattttagcacacagacactgctag

SEQ ID NO: 28900 - DNA, 920 bp, Glycine max
  Peptide Sequence Number=SeqID_120585
ctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacatcggattccccttgtccgtaccagttctgagttgactgttcgacgcccggggaagaggcccgaagggcccgttccaatccgtcccccgaccggcacgcgacgacccgctctcgccgcggaagcagctcgagcagtccaccgacagccgacgggttcgggactgggacccccgtgcccagccctcagagccaatccttttcccgagtacgaccgggcgtgggaggcactcggtcctccggattttcaagggccgccgggggcgcaccggacaccacgcgacgtgcggtgctcttccagccgctggaccctacctccggctgagccgtttccagggtgggcaggctgttaa

SEQ ID NO: 28901 - DNA, 447 bp, Glycine max
  Peptide Sequence Number=SeqID_120586
atgaaggcccgggtgatcggcggtcagatcaccttagtgggggtgacgggaaccccgaacgactggcagaggcccgtgatcaatgccgaaaatcccagggccctgttagacttatccgggtctagagggtgcctggatggcatacaccaactggcacttgagcagagggagatcagagttatgatcgctaggcaagacattgctgagcagcaatgtcatccacgtctgggtcaaagtggtcatgctggtgcacatgatccgtacccgcctccctgtagcggtccgggcatgcaagcttggcactggccgtcgttttacaacgtcgtgactgggaaaaccctggcgttacccaacttaatcgccttgcagcacatccccctttcgccagctggcgtactagcgaagaggcccgaaccgatcgcccttcccaacagttgcgcagcctga

SEQ ID NO: 28902 - DNA, 168 bp, Glycine max
  Peptide Sequence Number=SeqID_120587
atggaaacaataagtaggcaattcaagaatgtcttgcgagctataatgaaaagggctcgatggaaaacaaatggagatggtttaagggtgggaagggtcagcaggagattctcaagtattgtgagatgctttgcatcgtcaaaactgtctccatattccaaatggtaa

SEQ ID NO: 28903 - DNA, 393 bp, Glycine max
  Peptide Sequence Number=SeqID_120588
atgggtgaagtagaggagatacaagagaagatgaaggctgacatggaggccattaaagagaaaatggccacaatgatggaggccatgatgagcatgaagaagataatggaagccaatgcggttatagttgccgctactagcgctgtcgctaaggtgaacccgatgctcccatctggcctcaagcaaatgaatcatccaacctcaaatatggcacatatctctcaaaccatgggggggacacatgaaattccccaccacaatctagccgacttcgagccttgcctcggatatgccactgaagggcaagcagttggtggtatacccctgcaaaaacactttggagggcccttagtgtcacccacaaccacaaccctcacattccacaacggttaa

SEQ ID NO: 28904 - DNA, 201 bp, Glycine max
  Peptide Sequence Number=SeqID_120589
atggacaaatctgaaaagaaaaatcatagtgagaagaaactaaagaaagcatacatcacatgggatgaaaatgatttggaatcctctgatgattctgaaaatgaagagataaatctttgccttatggcaaaaagttacgaaagtgatgaagagaagaggacatggcatatcaacttgctacttcaagaaaaattacagtaa

SEQ ID NO: 28905 - DNA, 987 bp, Glycine max
  Peptide Sequence Number=SeqID_120590
atgtttaatccttttgctaaaaaatccgagcccgtcacaccctctgcaccagaggccaccagcctgagctggacgcaacgcctgaaaaatggtctttcaaaaacacgccagcagttaggagggcaattgagtgccctgttcggtggtggcaaaattaatgaagagatttacgaagagctggaaaccatcctgctcacttcagatgtgggcgtgaatgccacccagtatctgctggagcaactgcgtaaccgggtcaaaaagcatgacctgcaggacactgttgctctcaaacaggcattgaaggaaactttgctggagttgctggggccactcgaatcaccattggatgtcagcaatcatcaaccttatgtcatgatgatggtcggcgtgaacggggctggcaaaaccaccaccataggcaagctggccaaatacctgcaggcacaaggccacagcgtgctgattgcggcaggcgatactttccgcgctgccgcacgtgaacaattgcaggtatggggtgagcgtaacgatgtgcatgtcatcgcctccgagagtggtgatcccgccgccgtcatttatgatgccgtcaattcagccatcgccaaaaaaattgatgtcgtaattgccgatacggctggccgcctgccaacccaattacacctgatggacgaaatcaagaaggtgcaacgtgtgattgataaagctttgccaggcgcaccgcatgaaatcctgctggtactggatgccaataccggccaaaacgccgtcaaccagctcaaagcattccacgaagcactgggcgtcactggcctggccttaaccaagctggacggcacggccaaaggcggcgtcatcgccgcgattgcctacttgagccagcaatcgtcgagcaagacgccggtacgctttgttggcgtcggcgaaagtattgatgatttacgcccgtttaatgccaatgattttattgacgctttaattgatgactaa

SEQ ID NO: 28906 - DNA, 477 bp, Glycine max
  Peptide Sequence Number=SeqID_120591
atgcggcagtttggatacacccagaccattctactccgcctgccgattcatgggtgtcgtttgatgatatacacgacaggtggatgcactattcggaccatatggctgcagcaggtgacatctgcgttgtgccagcgactacatggactgattcttccgcattttgcatccattcgtgacactgggccagccatcagatcctcgggcagatggtcatgctacgcagcccagagttgcccctcaggatccagacatagatatccatccggtcacgaagccagcagcaccgtcgacatctgcaaggtccgatgtggccgagccgagacatgcagtggaagcttgctttgcgattgcggagaggttggagagccatctcaacctagaggtggtcacgccaggcacatcgacacatgtgctgatcgaagaatgcctcaagattgccaagagtgtcacacaagacccgctagtatatgttag

SEQ ID NO: 28907 - DNA, 1227 bp, Glycine max
  Peptide Sequence Number=SeqID_120592
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatccccaggaaggaaaagaaggagtccttttctcatgtggaagatacccaaacattccgttggtaggaacgaggggttgtattaactacaatcccgcgctcgctataagacaactagggtaccccatgaggggagcaccgacagaagaaagcatgtctcctttccttgtgagggatttcggcgcacaaaattccaagactatacaaagaatccataaggcatgggaaaccccgttaaggaaagatcaagagcttagaggcattcgtaatggcatcattggtgggtaccacgaatggctgaaagttcatatacgaggtttagattggctcgccaagttaaaagtcgtcagcgaagagaattttgaagcaccggaagaagacaaagaagtccaagctctcaaaagcgagttaggaaaggcaaaacttgccaaggagaagttcaagttggccgctacacacgttcggaaggagtgtgccgggttacgggaagagaatgcaattaccgcaagagcccttgaacaagagaccaagagggctcgcaaggaagagtatggccggaacaaatttcgcggagctctatggggtagcaatagtgaactcaagttgcgaagggaagaaagggaccagtcgcgagcacatggcatggttttgaaagaggagttagttgcctgttcaaggtccaaaagaagcttgtctcagcgtttatgcgagacggagaccaacatgctagctatcatcgccaagtaccaagaagagttaggtctagccgcggcccacgagcataggattgcggacgaatatgcccaggtatacgcggaaaaagaggctagaggaagggtgatcgactctttacaccaagaggcaaccatgtggatggatcggtttgctcttaccttgaacgggagtcaagaatttccccgattgttagccaaggccaaggcgatggcagacacctactccgcccccgaagagattcatgggcttctcggctatt

SEQ ID NO: 28908 - DNA, 609 bp, Glycine max
  Peptide Sequence Number=SeqID_120593
ttaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccaggggaaacgctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgactggcacgacaggtttcccgactggaaagcgggcagtgagcgcaacgcaattaatgtacaacaaaaccgaagaaagcaagaatttcctgtcacttcagacgcatgcctttgtcaaatggtggacacaatttgatgtatccaaagtggaaccagaacaggtcaagctttggttcatagctcatctagagcccctcaaagcagctgatcctgagacttcggggatcctctag

SEQ ID NO: 28909 - DNA, 441 bp, Glycine max
  Peptide Sequence Number=SeqID_120594
ggcctcggcaattacccattctcgtatttagcggatttatgtctcgtgcccaacatcgtcatccctcccaagttcaaagtaccggactttgataaatacaaagacaacttggccggagcaattgtagcatggtataccaatctggaagcttcccagatccgatcatggaaggacttggcaactgccttcattaggcaggagatgatcacaattatggtagatacgttacccacgttctactatgaaaagctgataggctacatgccagctaactttgcggatctcgtcttcgctggagaaaggattgaatctgggctacgaaaaggcaatttgaatatgcttccaatgtggcccccaacaacaacagaagataccccagtagtgggcgcgaggaaaaggaaggagatgcccatgcggtcaccaccgccccaacatggatga

SEQ ID NO: 28910 - DNA, 342 bp, Glycine max
  Peptide Sequence Number=SeqID_120595
atggcttctatgatggaagccatgttgggaatgaagcgactaatggagagtaacgtggccaccgccaccactactagcatggctgccgaggcagacccggctctctcgactgttgcgcaacatcccgttccaaacattgtgggacgagggagaagcacactgggccatgtcaacaatccccatctggggtacaaccgaggtgcttacctctacggtttaccacccaactacacaccactagccatgcatgaagacgcgggtcacgttactcccttcatcctcgaaggggagcctcctcagcatcctgatggggtccacgaggatcctcaagagcacacttag

SEQ ID NO: 28911 - DNA, 816 bp, Glycine max
  Peptide Sequence Number=SeqID_120596
taccaaggaagtgtttggaggaaagggcaaaggccttggcaaatcaaggcgaatgggctttcttttattgacatcttggcgcttttgatctttggagttgtcctctttccgaatatggaagggttagtggacctagcagcgattgacgctttcctcgcctttcatcatggcaaggaaagcccggtcgtcgccattttggccatgattctatcttcatgcgaaggatgtcccatgagaggagtgccatcagacgaaagcatcacgcctttcatcgcacaaggtttcagtgaccacaacgcgaggactgtgagagacgatgaggttaaagcttcggaagaaagtgatgaggtacaagccctaaaggcagagcttgaaagagcctgggtagtcgaacgagaagttcaagaatcatcacgggtcaaaggcatgatcttgaaggacgagctaaaggcttgccttaggtcgaaaagaaatttgtcccaacagttaagcaagactgaagggaatatgtgggccatcatcgatgagtgcaaagagaagctaaatctagcgacgactcacgagcaaaggctagaggatgagtacgccaagatatcagcagaaagcgaagcaagggagagggtaattgattcatggcaccaagaggcaacaatgtggacggaccgatttgctcttacttcgaacaggagtcaagaacttccccgccccgctagccaaagccaaagcaatggcggacacctactccacccccaaggagatccacggacttctcagctattgtcagcatatgatagacttaatggaccatatgattag

SEQ ID NO: 28912 - DNA, 1083 bp, Glycine max
  Peptide Sequence Number=SeqID_120597
atggggacaaatcaaaacggaaaaagattctatcaagtcaagattaagggtctagatgtcaccagccttaaggagttgggacggttgatggaacccctccaaaggcaagccttccgcaaagtgtacgaaaagattttagatttgaccacagcgaaggtatttacggaagccattgtatccctcgcccaatactatgaccagccattgagatgcttcacgttaggggacttccaaatagtaccgactgttgaagaatttgaggagattttaggatgccctcttgtgggaaaaaaactgtatcttttctccgggtttcttccctccttgagcaagattgtagctatgatcagagattcagcgagagagttggattgtatgaagcaaactcgaaacgacgtagtgggcctaccgcggaaatacttggaaggcaaggcaagggatatggcgagtcaagaagagtgggtcctgtttgcggatatactagctttgctaatctttggggttgtcctctttccaaacgtggacggtgcgagaagaacaacgcacggattgtctgctgcttacccgttctttgtgtgtgtagattgggaccaatacttggctgggataggaggcagcacaatcaactggtttcctcgatggaaggaaggaaaggagggagttctcttctcatgtgaggactacccaaacgttccattgatagggacgaggggttgtattaactataatctcgcacttgctataagacagttagggtaccccatgaggggagcaccgacggaagagagcctctcgcctttcctattgagagatttcggcgcgcaaagtttcaagatcgtacaaagagtccacaaggcatgggaaaacccgttaaggaaagataaagaacttaggggcatccgtaatggcatcatcggtgcttcggaagaggatgaagaagtccaagctttaaaatcagagctaggaaaggcaagactcaccaaagaaaaattcaagttagtcgctacagacatccggaaagagtgtgccggattacgagaggaaaatgcggctactgcaagagccctcgaacgagaaacctag

SEQ ID NO: 28913 - DNA, 225 bp, Glycine max
  Peptide Sequence Number=SeqID_120598
atggcctcctatggtggtgagcttcttctagactcatctctccttgaagtggcgtctcctctctctcttcctttctccattcctctgccattcatcttccaagaagcaaaggaatccattgatgaagaagatcctaggcctacaagctccaatggagcttacatcatgtggtatcaagagcatcttcatctaggttctatggtgcctactttataccaatcctag

SEQ ID NO: 28914 - DNA, 390 bp, Glycine max
  Peptide Sequence Number=SeqID_120599
atggaggagacacatggaatgccctaccacaatctagccgacttcgagccttggctcggatatgccactgaagggcaagcagttggtggtataccctttgaaaacactttggagggccctcagtttcgcccacaaccacaaccattgcattttgcggtgggaagagcccctcctgctatggccgaaaagggaaaggcggatcatctagaggaaaggctcagggccattgaaggaggatgcaactacagaacatttgcaaaaagggggacggatctttcaaagaacacgcccttaaaggtggagggatctggcggcccaggtggtacccccaatgatggaaagggagacgatgatcgtgatggtagagacattatcgatactctactatga

SEQ ID NO: 28915 - DNA, 720 bp, Glycine max
  Peptide Sequence Number=SeqID_120600
atgtctcctatagtagtcataactctttgcaagagcctaagtgaagaacttcgtgactattatgaaggaaggcataggtcacatcttagacctcactcccatagaagagaaaaggaaagaaagcctcaagatgttaacattaacctcccatacttccataggaaggacaatgtagaggctaacttagtttgggaaataagggtagagcaacaacttaaaaagaagtctacgtcaaaatcttatggctctcactcttatccaaagaaagaccaaggtcaaggtatcttaggggtgacaccttctaagcccaaagatgataaggggaagacaatagaaaagcaagcccctaaggctatggttaaagagaagtgtaaggaggtaagtatctcctccaagaggttagctaagaaggaaactcattatacaataaagacaaacattaaagaagctttccctcttagacaacctccacattttctcttttgtaaaaagacacttgctagcatttccatacctcttgggcttgagtttattcctcaagtaaagaagttgttggatgagggtttggttcgcaagagcttaaatccttgtgctttgttggtgcccaaaataggtattgttaggcaccaagtccctaaaataggtggtatgatgaatgttttgaatggtgcaaccctcttttgtaaaatcacttgtgcacctaacatcttcatggaataa

SEQ ID NO: 28916 - DNA, 324 bp, Glycine max
  Peptide Sequence Number=SeqID_120601
atgaagaacggtggaaaatcttcacgaaatcgcccacggaaacgggaaaagaaggaggtggttgccgcccagctcgcccaggcgagctgggttgctcccaccagaaggcaccgccttctgttggaacatcctggaaggcccaaaactttacggattgcgcaacaatgcttcctttcgactttcggcatgtcgcgaaactccatggattgcctaaagatgggtgttaagtacctcgaagcggtcaagcgagggtcgcatgctatcaaacaatggtccccggacgaaattaggagaagagtgaagagttgtccttgttctggatga

SEQ ID NO: 28917 - DNA, 279 bp, Glycine max
  Peptide Sequence Number=SeqID_120602
atggctctcagttatttcgtcaccatttttgcgacttaccatttttgtgcgtttttcgttcaccttgtggttagacatttcgcaagtcaagtgataaacgcacagagacaaatcctgcgccctttgtcattcaagagcagcaagttgagtgataaacgcgcagagactaatgtcttctgcgccctttgtcattcaggagcagcgtcgagtgataaacgcgcagagacaaattatggtcattctgcgccctttgttattcagatttcgcaagtcaagtga

SEQ ID NO: 28918 - DNA, 1095 bp, Glycine max
  Peptide Sequence Number=SeqID_120603
atgggcggccagtcgctggacagcgcgctggagcagctggataaaggcgaagcggaagcgctggtggtgctggagaacgatctctaccgtcacgcgccgaaagccaccgtcgatgcggcactgcacaacaccgcgcacgtgattgtggttgaccatcaacgtaccgccacgctggagaaagccggtctggtgctctccaccgccagctttgccgagagcgacggcacctccatcaaccatgaaggtcgcgcccagcgcttcttccaggtttacgatccggcctactacgacgatagcgtggtgatgctggagagctggcgctggctgcattcgctgcacagcgccgtcgagagccgccagattgactggacgcagctcgatcacgtgattgatgccgcgattgtggcgctgccgcagctgaaagggattaaggacgcggcgccggacgccagcttccgtattcgtggccagaaactggcgcgttcaccgcatcgtgccagtggtcgtaccgccgcgcgcgccaacatcagcgtgcacgaaccgcgtcagccgcaggataaagacaccatgtttgccttctccatggaaggtaacaaccagccgtcggcaccgcgttcgcagattccttttgcctgggcaccaggctggaactcaccgcaggcgtggaacaagttccaggcggaagtgggcggcaaactgcgtcatggcgatccgggcgtgcggctgttcgaagccagcgaaagtgcactggactggttcagccaggttccggcacgcttcgtgggcggcagtcagtatcgcgtggcaccttactatcagctgtttggtagtgaagagatgactcagcgctcgccaaccttccagaaacgcatggcaccggccacgctggtgatcaatccggcagatgctgagaagctgggcgttaataacggtgcgtccgtggagctggtttgcgccgcccccacgctgcgtctgccggtgcgcttctctgcggcactgcaggcggggcaggtgggtctgccgctcggcatgccgggtgtaccgccgttcctcgcgggtgcgcaaattgacaaactgcaggaggcagcgcaatga

SEQ ID NO: 28919 - DNA, 177 bp, Glycine max
  Peptide Sequence Number=SeqID_120604
atggtacaatataaattaaaggaactcgaaatggaactcatgagactaaatcaacatgaagaaaatgacaagaaaaagaaaggaatcacacttaaagctttatcttcaattcaagaagaaagtgataaagaagacttgaatgaaatagaagagatgatgattttagtttcttcgtga

SEQ ID NO: 28920 - DNA, 357 bp, Glycine max
  Peptide Sequence Number=SeqID_120605
atggcaggagctggtgacaatggtggtgtatatcatcaactggacagatttcagcgcttattactggacacgatgactacacaaatgcaacgtttgttgaaacgtaacaatgaagagctctacagacgaataaaaggactaaagcaccaaatgaatccaaatgttgggagaccttatggtggcaacagaagggtcaatgatggatcgaaccgaatagaggggaaagatagaattgagggagtaaaactcaatgtatcctcttttaaaggcaggtgtgatccagacgcctactaccttacctgggagatgaagattcagcatgcattctcctacaatgattatcctgaagagcagaag

SEQ ID NO: 28921 - DNA, 1166 bp, Glycine max
  Peptide Sequence Number=SeqID_120606
ctcatggtcacccgctgtaccatcatccaccaaagcaccatcaatccaggaacaacctgagttccatatccaacccatacagatgattcctggtcaagcccctgttcctgaaaaactagttcccaaacgacaacagggagtgaagatttctgaaaaccctagcattgcaacaagtcctagggaagtggacccggagatggataagaagatccgcagtattgtgagtagcattttgaaagacgcctctgttcctgatgctggtgaagatgttccaacatcctccaccccgaatgtttctgtgcctgatgttgataaagatgttccaacatcttccgctccaaatgctgaagccctcccttcacccagtgaagaggaatcaacagaagaagaagatcaagccacaaagaagacccctgcaccaagggcaccagaacctgctccaggtgacctcattgaccttgaagaggtagaatctgatgaggaatccattgccaacaagttggcacctggcattgcagcccgactacaaagcagaaagggaaaaacacccatcaagaggtctggacgaatcaaaactatggcccagaagaagagcactccaatcactcctaccacatccagaaggagcaaggttgcaatcccctccaagaagaggaaagaaatttcctcatccgattctgatgatgatgtcgaactagatgtctcgacatcaacggagggccaagaaatctgggagaaagaactgggaagagatgccttggattgcaaggagaccatggacctcatcaaggcagcaggactgatgaagacagtcaccaaattgggagactgttatgaaggcctagtcagggaattcattgtcaacattccctctgacataacaaacagaaaaagtgatgattatcagaaagtgtttgtcagaggaaagtgtgttagattctcccctgctgtgatcaacaaatatctgggcagacctactgatggagtgatagatattgctgtttctgagcatcaaattgccaaggaaatcactgccaaacaagtccagcattggccaaagaaagggaagctttctgcagggaagctgagtgtgaagtatgcaattctgcataggattggcgctgcaaactgggtacccaccaatcatacttccactgttgccacag

SEQ ID NO: 28922 - DNA, 99 bp, Glycine max
  Peptide Sequence Number=SeqID_120607
atggacacccgtctccgtgtgattggtgatcccatgaatggagttcaacggatacaagcgcaaggccgtgtaggcgcgctaccactgatcagaacctaa

SEQ ID NO: 28923 - DNA, 330 bp, Glycine max
  Peptide Sequence Number=SeqID_120608
atgactagaggcaatccatctgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattctgattttgcaccttctgagcacatggcacaacctccacctcgtgagaggactctaagggaaatggctgcacctgatttcacctacgaaagcttgtgcatccaataccctgatgaggatgtcccatat

SEQ ID NO: 28924 - DNA, 180 bp, Glycine max
  Peptide Sequence Number=SeqID_120609
atgggtgtccccttcctttttccgtgtgcctaccactggggctcttttattgttgttgggggcaacattggaggcatattcgaacttgccttttctcagtctggactcgattctttctccggcgaagacgaggctattcaatgcggtttgaataaggctaagcgagtagctactcgctaa

SEQ ID NO: 28925 - DNA, 318 bp, Glycine max
  Peptide Sequence Number=SeqID_120610
atgttactaacctttatgcttcgccaatctttatatgccacggggaatcgatcggttgaatccgttgcaagcctatcttccgaaccccgcatcaaagtcttgtcaccgtgcccgcttggggtctgtctgagtaaggaaagagctcgtagccacgtgataggtcttgtcttgttgataacctggagaccggcgaagactgcgctccagctggtgagctcttgtgctccctcttttcaatatccctttgctgtcttcgtaaccgcagtgagagtaggagctcaagcagttgccgctgcaagactagccgctcttgagtaa

SEQ ID NO: 28926 - DNA, 222 bp, Glycine max
  Peptide Sequence Number=SeqID_120611
gcatctgactgagacaagtatgcgagcaaggaattccgatgtgtgtggattccccaagccacagtccatccagagatctgggcaatcgcaatttgaatcagaaagttacatgaagaactggatgcagaattcaaaacgcgatgtctacctaggagcctacctgaatggtgctttgaaaggacttgatgatactccacaacctaaatccaaggctggtgctag

SEQ ID NO: 28927 - DNA, 314 bp, Glycine max
  Peptide Sequence Number=SeqID_120612
gcgtatcacgaggccctttcgtctcgcgcgtttcggtgattacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 28928 - DNA, 864 bp, Glycine max
  Peptide Sequence Number=SeqID_120613
atgaggggagcaccgacggaagaaagcatgtctcctttccttgtgagggatttcggcgcacaaaattccaagactataccaagaatccataaggcatgggaaaccccgttaaggaaagatcaagagcttagaggcgttcgtaatggcatcattggtgggtaccacgaatggctgaaagttcgcatacgaggtttagattggctcgccaagttaaaagtcgtcagcgaagagaattttgaagcaccggaagaggacgaagaagtccaagctctcaaaagcgagttaggaaaggcaaaactcgccaaggaaaagttcaagttggctgctacacaccccttgaacaagagaccaagagggctcgcaaggaagagtatggccggaacaaatttcgcgggagctctatggggtagcaataatgaactcaagttgcgaagggaagaaagggaccagtcgcgagcacatagcatggttctgaaagaggaattgattgcttgttcaaggtccaaaagaagcttgtctcagcgtctatgcgagacagaaaccaacatgttagctatcatcgccaagtaccaagaagagttgggtctagccacggcccacgagcatagaatcgcggatgagtatgcccaagtatatgcggaaaaagaggctagaggaagggtgatcgactctttacaccaagaggcaaccatgtggatggatcggtttgctcttaccttgaacgggagtcaagaacttccccgattattagccaaggccaaggcgatggcagacacctactccgcccccgaagagattcatgggcttctcggctattgtcagcatatgatagacttaatggcccacataattagaaatcgttag

SEQ ID NO: 28929 - DNA, 421 bp, Glycine max
  Peptide Sequence Number=SeqID_120614
cgccacgcttcccgaagggagaaaggcggacaggtatccggtaagcggcaggttcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctcctcttcctcaacaacctaactgcttgccacgagtacacatag

SEQ ID NO: 28930 - DNA, 405 bp, Glycine max
  Peptide Sequence Number=SeqID_120615
atgggtgacctagaggaagtacaggaacagatgaaagccgacatgtcggctttgaaagaacaaatggcttccatgatggaagccatgctaggaatgaaacaactaatggagagtaacacggccactgtcgtcgctgttagttcggctgccgaagcagacccgactctcccaacttccacgcaccaccctattccaaacatggtgggacgagaaagaagcacaccggggcacattagcaacccccatttggggtacaaccgaggaacttacccctacggtttaccacctaattacaccccaccagtcatacgtgaggacacgggtcacgttcctcccctcatcctcgaagaggagccttctcgacatcgtgacgaggtccatgaggatcatcaagagcatgcttag

SEQ ID NO: 28931 - DNA, 615 bp, Glycine max
  Peptide Sequence Number=SeqID_120616
atgagaggtgcgccatcggaggaaaccatcgtgcctttcatcgcacgagggttcaacggagctaatacgaagatacttcagaagatccataaggcatggaataaagtgggaaaaaaagataaagagctgagaggaagaagcaatggtgtcataggcggctatcacaaatggctggaatctagaatgcaagggatagcttggctcaaaaagctaaagggtttgaatagggaagaggcaaaagtgctcaaggagaatgaagaggtgcaagccttgaaggctgagctcgaaaagacaaaagtagcgaaggggaagctaaaggtggtagtcactagagttaggaaagaatgtgataggctgaaggatatcaacatgtccgtggctgaagcgctagagcatgaaatgaaaaaagccagaaaggaagactggagtagaaacaagttttggggggctttgttaggcagcagtaatgagctcaaacttagaaaggccgagagagacaaatcaatgatggagaacgtgatgttagaggataaggttaaggaattgtcagaggtcaaagggaagtttgaaagagaaattgagcaagacggaagagaatatgttgataatcattga

SEQ ID NO: 28932 - DNA, 1253 bp, Glycine max
  Peptide Sequence Number=SeqID_120617
atggcttctcgcaagcgccgtgccgtgcctacaccaggggaagcgtcaactgggacacttcccgcttcacatctgagatagcttggcacaggtaccaagacaacattcagctccggaacatccttccggagaggaatgttgaattgggacccggtatgtttgacgagttcctccaggaactcaggaggcgcagatgggaccaggtgctgactcacctcccggagaagcggattgacgtggctttggtgaaagagttctattcgaacctttatgatccagaggaccacagtcccaggttctgcagggtgcgaggacaggtcgttcgttttgatgctgacaccattaacgacttcctcgacaccccggttattttggaggacggggaggagtatacagcatacaccagatacctcagcactcaccccgatcctgacaccatcgcggccacactgtgcactccaggggggcgctttgtccttaatgctgatggtctcccctggaagctcctgaggaaggacatgacgacacttgctcagacatggagtgtcctttcttattacgatcttgcgcccacttctcacacttctgatgttaatcttgacagggcccgcttgatctacggtttggtgagccgcatggacatggatgtgggcagctttatatcacagcagatcagccagattgcccagtccagcacctcgaggctcgggttcccagcattgattgcagcgctgtgtgacattcagggggtggtttctgataccctgatctttgagtcactcagccctgcgatcaacctagcctatgtgaagaagaactgctggaaccccgccgacccatcgatcactttccctgggcctcgccgcacacgtaccagagcttcagcatcagcttccgaggcccctcttcctacccagtctccgtctcagccatcccagcgaccgcgacatccacctgcttccacctcagcatccatggacatgcatgggcagatgctgaggtcccttcacgtaggacagcagctcatcatggagaatatgcataggctgtccctacacctgcagatggaccccccgctcaccactccagaggcctatcgtcagcgagtcgcctggccaggagaccagccctccactgacaggggggaagagccttctggagccactgaggatcctgcagtcgatgaggacctcattgctgacttagccactgctgactggggcccatgggcagacttgggcggaggaagttga

SEQ ID NO: 28933 - DNA, 636 bp, Glycine max
  Peptide Sequence Number=SeqID_120618
aggactacacgtcctagccataagatggctgcatgccctcacctttaaaggactacacgtcctcgccttcgtagggctacacgcactcacctttagaggactacacgtcctcgcattcatagggctacatgccctcacctttagaggactacacgtcctctccttcagaggactacacatcctcgcccttaccttccgaggactacacgtcctctccttcagagggctacatgccctcaccttcagaggactacatgcatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggcggagatttcctggagatgccaggaagatacttaacaggaa

SEQ ID NO: 28934 - DNA, 129 bp, Glycine max
  Peptide Sequence Number=SeqID_120619
atgacagtcgacgtcggccaggaaagattaccgatcgagatgaatggcagcggaatggagaacgggagagagacagaggagacgccacttcaagaagaagatgagtctagaagaagctcaccaccatag

SEQ ID NO: 28935 - DNA, 624 bp, Glycine max
  Peptide Sequence Number=SeqID_120620
atgagaggtgctaataccttcctcaaacgtaaatacaactccctaatctggaatattctttataaccggtttccattggtttttccaacgttttccacaaataaacgttggtggcgactccgcgcattttcctcctttggaagacgcacccgtgagcctcgcctcgctcgcccgcaaaaggagttgaagaggtttaacctacataaatgcctcaccaaccttcaggagggaagcatagatgtggcagtggttaaagaactctatgccaatttatacagctcggaagaccagagccctaagcaagtgagggtgagaggacatttaatcaggattgatgctgacagtctaaattctttcttagagactccaatagtcttggaggagggtgagacactgcctacctattctaggttttcgaggatgaggattgatcctcaagagtgggctgcccatctctgcatccctggtaggggttttgttctaaatgcagggggccatccttggaagcttctgaggaaagatctcaccactcttgcacagacatggagtgtcctctcctacagtaacccgactcccacttcccacacctctgatcttaatatggatagagccagtttggtttag

SEQ ID NO: 28936 - DNA, 339 bp, Glycine max
  Peptide Sequence Number=SeqID_120621
atggctattctatgtgttattttgaagcttgaatgggcgatggctccgaagaagctttctgctaaaagggctaggaaggccaccgcaggggagggatctagtgcaaccccacaagcgaaaattgagtttgtcggacaccattttcgaagcaaggaacatcagcgtcatttcaaagcgattaaggattggtctttcctcaaagaaagatgggttcagctagcagaaggagagtacacagaattccaggcagaggttgccaggaggcattggacccagctgacagagcccatggctaagtatgaccttgagatagtcatggagttctacggaaacgcctga

SEQ ID NO: 28937 - DNA, 305 bp, Glycine max
  Peptide Sequence Number=SeqID_120622
gtaacggaggcgtgcaaaggtttcctcgggccagacggagactggccctcgagtgcaaaggcagaagggagcttgactgcaagacccacccgtcgagcagggacgaaagtcggccttagtgatccgacggctgatcttccccaagagctcacatcgacgggaaggtttggcacttcgatgtcggatattcgccacctggaacgtcgtgtgacatttgggtccatatacggtgtgggcgttagagcgagggcaggacctttccattttatgagaggcccaagagggatgcacgttgtgagtgccag

SEQ ID NO: 28938 - DNA, 552 bp, Glycine max
  Peptide Sequence Number=SeqID_120623
atgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccaatgagccggcgactcataggcagtggcttggttaagggaaaccaccggagccgtagcgaaagcgagtcttcacagggcaaattgtcactgctttatggacccgaacctgggtccgaaccgactgatgttgaagaatcagcggatgagttgtggttaggggtgaaatgccactcgaacccagagctagctggttctccccgaaatgcgttgaggcgcagcagttga

SEQ ID NO: 28939 - DNA, 94 bp, Glycine max
  Peptide Sequence Number=SeqID_120624
atgttggctatgatcggggatggggaaggtgtggatgtaggtacaggggacggtccacatgcatcaaccaaggatggagatggtgtggatgcag

SEQ ID NO: 28940 - DNA, 174 bp, Glycine max
  Peptide Sequence Number=SeqID_120625
atgaccaagtgcaagtgcaaggatccacttgaaggacttggaggacctatgacaagggctagagcaaggaaatccaaggaagctcttcaacaagtgctgtccatactgtttgaatacaagcccaagtttcaaggagaaaagtccaaggttgttaatggcattaagttattttaa

SEQ ID NO: 28941 - DNA, 246 bp, Glycine max
  Peptide Sequence Number=SeqID_120626
atgaggtcctttaatggtggttttccaccatggagatgcagtagaagacaaaggagaagaggtgagaggaggcaccatccactagggaataagccatggaagaaggagcttcaccaccaagatgagccttggataagaagcttggagaggatgcttcaatggaggaaaagaaagagggagaaaaaagagagggggggggggggggggagcacgaaatttgaaggaagaaaaagggagagaagttga

SEQ ID NO: 28942 - DNA, 324 bp, Glycine max
  Peptide Sequence Number=SeqID_120627
atgacgtctattccccacatggaaaacggccaaggggaggacataacattcagaggatgtggcggaacattgacattgtctgtcgcaacctacccttcagcgggagggcgacgtgtgactcgcgggatgcgtgttccacgaaaggaatacgcgcggagtcgccaccaacgtttatttgaggaaaacgtcggaaaaaccggaaaagacgcgatctacgaactttttagtgaaaggttcgggagttgtatttacgcacagggaagggtgtttccctttgctcctacgtattcctcaatttgggatgagaaaatcagacctacgtag

SEQ ID NO: 28943 - DNA, 204 bp, Glycine max
  Peptide Sequence Number=SeqID_120628
atggttaaagcacatcaaaagggggtacggaaaacaaacgaaatgaaaatgaaagctcgcgaaacaagaaaaaagagggaggtggttgtcgcccagctcgcccaggcgagttgggttgcttccaccagaaggcaccgccttctgttggaaccccctagaaggcccaagtgggcctggttgctatttgcacgccctttttactaa

SEQ ID NO: 28944 - DNA, 891 bp, Glycine max
  Peptide Sequence Number=SeqID_120629
atgattcactctgaggtgcatggtatttctatgatcattgatcaatctcttttcttttcattaactaaattaccctgtcaaggtgcaccttttgagggcaccattattgatgactggaagttcgactattctagtcatgatgctcgccgcatggtctgtaatgaccaggctgatatgaccggtagattgctggtcggatcattaacctttgattatcgcatcatgcactatatcatcgttagaattttgcttccccgttcttctaatttggctcaagcctctgaggaggacttgattttgatgtgggctttctttaccggtcgtcagattgactgggctcacttggttagggaccgaatgcttaaggcattacgggccaatgcacctcttccgtatcctcaattggtcacgctttttctccatcattttcaaattcctcttgatgatgaaccttttgttcaagtcaagagatctattgccataagtgtcagtgcagtaacttcatttggttactgtaaggatcgtgatggacaatggctgaagaaggacgcgcaacctctgcaagacgagcgtactccctctcctccgcctcaacgagatgattcctcagcccttatcaatgaagttctttcggaattacggggcctccgcacctatgttagcgaacgctttgattctttggatggtcgctttgaaggaatggatacctgtatcacgcagcttgaagaggatgaattaaattgtcatcatcaaaaagagggagattgtagaagcaaaagcaaagactttgactatgatgttttgatgatgccatgtggtcatgcacttctcaagtttaattcaagacaaaaatccaagaaatacaagatacatcatcaagaagatctctag

SEQ ID NO: 28945 - DNA, 156 bp, Glycine max
  Peptide Sequence Number=SeqID_120630
atgggagcaagtcatcataggacaccggaattagggtgggtttttatagttgatttagggatggcctttgtggataactgggtggtgggtaaggagaagggttgttattggctgagtaatgacattgttgggttggtgggaaacttggtcgtatag

SEQ ID NO: 28946 - DNA, 383 bp, Glycine max
  Peptide Sequence Number=SeqID_120631
ggtcggaacaggagagcgcacgagggagcttccagggggaaacgcctggtatctttatagtcctgtcgggtttcgccacctctgacttgagcgtcgatttttgtgatgctcgtcagggggacggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgccggataacaatttcacacaggaaacagctatgaccatgattacgaattcgagctcggtacccattgttgttgttgttgtcatggtatacagtgtatgcacagttggtgcacgagcatatgagtag

SEQ ID NO: 28947 - DNA, 760 bp, Glycine max
  Peptide Sequence Number=SeqID_120632
tcgattgggaccaacatttggctgggatagggggcagcgcgatcaattggtttcctcgttggaaggaaggcaaggaaggagttcttttctcgtgtggggactaccctaatattccattgatagggactagggggtgtattaattataatcccgcactcgccataagacaactagggtaccctatgaggggagcgccaactgaagaaagtctttcgcctttccttgtgaggaatctaggcgcacaaagtctcaaggcgatacaaagagtccacaaggcgtggagaagtccgttgaggaaagacaaggagcttaggggcatccgtaatggcgtcatcggagttatcgatgaggaggacttcgaagctccggaggaagatgaagaagtccgagctctaaaattagagttagggaaggcaagactcgccaaggagaagttcaaatcagttgctacacacatccggaaggagtgcaccgagttacaagaggaaaacacggccactacaaaagcccttgaacaagaaaccaaaagggcccgcaaggaggaatatggccgagagaaattccgaggagcattatggggtagcaacaatgagctcaagctccgaagagaggagagagatcggtcacgggtgcatgacatgatcttaaaagaggagttagttgcttgcgcgaggtccaaaaggggtttggctcaacacttggaagccatggagcaaagcatgctagctatcatagggcaatacaaggaagagttgaacca

SEQ ID NO: 28948 - DNA, 192 bp, Glycine max
  Peptide Sequence Number=SeqID_120633
atgtcagtgaaaaacctcgtcgagcgcctaggagtacatgacaagacaaaccacacaataaatgctccaaccatgtgggatcgaaacatgcttagaggagcactcaaactgggtgtatttacccccaaggcctacactctgaagagtccgtcagggcctctccctcctgattcaggtccaacccaaaaataa

SEQ ID NO: 28949 - DNA, 549 bp, Glycine max
  Peptide Sequence Number=SeqID_120634
atggatgtcaagataactttaatattgcatcatgaaggaagattcactccacgtgccagtgatggaaaggttgaatatataggcggagaatttgacgtttgggaggatatatctgcagattacatgaacacatttatcctatgtgatctggtgcaagcatatccaattctagaagaagtcccactgatgttggacttgaaatgtcatccaattccagaagctagtaatgaggatgatttagatgatgtacctgttgctggccatgaggaagatgttggtggtggagagaaagttattaatgtggatgttggtggtggtgaagagagagatgttggtggtggtgaagagaaagatgttggtaatcctgatgatgaagatgacaatgatgaggatgaatggtttatagacttctcttgtatgaggaaggaagttgaagttgaatatgaaacagatggctatcattcagaggagctcaaaaaccccattagtagtgatgatgaagatgaggatgttcacaaagtttatcctcaatacaatgaaagtagttga

SEQ ID NO: 28950 - DNA, 387 bp, Glycine max
  Peptide Sequence Number=SeqID_120635
atggacatgaatgtgggaggacccaggaaggccaggggtaagagatctgaggtccctaccacttcagcaccaaagacaccagttccttcttcttccacggcttcattgcctcccactcagattccaattattcctccagtacctctacagataccacttacagctcctttatctgcagagcatccacaggggcagtccatcatcatgcagagccttcagggcttgggcttgccctcaattatgagcatggaggagtttgatgctcaagtggcctgtccaagagaccaaccctcttcttttggagggggtagggcctctgcagcccaggagccaccagcaccaacaccaccagcagcagcagaggaggaggagactactccagattag

SEQ ID NO: 28951 - DNA, 420 bp, Glycine max
  Peptide Sequence Number=SeqID_120636
ggggaaacgcctggtatctttatagtcctgtcgggtttcgccacctctgacttgagcgtcgatttttgtgatgctcgtcagggggacggagcctatggaaaaacgccagcaacgcggcctttgtacggttcctggccttttgctggccttttgctcacatgttctttcctgcgttatcccctgattctgtggataaccgtattaccgcctttgagtgagctgataccgctcgccgcagccgaacgaccgagcgcagcgagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 28952 - DNA, 381 bp, Glycine max
  Peptide Sequence Number=SeqID_120637
atgaggtccctcaagaactttcagactgggtgcggccatgccttcctggttttcaattgggaaactggcaagtcatggaacgacccaaagtttccatggcgggcacaatgtaatgctttagttttgaccctacagctgggcctaggctttagggttctctccttgttaagatccgatgatgagtcctgtgaaggtactaataccgaggaccctgccatcgattttgaacgagaagcgaatcggcctgaggttgaagaagatgaagctatggaattcccccctgagctagaaaggatggtcgctcaggaagaccgcgagatgaagccgcaccaagaagaaacagaagtcgtaaacttaggtgttggaaatgagaagaaagag

SEQ ID NO: 28953 - DNA, 219 bp, Glycine max
  Peptide Sequence Number=SeqID_120638
atggtgaaagttggaactcttacgtgccgatcaacgtctcatttcgccaaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 28954 - DNA, 447 bp, Glycine max
  Peptide Sequence Number=SeqID_120639
atggacatagactatgctataagaaaagatgaaccacctgcaattactgatgaaagtagtccagctgatgttgcgctatatgagtggtgggagcgatccaaccggctcagcgtgatgttcattaagaccaaaatctcggctgggatatgtggttctatcgaccagcatgaaaagttccaagacttgcttaaagccattgatgactggttcatcccttcagataaggctttagcaagcactctgatcatgaagttctcctctttttggctcaccagtgtgaaagaatatgggtcgtttaagatttcctacaacacacataaggacaaatggtctatcaatgaattaatgaccatgtgtgttcatgaagaagaaaggcttgtaatgaaaatgagtgagagtgcattgctgacaactgcttgtgggaagaacaaagcagttaagtcttga

SEQ ID NO: 28955 - DNA, 207 bp, Glycine max
  Peptide Sequence Number=SeqID_120640
atgatattgcagaagattagaaggcctaactctctaaaaatagtccccagtggagtcaccaactgtcgcaacctacctttcggcgggagggcaacgcgaggctcacgagagcgtcttccaagggaggaaggcgcgcggagtcgacaccaacgtttattcgaggaaaacgtcgaaaaaaccggaaaaggtgtagtctatgaactttaa

SEQ ID NO: 28956 - DNA, 396 bp, Glycine max
  Peptide Sequence Number=SeqID_120641
atgggcctctgccagtcctatggagtgcccgtcgcccccagtaaggtcatctggccatctattagcagggccttcatcgagaaatattgtacgcctaggcaggcacagggccaagcacctcagcagccaaaggaggaccaacaactagttgcagatgcgccactgccacctcaagaggaggtaccgtctctaaggtccatctccgatcgcttgcagaggatagaactccagatgcacaggtatatgcatcatgtgactagccagcaggcggctaatcatagagggcagaggcaccttaacgagacattctaccgttacaacctgcaccagcaaagtcaggaccccagtcctttccattggcccactcccaagcagttcgaggccacagtagcctag

SEQ ID NO: 28957 - DNA, 543 bp, Glycine max
  Peptide Sequence Number=SeqID_120642
ccgcgtgaccgacaggaacatgtccagcgcgttgcgggcgtcctcgaacatcgcggtgctgaggttgatgcacagcagatagctgggcttgccctgctcgtcgcgcgcggcgatgctcaccgaacgcatctttttgccgtcccagttcagcttctcataggggccggtcacgccggcgccgccatcgagctcgaagtcctccagcccggcgtcatcgcccggtttgcgcttcgacaggttgttggccagataggcaatcttgttggtggccagatcgtggatcaccacttccgcattcgggaaaaacagcgccgcgatgccgtcggcgaccgagcgcaaaagttcgagttgagaagaagagttcggcacgctggggggtctccgtatagcccggtttggtttgcggttcagccgcttagcataccgcagttgccgccgcttgccgagtggatggcgttggcgtctccttcaccgacggctgcgccgcaagcgcctttattgtccttgccggggatcggtcacccgtccgtttctggtgaataa

SEQ ID NO: 28958 - DNA, 543 bp, Glycine max
  Peptide Sequence Number=SeqID_120643
atggcaggagcgggtgacaatggtggtgtatatcatcaactggacgcaatgactacacaaatgcaacgtttgttgaaccgtaacaaagaagagctctacaggcgaatagtcaaatcttccttgtttactcttaaacctctatcccctagagaagtgtgtgatgaccaaatcagaatgagagaaaagagagaacaagagaaagaaaataaggcgagtgaagtgaggaaagtgttgcctgctcatgaaccactctatctacaaggcatagaacatcaagttgatctccttcccggagcttcattgcctaacaggccaacttacgaaagcaatccccaagagactcaacgtaaggatgcacatgccaaagttgagtatgtgaaaggattgtatgaccaagtgaaggtgcaaattgcaaagaagaatgacagttatgccaagcaagccaacaagaaaaggaaggaagtggtacttgaatccggtgatgatcctagacatttgagggccaatgtttaccaagaaggagggactgatgagcaatcctga

SEQ ID NO: 28959 - DNA, 117 bp, Glycine max
  Peptide Sequence Number=SeqID_120644
acgaggacgagttgtaatcgattacaaggcttggtaatcgattacaggagtaataagccttctggtaatcgattacaggatgttgtaatcgattacaggctacctgttcttgtgtaa

SEQ ID NO: 28960 - DNA, 489 bp, Glycine max
  Peptide Sequence Number=SeqID_120645
atgtttatgaaaatcaagattggaatgctcgtttatttgcccagcattggtttcgagaatcacaagaggggttcaacaaatcagacttgccaagtcaatgcacttatagatataaggtgtacattgaaggttctgtttggtcagtcagtcaaaaatacattctgtcatgtgactctaccactctacgtgtacgactacatgtttcatctcctgaattcatatgctaaactcttcagatacaaaccctccataagtgctaatgctacagaactatgtgtggagtcaatggtttgtggagcagaaggatcagtaaagaaatttatgatggaatcattggtcaaggttcctgcaaataccgacccttgcaccatgcctgccccttttgaccctccaactttgtatgcaacattagagagaaaggaaagctcaattcaacaagttgaatcatgggagaaaagttattgggataatcaaaccataacatcttaa

SEQ ID NO: 28961 - DNA, 915 bp, Glycine max
  Peptide Sequence Number=SeqID_120646
atgaggggagcgccaaccgaagaaagtctctcgcctttccttgtgagggatctaggtgcgcaaggtctcaaggttatacaaagaatccacaaggcgtggaggagtccgttgaggaaagacaaggagcttaggggcatccgaaacggtgtcattggaggttatcatgggtggctaagaattcacacgcggggcttaggttggctctccaaattgaaagttgtcgatgaggagaaattagaagctccagaggaagatgaagaagtccgagctctaaagtcagagctagggaaggcgagactcgccaaggagaagttcaaatcagctgctacacacatccggaaggagtgcaccgagttacaagaggaaaacgcggccactgcaagagctcttgaacaagaaaccaaaaggtcccgcaaggaggaacatggccgagaaaaattccgaggagcattgtggggtagcaacaatgagctcaagctccgaagagatgagagagatcggtcacgggtgcatggcatgatcttaaaagaagagttagttgcttgcgcgaggtccaaaaggagtttagctcaacacttggaagccacggagcaaagcatgctagccatcatagggcaatacaaggaagaattgaaccagtccatggcccatgaacaaaagctagtggaggattttgcacaagtgtatgccgaaaaagaagcaagagggagggtgattgatgcgctgcatcaagaagcgactatgtggatggatagattcgccttgaccttgaatgggagtcaagacctcccgcgtctattagccaaagcaaaagccatggccgaagtgtgtactggccccaaggagattcatgggctaatcaattactgtcaacacatgatagatttgatggcccatataattaggaatcgttag

SEQ ID NO: 28962 - DNA, 354 bp, Glycine max
  Peptide Sequence Number=SeqID_120647
atggcaggagctggtgacaatggtggtgtatatcatcaactggacggatctcaacgcttattattggacccaatgactatacaaatgcaacgtttgttgaaccgtaacaaagaagagctctacatgcaaatagtcaaatcttccttatttactcttaaacctctatctcctagagaagtgtgtgatgcccaaatcagaatgagagaaaagagagaacaagagaaagaaaatagtgaggcaccacagaggaataggaaaaagaagagtgatacacccgagggaaagagtgatacacataagagagagagtgatacacatgagagaaaatttaattattatgcagaggctagtgaa

SEQ ID NO: 28963 - DNA, 1209 bp, Glycine max
  Peptide Sequence Number=SeqID_120648
atggcgtcgttacccgatgggaaaatgaccagcatctctgaagtcacagaggtctacggcgtatcccgtaatcatatggtcaaaataatcaatcaacttagtcgtgccggatacgttgctgccgtccgcgggaagaatggtgggatccgtctcggtaaaccggcacagagcattcgtgttggcgatgtgaaaatttccaccggagctgacaacggaggaaccgacatgtcacacgatcctttccaggaacgcgaagccgaaaaatacgcgaatcctatccccagccgcgagttcatcattgaacacttaacaaaacgcgaaaaacccgccaaccgtgaagaacttgccgttgaattaaacattgaaggtgaagagcaaactgaagcgcttcgccgtcgcctgcgcgccatggagcgcgacgggcaactggtctttactcgccgccagtgctacgcgctgccggaacgcctcgatctgctgaaagggaccgtcattggtcaccgcgatggcttcggcttcctgcgcgttgaggggcgtaaggacgatctgtacctctcatctgaacagatgaaaatgtgcatccacggcgatcagatcctggcgcagccgctgggcgccgaccgtaaaggtcgccgcgaagcgcgcgtcgtacgcgttctggtgccaaaaaccagccagattgttggccgctattttaccgacgcgggtgtgggcttcgtggtgccggacgacagccgtttgagcttcgacattctgatcccacctgaagaggtgatgggcgcgcgcatgggcttcgtggtggtcgttgaactcacccagcgcccaacccgtcgtaccaaagcggtgggtaaaatcgtcgaagtgctcggtgacaacatggggactaccatggccgttgatatggcgctgcgtacccatgaaatcccatatatctggccgaaagcggttgaagagcagatcgagagcctgcgtgaagaagtcccggaagagtccaaagtgggccgcgtggatctccgctccctgccgctggtcacgatcgacggtgaagacgctcgcgacttcgatgacgccgtctactgtgagaaaaagcgcggcggcggctggcgtctgtgggtggcaattgccgacgtaagctactatgttcgtccgcataccccgctggataacgaagcgcgcagccgtggtacctcggtctacttcccgtctcag

SEQ ID NO: 28964 - DNA, 237 bp, Glycine max
  Peptide Sequence Number=SeqID_120649
gcccacattctaacaaaaagaagcttgctagagctttcatcacaagatgtattgttggcacaaaacaaggtgtgccatctgtggtggagctcacgattctggctgctgtgtccctgttgcaacctatcctttggcgggagggcgatgcgggactcactggtgcatctttcatgggaggaaaatgcgtggagtcgccaccaacatttattcgagaaaaacgttggaaaaatcggaaag

SEQ ID NO: 28965 - DNA, 375 bp, Glycine max
  Peptide Sequence Number=SeqID_120650
atgactttttctcatctgggccgcaacattaccctccatgctgatgcacccccatctttatcccctgcgtcagcccaccaactaggggatcctctagagtcgacctgcaggcatgcaagcttggcactggccgtcgttttacaacgtcgtgactgggaaaaccctggcgttacccaacttaatcgccttgctgcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 28966 - DNA, 1107 bp, Glycine max
  Peptide Sequence Number=SeqID_120651
atgaataccgaacttcttcacaaatattcgggtgcagtgccgcgttacacgagctatccgaccgcaccgcatttccacgagggaatcgataatggcacctatcgccgctggctcggcgcgctcggtcacaggaatcgtctgtcgctttacctgcatattccctattgcgaccggctgtgctggttctgcgcctgccacaccaagcacacgctgaaatacgagccgattgccgtttatcttgaagcacttaagcaggagatcgaagccgtcggcgcacttgtttcgccggatgcggtggtgggtgccgtgcatttcggcggcggctcgcccaccatgttgaagccggaggacatgcagagcctgatggactgtctgcggcgtcatttcaccttcggcctcgcacccgagatcagcgtcgagatggaccccaacgatctggatgacagccgctacgatgcgcttgccgccatcggcatgtcgcgggcgagcctcggggttcaggacttcgatgacaaagtgcaaaaaaccatcaaccgcatccagtctttcgagcagacgagatccgtggtggatgcggtgcgggcgaggggcgttcactcagtcaattgcgacattctttacgggttgccgttccagacatgcgagacactgaaaagaaccgtcgatcagatcgtatcgcttgcccctgatcgcatcgcgctttttggctatgcccatgttccctggatgaagaaacaccagtcgctgatccccgaacatgcgctgcccgatgttgccgaacgctaccgccagatgacgatggcgggggagatgctgaggcaggccggatacagccagatcggcatcgatcattttgcccggccgaccgatacattatcccaggccgccgaagccggcgccctgcggcggaattttcagggctatacgaccgatactgccgatgcgctgatcgggcttggcgcatcatccatcggccggctgccgcagggttatgtgcagaacatggtggcaaccggtgaatatcagcgcatggtgggtgagggcggtctttgccgccgtgaaaggcatttgagttgtcgcaggacgatcatctgcgctctcatgtga

SEQ ID NO: 28967 - DNA, 92 bp, Glycine max
  Peptide Sequence Number=SeqID_120652
atgccttgcaaatatgggatggctccgaagaaactctccacgaagaggtctagaaaggacgccactggagaaggcttcagtgccacctcaga

SEQ ID NO: 28968 - DNA, 345 bp, Glycine max
  Peptide Sequence Number=SeqID_120653
atgaccggccccctcgatgggccgatcgcttgttttctcataaaggtggacccttgggtactagtacctatcacctttagaggaccatatgtcatcgccatcagaggactgcacatcctcgcctgcagagggttgcatgccctcgcctttagagggctacgcgtcctcattttcagtgtgctccatacccacaccttagaagaatataagggatcgcgcccacaagacgcccagtgggcccgaagaagtccaacagggccctggggtttccagctctggttacgggcctctgtcagtcctacagggtgctcgttcccccagcgaggtcacgccatcgtgacatag

SEQ ID NO: 28969 - DNA, 510 bp, Glycine max
  Peptide Sequence Number=SeqID_120654
atggctacaccacccagctccccccatcctcctcctaagtcagcagcaccttcgtcgtctacgttgaagaagacaagaaaagcaacatggctcagatcattagctactagatcagttggggtggagagattagtggttcatgtggatcctaccactgggaaagtcgatgacgtcaaggagagcgacgatgataaagtatgtggaaattacaacataagcaaggagaagtggaaccagttttgtcagagccatagagacccttcatgggaggatattcaaaaaaaggcacaggcctttcaaaaacaaaacactgccccccatgtgttgtctcgtggggttatgattatccagaagaaaaattccctagaagagcaggcctcacggggaagctttgtcgctcatggacatcaggatgtactgactactgtcattgggcgaccaaaacaccctggtcatgttcgtgctactggagccaacgtcacgattaaacaatactttggattggcttga

SEQ ID NO: 28970 - DNA, 396 bp, Glycine max
  Peptide Sequence Number=SeqID_120655
atgaaggtgatgagaatcatgaaactggccaaatacaggctaaaggcccaagtggagaaggatgaaggcccagaggcagagacactatcaagactattaattgttgctgaaggcccaagtaatccttgtggcgtctaccctgacttatcttccttcactggaagtggcgtctacccagacttatcttccttcaccggaagtggcgtctacccagacttatcttccttcaccggaagtggcgtctaccctgacttatcttccttcaccggaagtggcgtcatccaaaaactctacagcctgtatcaagtgatccgccccgtaaggttcacatcatctggtatcagagcttcggctcttgatacaggttctatcttatcctattatttttctttgtaa

SEQ ID NO: 28971 - DNA, 50 bp, Glycine max
  Peptide Sequence Number=SeqID_120656
atgtcgagaaattcgaatggtcataacacttcatacagatgtccgattcg

SEQ ID NO: 28972 - DNA, 579 bp, Glycine max
  Peptide Sequence Number=SeqID_120657
atgacaagcagagaccaagtttggtcattctgcacccatgatacgcggagataccttatggttattcgcacccttttgtcatccagaggcggcgggcccgatgacaagcagagaccaagtttggtcattctgcaccctgtgatgatacgcggagataccttatggttattcgcacccttttgtcatccagaggcggcgggcccgatgacaagcagagaccaagtttggtcattctgcacccatgatacgcaaagataccttacggttatcgcacccttttgtcatccagaggcggcgggcccgatgacaagcagagaccaagtttggtcattctgcaccctgtatcatccagaggcgggcccgatgatacgcggagataccttacggttatccgcacccttttgtcatccagaggcggcaggcccgatgacaagcagagaccaaatttggtcattctgcacccttgtatcatccagaggaggcgggcccgatgatacgcggaaatacccgagtggttatccgtataaacattcttttgctatctgtaagacagaacgcttgatagcatgcagaggctga

SEQ ID NO: 28973 - DNA, 279 bp, Glycine max
  Peptide Sequence Number=SeqID_120658
atggacaaagatcaatggatgtataatagtgtaatgtttgaagaagttgatatgagtgaacaaaatgaaggtgaagctggtgtaaaatcagaacatgttgattgttttgatgtgttcaatacttctcatgtgtttgctacccatgatgatgttttgaattgggctcaagctattacttatgaaactggttttgtggtcgtcattatgaggtcagacacaaacactagtatgagaggaagaactttgtttgtcttaattggttgtgaaagtagtggttag

SEQ ID NO: 28974 - DNA, 3276 bp, Glycine max
  Peptide Sequence Number=SeqID_120659
atggcggtagcgctgtgcgtaatcgataccgaagccgaccacgaactcatccggaatggtaaagccgacaaactcgaccggcacctcaacttcacgacgctccggcttatccagcagcgtgcagatcgccagcgattttggctcacgcagctgcagaatttcacgcactttgctcagggtgttaccggagtcgatgatgtcttcgacgatcagcacatctttgccgcgaatgtcttcatcgagatctttgaggattttcacgtcgcgcgtggaggacatgccgctgccgtagctggaggcggtcatgaagtcgacttcgtgcgcgacatcaatggcgcggcacaggtcagccataaacatgaaggagccgcgcagcaggccgaccagcaccatttcgctgccgctgttgcggtagtgctcgctgatctgcttgcccagttcggcaatacgggttgcgatctcctgctcagagatcatcacgtcgacgcatcctgcccgctctctctggagatccctatggccgcttcatcaggtaaaaaaacgcagatcggcacgcgtgaactgcatccggaaacgcagatgctcaactacggttacgatccgcgcctgtcagaaggtgcggtgaagccgccggtgtttctgacgtcaacctttgtgtttaacagcgccgaagagggcaaagaatttttcgatttcgttgccggccgccagcaaccgccggcgggcaaaagcggcgggctggtctattcccgcttcaaccaccctaacagcgagatcgtcgaagatcggctggccatttatgaaggtgccgaaagcgccgcgctgttctcatccggcatgtcggcgattgccaccacgctgctgacctttgcccgtcccggcgaagtgatcctgcactcgcagccgttgtacggcggcaccgaaacgctgctgagcaaaacgctgcacgatctggagatcaaagcagtgggattcagcgacggcaacgacgaaaataaagtgtatgaagccgcgaagctggcgtggcagcgcgggcgcgtcgcgatgattctgattgaaacgccggccaaccccaccaacagtctggtagatatccaactgatgcgtcaggtggcagaggtgatcacccagcagcagggctcccggccgattctcgcttgcgacaacaccctgctcggcccgctgtttcagcgtccgctgcagcacggcgcggatatctcgctctattcgctgaccaaatatgtcggcggtcattccgatttgattgccggcgccgcgctgggcagccgggcgttaatcaacaaagtgcgttcgctgcgcagcgcgattggcacccagctcgatccgcactccagctggatgattggccgctcgctggaaacgctgtcgctgcgcatggagaaagccgccagcaatgcggaacaggtcgcggcatttctacgcgatcacgcgcaggtggcgaaactgcactggctgccctatctcgacgccagcagtccggcaggagaaacctggcagcgccagtgcagcggcgccggttccaccttctcctttgatatcgagggcggccaggctgcggcattccgctttctcaacgcgctggcgctgttcaaactggcggtgagcctcggcggcaccgagtcgctcgccagccatcccgccagcaccacccattccggcgtaccgcaggaggtgcgggagcgcattggcatcaccgacgcgacggtgcgcctgtcgatcggcatcgaacatgccgatgatttgattgaagatattcgcctgacgctggaagcggccatggcagtgcgccatataggcattttcagtatcggcgacgtagttgaagcgcaccagcacttcactgcgccagccgttgacgctgaccatatctttccagccggcgcgatgcgccgcaggcggcttgccgttctcggacagaatacggaactgcgtgccgtgaatgtggaacggatgcagcatggcgtcgccttcgccggagatggtccatttttcatatttgcccagcggcacggcaaacatgggcttttccatgattgccctgatccatcgccatatcgccgtgctccatattgccatgatccatcgcgccatggtccatgttcatgctgccgtgatccatcgctttgcccgcggcgtgctggctacccatcgctttggcaccgtagcgctgctgcagcgcctgcatgccctgctgatccagctgcggatccatcatcagctgcagccagcggctctgcagcccttccgttgccggcagcggcggcacatccaccagttggtccggcagcgtaccgctggccatcacgcgcagcggcagaatctgcaccagcggcagcggctgatcgaacggcgccagctatccaccagcacttcaaagcgctcgcccggcagcagcggcaggctctccaccttcaccggttcagccagcaggccaccgtcgctcgccaccacgtacagcggacgtttatcgctggcggcgatgtgcagcgagcgcgcgttgcagccgttgagcaggcgcaggcgcagccagccgcgcggcaccgcgtgctgcggatacggcacgccgttggtcagcatcaaatcgccaaaccagcccacggcggcgcgcatgatatccagctgataatcgatacgcgtgccgtcctgagtgagctgcttatcctggaaaatcagcggcacatcatcttcgccccactgcatcggcagccgcagcttgccggacgcctcatcttccagcagtaccagccctgccagcccctgcgccacctgatagccggttttgccatgctgatgcggatggaaccagcaggtcgccgccggttgatcgggggtaaaactcacctgacgcgtggcgccgggcgcaatcagcgcctgcggaccgccatccaccgcgccgggaatttccagcccgtgccagtgcagcgtggtggcttccggcaggcgattatgaatattgacggtgacgcttttctcacgctgcagccgcagcgccgggccgagcaggctaccgttgtaaccccaggttgggacggatttgccgttccactggctgctgccggtcatggcggtcagcgtgtactggccgtgtgcatcgggctccagcagcgacgggatgggcaacagcgggcgcgtagcggccatcagcgagcgactccagaagggcagcgcgccggctgcactgagggcggcggtcagcttgagaaaatgacgacgttgcatattcatatccttatcgtgaataggggcacagcgtaa

SEQ ID NO: 28975 - DNA, 1479 bp, Glycine max
  Peptide Sequence Number=SeqID_120660
atggccgaaaaagagacctggcatgagacgctgcatagcggctttggccaatatttcagcgtagacaatctgctataccgcgataaaaccgcgcatcaggatctggtgatctttgagaacgccgcgtttggccgcgtgatggcgctggacggcgtggtgcaaaccaccgagcgcgatgagtttatctatcacgaaatgatgacgcacgtgccgattctggcgcacggcaatgcccggcgcgtattgattatcggcggcggtgacggcgcgatgctgcgcgaggtcgcccggcatcagcgcgttgagcacatcaccatggtggaaattgatgccggcgtggtgaatttctgtcaaacctatctgcctaaccacagcgccggcgcctatgacgatccgcgtctgcagctggtgatcgacgatggtgttaacttcgtcagccagacgcaggaacggtttgatgtgatcatctccgactgtaccgatccaatcggtcccggcgagagtctgttcacctcggcgttttatgccggctgcaaacaggcgctcaatcccggtggcgtgtttgtcgcgcagaacggcgtctgcttcctgcagcaggatgaagcggtcaacagccaccgcaaactcagccactatttcgctgacgtcagcttttatcaggcggcgattccgacctactacggcggcatcatgacctttgcctgggcgagcgataatccggcgctgcgccagccggaccttgcgacgctgcacgaagccgaacgtgatggctatatcgcctatattgatgagcaatataacgccaaccgcctgacggaaatcctcaccgagacctgctcgattatcggtgctaacgtgctgaatatcgcgcgccaggattatgagccgcagggtgccagcgtgacgattctggtcagcgaagagccgatcaatccgcaggatatcgataattccgagcatcccggcccgctgcccagttcggtggtggcgcacctcgacaagagtcacatctgcgtgcacacctatccggagagtcacccggaaggcggtttatgtaccttccgcgccgacattgaagtctcgacctgcggcgtgatttcgcccctgaaggcgctgaattatctcatccaccaactggagtcggatatcgtgaccgtggattaccgcgtgcgcggcttcacccgcgacgtcaatggcgtgaagcatttcatcgaccatgagatcaattctattcagaacttcatgtccgaggatatgaaagcgatgtacgacatggtggacgttaacgtttatcaggaaaacatctttcataccaagatgttgctgaaggaatttgatctgaagtattacctgttcaacaccaaacctgaagagctgagcccgcaggagcacaagcgcattaccaatctgctgtggaaggagatgcgtgagatttattacgggcgcaatatcccggcgacgggattgaagttgttataa

SEQ ID NO: 28976 - DNA, 912 bp, Glycine max
  Peptide Sequence Number=SeqID_120661
atgagcaacaatattcagggcgtactgaccgccatcgtcaccacttttgatcgcgacggagcctacaatcctgccgcgcagcgtgaacagattcggcgtcagcttagcgctggtaacggtattttctgcggcggcaccaacggggaatttttcgtgctgaacgagcaggagaagctggcggtgaccgagacctgcgtcgacgaagtaaacggcactgcaccggtggtggcgcacattggcgagatctcgacgcccggaaaccgtgcgcacgctggcagcgcatctccgaacacgtcgcctgattggctcgagatcaccaccgccgcaatagagacccgcgccggccactggccgcgcatttttgccaccgacgtctacggcaaaacgctcggcatcatcggcctgggcaatatcggtaagcaggtggcactgcgcgctaaaggcttcaatatgcgcatcctcgccttcgatttttatcccgatgacgccttcgccgccgaacacggcgtgacgtttgtcagcctcgatcagctgacggagcacagcgacttcatcaccttacatatgccgctcaccgaccagacgcaaaacctgttcgacgccgcgcgcctgaagcgcatgaagaagagcgcgtttctcatcaacgcgtcacgcggtggcgtagtgaatgagcaggatctctaccaggcattgcaggataacgtgattgccggtgcggcggcggatgtctttgtgcaggagccgctggcgcagcatccgctgttcaccctgagcaactttatccccacggcgcaccttgccggttataccgacggtgccatcagcgccatcggcgaacgctgcgtgacgcagattgtgcagtgtataaaacagggcgaacgcccgatgaatgtcatgaacgggctggcctga

SEQ ID NO: 28977 - DNA, 97 bp, Glycine max
  Peptide Sequence Number=SeqID_120662
atggcgatgaaaaagttgctcatagcgtcgctgctgtttagcagcgccaccgtttacggtgcagacgatttcgtagtgaaggacattcatttcgaag

SEQ ID NO: 28978 - DNA, 720 bp, Glycine max
  Peptide Sequence Number=SeqID_120663
atggcaactgtttccatgcgcgacatgctcaaggctggtgttcacttcggtcaccagacccgttactggaacccaaaaatgaagccattcattttcggtgcgcgtaacaaagttcacatcatcaaccttgagaaaaccgtaccaatgttcaacgaagccctggctgagctgaacaagatctcttcccgtaaaggtaagatcctgtttgttggtaccaagcgcgctgctgccgaagcggtaaaagagtctgcactgagctgcgaccagttcttcgttaaccaccgctggctgggtggtatgctgaccaactggaaaaccgttcgtcagtcaatcaaacgcctgaaagatctggaaactcagtctcaggacggtactttcgacaaactgaccaagaaagaagcactgatgcgtgctcgtgagctggccaagctggaaaacagcctgggcggtatcaaagatatgggcggtctgccggatgcactgttcgttgttgacgctgaccacgaacacatcgcaatcaaagaagcaaacaacctgggtatcccggtatttgctatcgttgatactaactctgatccagacggcgttgatttcgttatcccaggtaacgacgatgcgatccgtgctgtaagcctgtacctgactgccgttgccactaccgtgcgcgaaggccgttcacaggacctggctgagcaggctgaagaagctgctgaagcttaa

SEQ ID NO: 28979 - DNA, 920 bp, Glycine max
  Peptide Sequence Number=SeqID_120664
cggtgcgtcagggtgcattcatcgcgcgcaacaccgtgctgatgccgtcctatgttaacatcggtgcgtatgtcgatgaaggcaccatggttgatacctgggccaccgtcggctcctgtgcgcagattggtaaaaacgtgcacctgtccggcggcgtcggcatcggcggcgtactggaaccgctgcaggcaaacccaaccatcatcgaagataactgctttatcggtgcccgttccgagatcgttgaaggcgtgatcgtcgaagaaggttcggtgatctccatgggcgtttacatcggccagagcaccaaaatttatgaccgcgaaaccggtgaagtgcactacggccgcgtaccggcaggttcggtggtagtttccggtaacctgccgtctaaagacggtagctacagcctgtactgtgcgttgattaagtatgccgtaagcgttcggttcgttgcgcttattacgcagccgaatgatgatgataatcctgcgcgctcactcactctcagatggaatataaacgctatgtacgacaacctgaaaagcttaggtatcagcaatcctgaagacattgaccgctacagcctgcgtcaggaagccaacaatgacatcctgaaaatctacttccgcaaagacaagggcgagttcttcgccaaaagcgtgaagtttaaatacccgcgtcagcgcaaaaccgtggtggccgatcacaccacccagggttataaagagattcaggaaatcagccctaatctgcgttacgtgatcgacgaactggatcagatctgccagcgcgatcaggtagaagtggatctgaagcgcaaaatcctcgccgatctgcgccatctggagaacgtggtgtcgaacaaaatcgcggaaatcgaatccgatctcgatcagctgacccgcaacggtcgctaa

SEQ ID NO: 28980 - DNA, 1416 bp, Glycine max
  Peptide Sequence Number=SeqID_120665
atggagcaggaagtcacactgctgcgtgacaaaattgaaaaccgtcagacgctgacgctggccggctgcgaaatttacaccggtacgctcaacggcgttgaggtggctctgctgaaatcgggcatcggcaaaaccgcggcggcgctgggtaccacgctgctgctggagctgtgcaaaccggatctggtgatcaacaccggttccgcaggcggtctggcgccaacactgcaggtgggcgatatcgtggtgtccgatgaagtgcgttatcacgatgccgatgtcaccgcttttggctatgagcctggtcagatggcgggctgcccggcggcgtttgtcgcggacagcgcgctgattgccgccgcagagcaggtgatcaaacagctggatctcaacgcggtgcgcggtctggtggtcagcggtgacgcctttatcaatggcgccgcgccgctggagcgtatccgcagcaccttcccgcaggcgattgcggtagagatggaagccacggcgattggtcacgtttgccatcagtttaaggtgccgttcgtggtggtacgcgctatttctgacgtggccgataaagcgtcgcatctgagtttcgaagactggcgcgtggctaaatatctgctgctcgggctgtggctgctgtgccacagtctgctggccgcaccgcgcgtcattaccctgtcgccgcatctcaccgaactggcgtttgccgccggcatcacgccagtggcggtgagcgcctggtcagactatcccgccgctgctcgccagctggagcaggtggcgaactggcagggcattcgcgttgaacgcattgtgcagctcaggccggatgtggtgctggcctggcgcggcggcaatccgctacgccaggtggagcagctacagcgtctgggcatccatgtggaatggatcgatccgcaatcactcgatcagatgattgacgcgttggcagcgctgcagcgctggagcccacagccccagcgggccaccgcggccgcacaggcgttacaccagcagctgcagacgctgcgtcagcgctatcagcagcaaacgccggtgccgctgtttctgcagtttggccagcagccgctgtttaccgccgcgcgcagcacgctgcagaatgaggttatcaccctgtgcggcggtcgcaatatctttgctgacagcagtgtgagctggcctcaggtgagccgggagcaggtgctgatgcggcatccgcaggcgattgtcactggcggtgatgccagccgcgccgccagcgtcgcgcgcttctggcagccgcagcttaacgtgccggtgattgcgcttaacgatgactggctgagccggccgggtccgcgcctgatgctggcggcaaaacaattgtgcgaagctttacatccgacgaaaaataaagcattaccagactaa

SEQ ID NO: 28981 - DNA, 889 bp, Glycine max
  Peptide Sequence Number=SeqID_120666
atggcggatcatgtccgcggcagcgccgatgcagtgcgccgaggtggcgcaggcggccgacagcgagtagctgacgcccttgatctggtaggccgtggccaggcaggccgagacggtcgagcacatcgtgcgcggcaccatgtacgggccgaccttgcgcacgccacgttcgcgcagcaagtcgaccgcgccgatctgccactcgctggagccgccaccggaaccggcgatcaggccggtacgcagattgctgacctgatcggcgctgagcccggcatcggcgatggcatcgcgcatggccagataggcgaaggccgctgcatcgctcatgaagcgcttctgcttgcggtcgatcagcgcgtccaggtcgaggtcgacgcggccgccgacctggctgcgcaggcccgcttcggcgtggtcgcgcgcgctgtagatttcgcggtcatccacgtacatgcgcgcgtccgactgggccatcaccagcttgcggttgatgacacggctgatatcgatctcgtagcgcaccagcttggcgtccggcagcacctggccggtgaacttcacttcgccacagcccagcgcgcggcccttgccgggggcgcccagccaggtcaggaagaagccggtcagctgccacatggcatccaggcccaggcatccgggcatcacggggtcgccgatgaagtggcagccgaagaaccacaggtccgggcggatatccagttcggcgcgtaccatgccttttccatgcggtccgccgtcctcgcggatgtcggtgatgcggtcgaacatcagcatcggatcgttgggcaaacggccggcggcggcgccgaacagttcaccgcgtgcgctggccagcagctgttcgcggttgaacgcgtggagacgg

SEQ ID NO: 28982 - DNA, 376 bp, Glycine max
  Peptide Sequence Number=SeqID_120667
gactgtttccacggctttttcccgctgcgatagcggtttgcgtaaaactttgaaacagttaacatcccggcagcggcgcgcgtgccatttgctggctgaaccgctatcttcagccttcatcaatccggaggtgctatgcaaggcacagggcaaaacgccgggcatgatgattgtcatgagcctgtatgccggtttgatttatcaggcattaatgaccatggatgggaagaacgttactgacgggatggtttttattgctgctatcactggcggccagtgcacaattaccggtgggtcctgtggtgatagcggggcagcatggacgccacctggccgggcacagcagtacggcagatgtcgccgagacgccggatga

SEQ ID NO: 28983 - DNA, 1202 bp, Glycine max
  Peptide Sequence Number=SeqID_120668
atgaattccattggacccaaaaatgatacattggaagaatcatctgagtcttccaatatcaataggttgattgttccgctcctgtatcttccaaaaggaaaaaagatctctgagagctatttcctggatccgaaagagagtactcgggttctcccaataactaaaaagtatatcatgcctgaatctaactggggttcgcggtggtggaggaactggataggaaaaaagagcgattctagttgtaagatatctaatgaaaccattgctggaattgagatctcattcaaagagaaagatatcaaatatctggagttcctttttgtatattatatggatgatccgatccgtaaggaccatgattgggaattttttgatcgtctttctccgagaaagaggcgaaacataatcaacttgaattcgggacagctattcgaaatcttagtgaaagactggatttattatctcatgtatgcttttcgtgaaaaaataccaaaggaagtggagggttttttcaaacaacaagggactgggtcaattattcaatcaaatgatattgagcatgtttcccatctcttcttgagaaacaagcgggctatttctttgcaaaattgtgctcaatttcatatgtggcaattccgtcaagatctcttcgttagttgggggaagagtccgcacgaatcggattttttgaggaacaacatgtcgagagagaattggatttggttagacaatgtgtggttggtaaacaaggatcggttttttagcaaggtacggaatgtatcatcaaatattcaatatgattccacgagatctagtttcattcaagtaacgggttctagccaattgaaaggatcttctgatcaatccaaggattatttcgattccattaggaatgaggattcgaaatatcacacattgatcaatcaaagagagattcaacaactaaaagaaagatcgattctttgttgggatccttcctttcttcaaacggaacgaacagagatagaatcagagcgattccctaaaatcctttctggatattcctcaatgtgccgactattcatggaacgtgagaagcagatgaataatcatctgcttccgcaagaaatcgaagaatttcttgggaatcctgcaagagctactcgttcttttttctctgacagatggtccgaacttcatctgagttcgaatcctactgagag

SEQ ID NO: 28984 - DNA, 192 bp, Glycine max
  Peptide Sequence Number=SeqID_120669
atgagggcttctggtaatcgattaccaagggggtgtaatcgattaccaggcttagaaaggggactagaacattgtggaggcctctgtggttatgaaacgtattgtgcggcggcacagttagattcttgtgaaagagtctacccctttcttttcttccttgtagatcgtgatggcggcgcagctaatccatga

SEQ ID NO: 28985 - DNA, 475 bp, Glycine max
  Peptide Sequence Number=SeqID_120670
ggacagaacccatcaacccacaaagaagagcctgttggaactaacatcacacgacgccttgttggcacagaacaagttgtaccatttgtggtgaagctcatgagacaggccaatgcattcccactgacgataacacttaagaaattcatttcatggggaatcaaaagaggcaagggtacactcaaggaaggttttcaggtttccagcaaggtccttataatcaacaaggacagtggaggacacaccctagcaaccagttcaataaagaccaagatgggacaactggccaagcagatagctgacaagtcatcaaacagctttggagcaaatacggaaaataatcctaaggaggaatgcaaggctgtgatgaccaggagtaaaaggtttgtggaagctgaggatgaagaaaatgaggtagacaaggaacaactgagtgaaaagacaggtgttgaggttaagaaaaatgatgtgaagg

SEQ ID NO: 28986 - DNA, 264 bp, Glycine max
  Peptide Sequence Number=SeqID_120671
atgactcgaaacgcaacgtgtgcttgtcacggaggagccccggggcattccattgagcattgtatgaccccgaagcataaagagaatcgcttgttgaatcctaacattgacaagcaacaccatacatggggcaattctggaagctgttgttatgactcatcaggattgatgcaatcctatcccgcaagggcattgggtagaagactcaaagtagattgggctagagatccaagggaaggccctagggttctcatgagccttagg

SEQ ID NO: 28987 - DNA, 219 bp, Glycine max
  Peptide Sequence Number=SeqID_120672
atgggtgcaagggataaatcaatcatgcacaagagattcatgcaaaagccattacttactgctagtcgttctctcacaattaaagatcacactctcaccgggttgcggctaatgcattccttcacaatcaacctgacaaaccaactaacattttcagtcataatcctaattccatgttttttctcttctaataactgcatgctcatgcaaggcatatga

SEQ ID NO: 28988 - DNA, 345 bp, Glycine max
  Peptide Sequence Number=SeqID_120673
atggcccgagttatgttggggaacggttacgaacccggaaggggtttaggcaaagactacggcggcataactagcctgataaatgccaaaggaaatcgtgggaagtatgggttaggctataagcccactcaggcagattataaagagaagcatcgcgggaaggaagagcgatccaatgaggagtccctcgaaggtactaatacctgggacccgcctatcaacttcaagcaagaaacgaatcaaacggaagatgaagggaacgaggatgtgggacttcccccggaattagaaaggatagtcgcccatgaggaccaagaaatggggcctcatcaagaagaaacataa

SEQ ID NO: 28989 - DNA, 594 bp, Glycine max
  Peptide Sequence Number=SeqID_120674
acatcagtggtcatcgaggaaggggagagcttgccctcttactctaggttctgcaggtggaggccagatcctcaagcgcttgcagcctatctatgtatccctaggagcggatttgagctgaatgcagattggctacttctgaagattttgaggaagaatcttactactctggcccatacctggagtgttctatctttttctaacttagcctcgacatctcatactttagatattactttggatagggctaagttaatctatgggcttgtaatgcagatgaatatgaacttgggatccctcatctcagaattgctagaatctagggctagaggatctaaggcaccatctactttagctccccctacctcagctccttctacattagctccttctacctctcctctccctccaccaccaacagctccagttcttccaggtccctccgctcagagcttagagcctgcatcagcgccagctccagatcatgcagagtttgcaggatgtggtccagcagcggccagttatgagcgtcgaggagtttcttcaaaacatggcctggccaggagtccagccttctcctttgggagggggtga

SEQ ID NO: 28990 - DNA, 297 bp, Glycine max
  Peptide Sequence Number=SeqID_120675
atgaagaagaatgtggtgtttgacaaccgagaggatgttttgcggtgggctcgatccgttcttcatgaaaacggatttgtggtggtgattataaggtctgacacaaacactggtagtagaggaaggacttcgtttgtgttaattgactgtgaaaggagtgacgagtataggtgtaggaagaaagaatttgttagaagagatactagaactaggaaatgtgggtgtcccttcaagcttcatggcaagccaatagttggaggacaaggttggatggtgaaattgatgtgggattcataa

SEQ ID NO: 28991 - DNA, 428 bp, Glycine max
  Peptide Sequence Number=SeqID_120676
cactagaggatgagctcgcgcctgtcatttcacgaggcttcaataagaccaacgtggggacacttcagaaggtccgcaaggcatgggaggtgttgcaaaagaaggacaagggtttggattggcttccaagtttgagaaccgctaaaagagaggaagttgaggcatcggaagaagacgaagaagtgcaggcccttagggcggaactcgagcaagcccaaacagttaaagaaaggttcaaatcagcagttctgaaaatccgaaaagagactactgaactgagagatgtaaatgtggctaccgccaaagccttgaaacgagaaaacaagagggcttgcagggaagaacacggccagaacaagtttcgaggggctctgtggggtagcaccagcaagcttaaactccgaagagaggaaagggaccaatcatga

SEQ ID NO: 28992 - DNA, 921 bp, Glycine max
  Peptide Sequence Number=SeqID_120677
atgacaccttcgaccgaagatgtgaaaagagtaatgcaaggattgtctgttgtacttcagctctttatttatgagaaaggaagggcgaattgggatcaactcttagcaagcaaagaaggagcatctgtcaactggttccctcgatggaaggaaggaaggaccggagttcttatttcatgcagaggatttccaaatgttcccttgatggggacgaggggttgcatcagctacaatcccgttcttgctataagacaacttggctatcctatgagaggagcaccactagaggaagagatcgtgcctgtcatttcacgaggtttcaataagaccaacgtggagacacttcagaaggtctgcaaggcatgggaggtgttgcaaaagaaggacaaggaactcagaggcagtaacaatgggcccatcggtggctatcataagtggttaaaagcccacgtgcaaggtttagattggctcccgagtttgagaactgctaagagggaggaagatgaggcaccgaaggaagacgaagaggtgcatgcccttaggacagaactcaagcaaactcaaatggtcaaagaaaggttcaaatcagcagctcttaatatccgaaaggagaatgccgaactgagagatgtaaatatggctaccaccaaggctttggaacaagagaccaagagggctcattgggaagaacacggccggaacaagttccgaggggctctgtggggcagtaacagcgagcttaaactccgaagagaggaaagggaccaatcgcgagtagacagtttgatcttgaaagatgaattgaaggcttgctcgaggtccaagagaagtttgtctcagcggttgtgcgagacagagaccaacatgttagctatcatcaccaagtatcaagaagaactaagcctagccacagcccactag

SEQ ID NO: 28993 - DNA, 298 bp, Glycine max
  Peptide Sequence Number=SeqID_120678
caaaagaatgtttatacggataaccactcgggtatttccgcccgtcagcgtgactcaaaagtcagtatgacagatcttctaagtgcggaagatgatgtaaatctccgcgtgtcaacgggcttgtcggccgcaattgacgaagggtgcagaatgaccataatttgtctctgcgtgccatcggacacgactgtgtctgaatggcaaaaaggtccgccgcctctggatgacaaaagacgcagaatgaccataatttgtctctgcgtgccatcggacatgactgtgtctggatggcgaaaag

SEQ ID NO: 28994 - DNA, 1214 bp, Glycine max
  Peptide Sequence Number=SeqID_120679
gaattagggcggttgatggaacctctccaaatgcaagccttccgcaagacttacggaaagatcttagagttgaccatagcagaggtatccatagaagccattgcatcactcacccaatactacgaccagcctttgagatgcttcacattcggagacttccaattggtaccaaccattgaagaatttgaggaaattctaggatgtcctcttgggggaagaaaaccatacctttcctccgggtgtctcccctctttgagtagaattgcaactgtggtcaaggattcagcaagaggtttggaccgcataaaacagactcggaacggcatagcgggcctaccatggaggtacctagaagacaaggcgaggggtatggccaatcaaggagattgggttccatttatggatgtgttagctttgctaatttttggggtcgtcctctttccaaacgtggatggtttagtggacctagcagcaatcgacgctttccttgcataccaccatagcaaggaaagtccggtggtagctgttctggcagatttatttgacacatttgaccgaaggagaatagattgggaccagcttttggccgagataggagggtacccaaacattccgctgataggaacgaggggttgtatgaactacaatcccgcgctcgctataagacaactagggtaccccatgaggggagcaccgatggaagaaagcatgtctcctttccttgtgagggatttcggcgcacaaaatttcaaggctatacaagcaatccataaggcatgggaaaccccgttaaggaaagatcaagaacttaggggcattcgtaatggcatcattggttggtaccatgaatggctaaaagttcatatacgaggtttagattggctcgccaagttaaaagtcatcagcgaagagagttttgaagcaccggcagaggacgaagaagtccaagctctcaaaagcgagttaggaaaggcgaaacttgccaaggagaagttcaagttggccgctacacacatccggaaggagtgtgccggattacaggaagagaatgcaactaccgcaagagcccttgaacaagagaccaagagggctcgcaaggaagagtatggccggcctaaccttcgcggagctctgtggggtagcaacaatgaactcaagctgcgaagggaagagagggaccagtcgcgagcacatagcatggtcgtgaaggagga

SEQ ID NO: 28995 - DNA, 243 bp, Glycine max
  Peptide Sequence Number=SeqID_120680
atgagtcatcattcatctagtgttaatggcgagggtactactcataagaaccctctatctagaatcttagatgagttgagttccctcaagttatggaaagaaaaactagaaagaaaagaaaaaggaaaagagaggaaagacataggtcacatcttagacctcactcccataggagagaaaaagaaagaaagtctcaagaggctaacattaacctcccatacttccatgggaaggataatgtag

SEQ ID NO: 28996 - DNA, 210 bp, Glycine max
  Peptide Sequence Number=SeqID_120681
atgttggtgcgcatgatccgcactcgtctctttgcagcggcacgggtgaaatcttgccccggtatgcatagtagctgtgtgatagcctccctctctggttgtgctcacacagttggccctcctccaatatcagggggtggcccaggaaccattaaaaggaaactactgatgtggagcacactgaaaatgaggacacgtagccctctaaag

SEQ ID NO: 28997 - DNA, 393 bp, Glycine max
  Peptide Sequence Number=SeqID_120682
atgcccttgcgggataggattgcatcagttgatctcaatatcttagatggtgtggagatgaagcttttgggattgactagacaaccctccataggaaaattcatctgcaatggtgttgattacacctttgatttgttgggcaggctcattttcctactcatgttaaggctagtgtttgtgtctttgctagtgatgcctctgtctccctctgtcttatgctatgtccctccttctatcaacatcatggtttttgtgctcatgctcttgtgtcctccagcatttggttctatctattttgggtctggaggaagtggcggaggaagctttatgggtacctccgtgttgaaggcctcctcaagaatagtggttcaattggttgtcagaggtgtctaa

SEQ ID NO: 28998 - DNA, 468 bp, Glycine max
  Peptide Sequence Number=SeqID_120683
atggcggctggaaatacaacaatagagaaacctagagaagagtggtctgaagaagaaagaagattagtgcagtataatttaaaggctaaaaatatcattacttttgccctaggaatgaatgaatattttagggtgtcaaattgtaagagtgctaaggatatgaaatcaaagaagcaaaacttcaaatctaaaagaagaactgaagagtcatctcaaatcccaaaatgctttgagtgtaatcaacccggacatctgagggctgattgtccaatctttaagaagaagatagagaaatctgaaaagaaaactattggagataagaaggcaaagaaggcctatatcacatgggatgacaatgacttagaatcgtctgatgattctgaaaaagaaatggttaatctatgtctaatgggcaaagattatgaaagcgacgaagaggtaacatcttctaacaaatctattctttga

SEQ ID NO: 28999 - DNA, 216 bp, Glycine max
  Peptide Sequence Number=SeqID_120684
atgggttcagaaaaaactcccataattgaagatctccataaatatcttcagattgaaaagaagaaaatagaaatttctaatgacgacgaaaaaacggctgctcctgaattttgggatcatccgaaagaggcggaggcgttcttaaagcagcttcgttctaaaaaaagatgggtggaagattaccaggaaattgctactcagtttgaggatctgcag

SEQ ID NO: 29000 - DNA, 594 bp, Glycine max
  Peptide Sequence Number=SeqID_120685
atggacaagaaaatccgcagtattgtgagtagcattttgaaagacgcctctgttcctgatgctgagaaagatgttccaacatcctccactccagatgttgctgtccctgaagctgatgaagatgtcccaacatcttccaccccgaatgtttctgtgcctgatgttgagaaagatgttccaacatcttccgctccaaatgctgaagccctcccttcacccagtgaagaggaatcaacagaagaagaagatcaagccacagagaagacccctgcaccaagggcaccagaacctgctccaggtgacctcattgaccttgaagaggtagaatctgatgaagaacccattgccaacaagttggcacctggcattgcagatagactacaaagccgaaaggaaaaaacccccattaagaggtctggacgaatcaagactatggcacagaagaagagcactccaatcactcctacctcatccagaaggagcaaagttacaatcccctccaagaagaggaaagaaatttcctcatctgattctgatgatgatgtcgaactagatgtctcgacatcaaagagggccaagaaatctgggagaaag

SEQ ID NO: 29001 - DNA, 861 bp, Glycine max
  misc_feature (846)..(846): n is a, c, g, or t
  Peptide Sequence Number=SeqID_120686
atggaagaaagcatgtctcctttccttgtgagagatttcggcgcgcaaaatttcaaggctatacaaagaatccataaggcatgggaaaccctgttaaggaaagatcaagaacttaggggcattcgtaatggcatcattggtggttaccatgaatggctgaaagttcgtatacgaggtttagattggctcgccaagttaaaagtcgtcagcgaagagagtttcgaagcaccagaagaggacgaagaagtccaagctctcaaaagtgagttaggaaaggcgaaacttgctaaggagaagttcaagttagccgctacatacatccggaaggagtgtgccggattacgggaagagaatgcaactaccgcaagagcccttgtacaagaggccaagagggctcgcaaggaagagtatggccggtacaaatttcgcggagctctatggggtagcaataatgaactcaagttgcgaagggaagaaagggaccagtcgcgagcacatagcatggttctcttgtctcagcgtctatgcgagacagtaaccaacatgttagctatcatcgccaagtaccaagaagagttgggtctagccacggcccacgagcatagaatcgcggatgagtatgcccaagtatatgcggaaaaagaggctagaggaagggtgatcgactctttacaccaagaggcaaccatgtggatggatcggtttgctcttaccttgaatgggagtcaagaacttccccgattgttagccaaggccaaggcgatggcagacacctactccgcccccgaagagattcatgggcttctcggctattgtcagcatatgatagacttaatggcccacatnattagaaatcgttag

SEQ ID NO: 29002 - DNA, 225 bp, Glycine max
  Peptide Sequence Number=SeqID_120687
atgatgattggatgtggaattacctggatgttgtggaagcttggaaggattgatggggacttggcgttgagaggaacgaggataagggctacatgggagtacgtgagctcagttggaggtgggcaacaagggatggtgggtttagtggtacctagagatatgtcgcgggggtcaggagaccttggggacatcaggtggggtgctattgcccaaaaccaagcttga

SEQ ID NO: 29003 - DNA, 192 bp, Glycine max
  Peptide Sequence Number=SeqID_120688
atgcaggagggtgcaggttcagcaaggtcaggccatgcaggagggaatcaccatccgtattggtggtttgctttcggtgagggaatcgccagcctggctagcgtgacgctaagcgagcaactaactgcaggcgctaagcgtggcgttaagcacgaaggagcagaaaccgttacgcgcactaagcccagctag

SEQ ID NO: 29004 - DNA, 67 bp, Glycine max
  Peptide Sequence Number=SeqID_120689
atgccactgaaagactctactgagacaagacggctgtcagaacgtagaggagtaggatgggcagttg

SEQ ID NO: 29005 - DNA, 390 bp, Glycine max
  Peptide Sequence Number=SeqID_120690
atgacagtagctgtgtctcgcaaaccaccttcaaagcccgatccggaggtcgatgatccgctttatctgatgacattgaccatcccagagcttttcttgaggccttaccaggttacatgggatgccaccctgttcggagtctttaattcagatttcccactctacataaagcacgaagacctctctgaaatcgcacatggtggtcaatgtctcagcatatcagtgttacagttgtggattttgcatctcactgatacaagtatgcgagcgggaattctgatatctatggattcctcgagccacagtccattcagagagttcaaaatgcgaggtctatcttggagcctacctaaatggcggacactagcagatggtgatcatcctacctaa

SEQ ID NO: 29006 - DNA, 255 bp, Glycine max
  Peptide Sequence Number=SeqID_120691
atgactattgaagaatccattcatgtttcttttaatgagtctaatgttatttctccaagaaaggatgtgttggatgatgtttcagatttcttagaagagatgcatactcatgaaagggattccaaaaggaaaagagatgaaagcaataaggattttcaagactatgaaactaaagcaaacaatgatcttccaaaggagtggaaagcttccagaattcattttcttgacaacattatcagcaatatctcaaaagag

SEQ ID NO: 29007 - DNA, 282 bp, Glycine max
  Peptide Sequence Number=SeqID_120692
gtcgactctagaggatccccaggcccaagtggagaaggacgaaggcccaagtggagaaggacgaaggcccaagtggagaaggacaaagcccccgagtggagaaggacttatcaaggtaatccttgtggcgtctaccctgacttatcttccttcattggaagtggcgtctacccagacttatcttccttcaccggaagtggcgtctaccctgacttatcttccttcaccggaagtggcgtcatccaaaccttcgtagcctttatcaaacgatccgccccgtaa

SEQ ID NO: 29008 - DNA, 105 bp, Glycine max
  Peptide Sequence Number=SeqID_120693
atgaaaaaatacgaaaaatcgcacaagttggcagggaattggaaggaggattggtgccatcccttgaagaatttgagtccagaagcaaggggccaaccaccttaa

SEQ ID NO: 29009 - DNA, 1081 bp, Glycine max
  Peptide Sequence Number=SeqID_120694
cgtgctcggccgcacgccggggttcgatcgcgatgcgccgctgttccaggcgatgctggcggacgatgtgctgtcgcgctgcaagctgatcgccgaaccctgggacgttggccccggcggctatcaggtgggggcgttccccggccgcttcgccgaatggaacgaccattatcgcgacgacatgcgccgtttctggctgcagagcggcgtgtcgctcggccagttcgcccggcgtttcgccgcctccagcgatctgtacaaccagcgcgggcgggcgccttacgccaccgtcaacatgctgaccgcccatgacggttttaccctgcaggacgtggtcagcttcaacgagaaacacaaccagccgaacggcgaaggcaaccgtgacggcagcgatcgcaatttcagcaacaaccacggcgtggaaggcctggtcgccgacgacgccattgtgcaacgccgtagggccagccagcgggcgatgctcgccacgctgttgctgtcccagggaacgccgatgctgctggccggcgatgaacagggacatagccagcaggggaacaacaacgcctattgtcaggacaacgccatcacctggctcgattgggccacggcggatgacgcgttgaccgattacgtcgcggcgctgatcgcgctgcgccgccagatccccgcgttgcaacaggaccgctgggcagccgctcgacgcgcagcagtgggagcaaggcgatctgctcatgcagatcctgctgtcgcagcgctggctgctgctggtcaacgccacgccgcaaacggtggagatgaggttgccggaaggcgattggcaggttgtcgccccgttcactcaggaagactcacgggcggtgttacccgcctggcaccaggccgcgcgctcgctttgcgttctgcgctgatcctggccggcggccgcggctcgcgcctgaaagatttgacctccacccgcgccaagcccgccgtccactttggcggcaagttccgcatcatcgatttcgccctgtcgaactgcctgaactccggcattcgccgcatcggcgtgatcacccaataccagtcgcacacgctg

SEQ ID NO: 29010 - DNA, 411 bp, Glycine max
  Peptide Sequence Number=SeqID_120695
atggggacaaggggttgcatcaattacaatcatgtcctagctataagacaagttggctaccctatgagaggggcaccactagaggaagacctcacacctattattgcacgaggtttcaatagcaccaacgcggaggcacttcagaaggtccgcaaggcatgggagatggtgcaaaagaaggacaaggaattcagaggcagtagcaacgggcccattggtggctaccataggtggttgaaagcctacatgcaaggtctggattggctcccgaatttgagaaccactaagggggtggaagttgaagctccggaggaggacgaagaggtgcaggccctcaggacagaactcgagaaagcccaaactgtcaaagaaaagttcaaatcaacagctcttaggatccgaaaggagaat

SEQ ID NO: 29011 - DNA, 294 bp, Glycine max
  Peptide Sequence Number=SeqID_120696
atggctaagtttgaccctaaggtagtcttggagctttacgctaatgcttggcccacagaggagggagtgcgagacatgcgttcatgggtgaggggaaggccaggagtgcgagttcagtcagaggaggaacagggccgacgggttcgacgaggaggccattgcccagctattgtgcacaccagggcaggatttcgcccggactgctgtagggaggcgggtgcggatcatgcgcaccagcatgaccaccttgacccagatatggatgacattgctgctcagcaatgtcttgcctag

SEQ ID NO: 29012 - DNA, 237 bp, Glycine max
  Peptide Sequence Number=SeqID_120697
atggccttagcaaatttcttattcccagaaggaaattccatgaaacatgagatagaattgcaaagacttaatcaaaatgagatagaggaagcaaacgtatgcttaatgaccaagaatcatgaaagcgatgaggaggagcccttgaaaaaaaagtggtacatagacaacggattctctaaacacatgacgagagatgcctcaaagttcacaactatttctcctaagaaaagcgggcat

SEQ ID NO: 29013 - DNA, 351 bp, Glycine max
  Peptide Sequence Number=SeqID_120698
atggcaaccaataagaacttgacatgtctcgagacttttgggaatggtactagtatgtccatcccctacatggaaaaagatcaaggggagtttaggctctgtaggttgtcaagaggggtcatccagtttggctccacttcttctcctgctatgacctctttgatgtctatggtaagtgcttggagtgtcttctggatgatgatggtcttgaggatgatgcttgctgatgtagctccatgtggagcttgtaggccttggatcttcttcatcaatggattccttttcttcttgaggtctgattgcagcaaaatggagaaggagaaagatgaatggagatgccacttcaagtag

SEQ ID NO: 29014 - DNA, 339 bp, Glycine max
  Peptide Sequence Number=SeqID_120699
atggttaacgagtctggggtcatagttttactaggacaccttgtagaagcaaagcttcctgaaattctgatactggggacagatgtcgtacaggatgtcacgacatcgcgcttcagaacatgcagattgtatatgaccggtaacatcaaggtggctcacaaaacactcaagtcccaaaactcacaaaataactcttcaatctcggacttggtagaaaactcgtgcagccttcatgtttatatagcagtgtgcgtatctgggctgcaacaacttgcgctggataagatctatcattctcctgaaaaatctgcacttaaagatctaaaagataaagtttga

SEQ ID NO: 29015 - DNA, 606 bp, Glycine max
  Peptide Sequence Number=SeqID_120700
atggggtggttggaataccaagaaaatgtttggaggcaaaagcaagaatcttggcagggagtcctctttccaaatgtggatgggttggtggacctggcagcgatcgacgcttttctcgtctatcatgaccgcaaggaaagcccgattgtcgctatactagccgatctatatgacaccttcgaccgaagatgtgagaagagcagtacaaggattgtttgctgtactccagccctctatgtatggttggtttcgcacctttttcgccaagaggtgagccatgcttgcccgctagaaagccaccgttcatgcacagagaaaagaggggcgaattgggaccgactcttagcaagcaaagaaggagcgtctgtcaactggttccctcgatggaaagaaggaagaatcgggattcttacttcgtgtggaggatttccaaattttcccttgatgggaacaaggggttgcatcagttacaatcccgttctggctataagacaacttggctatcatatgagaggggcaccactagaggaagagctcgcacctattattgcacgaggtttcaataagaccaatgtggaggcacttcagaaggtccgcaaggcgtga

SEQ ID NO: 29016 - DNA, 260 bp, Glycine max
  Peptide Sequence Number=SeqID_120701
atggggggtgcaaatagcaattttgacattttgaaattgggtcttcgagagtattttcgaagctggattgcttctggaggaagcaacccagctcgcctgggcgagctgggcggcaacctcctccccctttttcctataaataggctgaagggggctgttctaagggtctcggatccccctggtgatgtttccgtaagcaaatacgtgaaggatttccttcgttattcaccgttcttcatccgttcttctttcttcaacgg

SEQ ID NO: 29017 - DNA, 297 bp, Glycine max
  Peptide Sequence Number=SeqID_120702
atgaagggaatcactggagcaccttacagggcacgttgtgatgctttgaccatcacagatgtgtcctggttgccgtacacggagcatcgggggtttagggcctttgaggtgatttcatcatttcaagctcgaccggagagggtggtacgacggtttggttacatccaaagcatccctccgtcgcctgtatctgcgaattacatggagtggtttttccgcatatctcactcattcatgataccgacccaggcaggtgaccagccgagagatgcaccagctgcagaccctgaggagtag

SEQ ID NO: 29018 - DNA, 456 bp, Glycine max
  Peptide Sequence Number=SeqID_120703
atgcttaacaccccccctccccctacaactcaagatgcctcaagggataacatctggagtttggatactaagtatcggaatcgcatagtggtgtgggacttctatcagcaagagccctttactcggcttctgaaacaagagaacggaccgactctaactaatccactcctaataacaggaaggctaaaggcagacctcgtcctactaaaggaaagggctctttctattccgagttggcctgcaccggtcctatcctattcgattaggaaactgatgattctagagcaagtgacatccatatcaaatcctccagaagttatgctcaacaggaaagtcattaagaagtgccacagcactattgctattgatcggacattcacaattgcattacctgaatggaatggcagcagtcttcttagtcccaatccctgcgcattcaagaacaagcccatctag

SEQ ID NO: 29019 - DNA, 675 bp, Glycine max
  Peptide Sequence Number=SeqID_120704
atgggtgaagcagaggaggtgcaagagaagatgaaggccgacatggaggccatgaaagagcaaatggccacaatgatagaggccatgatgagcatgaagaagataatggaagccaatgcggttatagttgccgctactagcgctgtcgctaaggtgaacccgatgctcccatctggcctcaagcaaatgaatcatccaacctcaaatatgcacgccttcccgccatatggtttgcctcccaaactatacaccaccaatgtggtgtacattcccaatgaggatgtcaataactccactcccatactcattaagagccaacaacctcaatctgatcatgcacatgtctctcgacccatggaggagacacatgaaattccccaccacgatctagccaacttcgagccttgcctcggatatgctgctgaagggcaagcagttggtggtataccctttgaaaacactttggagggccctcagtttcgcccacaaccacaaccattgcattttgcggtgggaagagcccctcctgctatggccgaaaagggaaaggcggatcatctaaaggaaaggctcagggccattgaaggaggtgaagattgtgcctttgctaacctagaagagttgttcctaatacccaaacatggtcattcccaagttcaaggtgctggaccttga

SEQ ID NO: 29020 - DNA, 321 bp, Glycine max
  Peptide Sequence Number=SeqID_120705
atgcagagttcacaacgcgatgtctatcttggagcctacctaaatgggttccactacaacggacactggcagatggtggtcatcctgcccaaggaacacctagttgtctggttttgttcattgcataacaggccagataactaccttaaggggattattaatagtgctttaaaaggtcttgatgatgctccacagcctaaatcaaaggcttctgctaggtggattgtcgtcaagatgtccaccatcattttaggaacttttaggaataattgggaagcgtattttaacgatcctagaccattggagccaaagagattatag

SEQ ID NO: 29021 - DNA, 582 bp, Glycine max
  Peptide Sequence Number=SeqID_120706
atgggatcaagtcaaaagccttcgcttaaaaagaggttctatcaagtcaaaatcaagagcttagaggtcactagtttacgagagttggggcaattaatgggtcaacttcacggcaagccttccgcaaagcctatggacttccagctagtgccgactgtgaaagagtttgaagaaatctgggatgcccactgggaggaaggaagccatatcttttctttgggttctatccctccacgacaagagttgccaaggccttggcaaatcaaggcgaatgggctttcttttattgacatattggcgcttttgatctttggagttgtcgtctttccgaatatggaagggttagtggacctagcagcgattgacgctttcctcgcctttcatcatggcaaggaaagcccggtcgtcgccattttggccatgtatgacacgcccgtctatccgctacaaggtcaccgctcgtgcgtcgaaaaaggaaaggcgaattgggacaaactcttggctagcatggaggggcgtctgttaattggttccctcgctagaaggaaggaagaatcaggattctatcttcatgcgaaggat

SEQ ID NO: 29022 - DNA, 693 bp, Glycine max
  Peptide Sequence Number=SeqID_120707
atgactactctgacccagatatggatgacgttgctactcagcaacatccagcccagcgaccataattccgacctccccctgccgaagtgtcagttggtgtacgtcatcctgacacggatgagcattcacgtggctcagttgatcgctgatgccatctatctatttgcaggtatggcacctactcggcaccctttggacccagataagtccaacagggccctgggatttcctgcgctgatcacaggactctgccagtcgttcggagtccccgttgcacctagcaaggtgattcggccacccatcacccgggcttttattgagaagtactgcacgcagagacaggtccagggtgatgcaccacaggccgcggacatgccgccacctcatcaggctggcctagatgggccatttgattcagagcagtatttacgacatgtggttcgccagcaggcggccaaccatcgggcgcacgtgcagactcatgactgtctttaccagctgagcctcagcctgcagagccagggttttacttcttttccatgccctactccggatcagttcagggcagaggtcgcttggcccggagattggtcggaggcaccagcagaggctcccgacgaggcagatgaggcccgcgaggacgaggagatgaccgatttgcttgatttcttgggagggagcggagccacatga

SEQ ID NO: 29023 - DNA, 522 bp, Glycine max
  Peptide Sequence Number=SeqID_120708
atgtcggattcgctctcttaccacttctggaacaacggcgtggtgatccgccacaacgaggagttcgagaagattgaaggcaccgaagacggcgtgatcgtgcacctgaagtccggcaagaaggtgaaagcggactgcctgctgtacgccaacggccgtaccggcaacacagattcgctggggttggaaaacgtcggcctggaatcggacagccgcgggctactgaaggtgaacagcatgtaccaaaccgcgctgtcgcacatctatgcggtcggtgacgtgatcggctatccgagcttggcttccgccgcctacgatcagggccgcatcgccgcgcaggcgatcgcttccggcgaagccagcggtcacctaatcgaagatatcccgaccggcatctacaccattccggaaatcagctccgtcggcaaaaccgagcaggaactgacggcgatgaaggtgccgtatgaagtgggccgcgcccagttcaagcatctggcgcgcgcgcagatcgccgggatgaac

SEQ ID NO: 29024 - DNA, 222 bp, Glycine max
  Peptide Sequence Number=SeqID_120709
atgtatgatgggcagttggtcagatctagtatggatcgtacatggacggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 29025 - DNA, 729 bp, Glycine max
  Peptide Sequence Number=SeqID_120710
atgccaggttaccatctgctcggttcatctaatgggtttcactttgggtttagcgaaataccagaagtataccgtgtttgtttttggaacaattcgacaagggtgatatccagagaatcgtcaacgctgtctttttccccgggcattggtcgtagaacaatgtttggttggagaaaccttaaaggttttcctgttctttggactttacctgaagttggtggagtgtatctgagtggaaccattaattgggttgttattaagggaaaagaaaccattcattctgaaatcgtaattatttctgttgacctggagaaggagacttgcagatcactgtttcttccggacgatttttgcttttttgatacaaatattggagtttttagagactcgctgtgtgtttggcaagatagcaacactcatctttgcttgtggcagatgaggaagtttggagatgacaagtcttggattcaattaataaattttagttatttacatcttaatatttgtccttatgaagaaaaatcaatgattttaccattgtgcatgtctaacaatggagacttcttcatgctgaaattcactagaaatgctgatgatgaataccaaacaattctgtataaccagagggattgtaagtctcaagtttctgtcgctccctcaggtagtttcagaactttgttgtggcgcaaccacaagctttttaccaaaagtttggtcataccttattga

SEQ ID NO: 29026 - DNA, 258 bp, Glycine max
  Peptide Sequence Number=SeqID_120711
atgacggtggaaacctctgacacattcagctccctgagacggtcacagcttgtctgtaagcggatgccgggagcagacaagcccatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 29027 - DNA, 372 bp, Glycine max
  Peptide Sequence Number=SeqID_120712
atgatcttgaaggacgagttaaaggcttgccttaggtcgaaaagaaatttgtcccggcagttaagcaagactgaagggaatatgtgggccatcatcgatgagtacaaagagaagctgaacctagcagcgactcacgagcaaaggctagaggatgagtacaccaagatatcagcggaaagggaagcaagggaaagggtaatcaactcattacacagaggggcaatggtgtggatggacagattcgcctttactttgaatggaagtcaagagcttccccgactgctagctaaggccaaagcaatggcggatgtgtactcggcccccgaagaaattcatgggctcctcaactattgccagcacatgattgatcta

SEQ ID NO: 29028 - DNA, 610 bp, Glycine max
  Peptide Sequence Number=SeqID_120713
gcagtttaaatcagacctcacgaggaaatgggcccttgcagtccatcaggacggtgtcgaggacactgtctgtgacaaatatggcatcagcaaggaaaagtgggcccagttttgccagactcgcagaaacccttcttgggagcagaagctcctggctgagaagaccaagaagaagatgcaggaagctgcacagtcaggaagcgttgatggcgtcatcgaccctccatccccgatcagacgccacgtgaagtggaagatggtctgcacgaagaagacaggggagatgacaactaaggccgcaaaggaaatcgctgagaagattgattcatttgaggagcaggccacacagggatcgttcatcccccatggacgtccggatgttctggccgctgctattggacgtccagagcaccctggacgtgtccgtgctgctggagccggtgtcaccattaagcaatactttggatcggctccatggacgtcccgcagcgcttcctccctgcctcctgacgaattacagcagctaacccagcagatcagggaccagctagaggagtccatcacagagaaagtgacgaggcagatcatggcatccttcagccacctttag

SEQ ID NO: 29029 - DNA, 488 bp, Glycine max
  Peptide Sequence Number=SeqID_120714
gaacgggggaagcccgtctgatagcgctctgtgcgcgtactccgaaagggaatcgggttaaattcctgaaccgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 29030 - DNA, 487 bp, Glycine max
  Peptide Sequence Number=SeqID_120715
atgccgagaggaatgagtaaattaaatcatttacaacatctggatttctttgttgtgggcaagcatgaagagaatggaatcaaagaattgggaggactttcaaatcttcgtggtcaacttgaaattaggaacttggagaatgtttcccaaagtgatgaagcgttggaggcaaggataattgataaaaaacacattaatgatttatggttggaatggtctggatgtaacaacaacagtaccaacttccaacttgaaatagatgtgctttgcaagttacagcctcactttaacattgaatcgttgcaaatagaaggctataaaggaaccagatttccagattggatgggaaattcttcctactgcaatatgacacgtctaaccttaagtgattgtgacaactgtagtatgcttccttcacttgggcaactaccttctctcaaggtccttgaaatttcaggattgaataggctgaagactattgatgcag

SEQ ID NO: 29031 - DNA, 168 bp, Glycine max
  Peptide Sequence Number=SeqID_120716
atgggtgcaagggataaatcaatcatgcacaagagtccatggcatgctcattcaaatccagtgcaggagtgcctgatgatgaatcctaaggaaggggcaggtctaacactggtgcagatgactcaggctgagaagaagacatgtccagcactacagtggaaggctctg

SEQ ID NO: 29032 - DNA, 438 bp, Glycine max
  Peptide Sequence Number=SeqID_120717
atggggaagggtgggctggcagatgaaggaagagggggagcatcgacactaaagggtgaggaattttgctacgcccgattggatgaaattgtggatgctgtcgccgtcgacgaggatgacaacctgatggtgcaaagagcccagaagacgaaatgtttgtggcgtaggagtgccttccatggtgttcagacttatttgagggaccaacgaggtggtgactatgagaccacttgtcatcgcagtggtagcacaacccctattcacggcagactgccatctcctccgctggtgaatggtgagtcgaaaaactgcgctggccatgatggcggtccagcatcttatcttcctggagtcgtgcgagatcgatcgcctgaggaagagaaagagggcgcagagcttgaacttcccggtgaagttccaaaatcaacccttggatga

SEQ ID NO: 29033 - DNA, 327 bp, Glycine max
  Peptide Sequence Number=SeqID_120718
atgaccattcgaggccttgggctcaatggcctcgatgacatctattccccacatggagaaaggccaaggggcggacatgacattcagaggatgtggtggggcattgacattatccgagaatgcttgacatttgtggcattatcgctcacatggacacaacaatcaatttccatgggtgaaggtagctcttcgcatctgttggttggtgccgttgtccgtgataatcttccttggcaaaccatatcggcagatgatctctttcttaatgaacctgaccaccacacccctcgtgacattggtataggagcgcctcgacccaattggtaa

SEQ ID NO: 29034 - DNA, 627 bp, Glycine max
  Peptide Sequence Number=SeqID_120719
atggtctctggtaatcgattaccacggggtgtaatcgattaccaagctttgaaaacgaggtcaggaagccatgagggctttctggtaatcgattaccaagggagtgtaatcgattaccaggctttagaaagggggactggaacattgtggagccctctgagggatgggtcactggtaatcgattaccagattgtgatggcggcgcagctaatccgtgatcgagtagagatggagtgcctagaaggagcttgggagaccctcgaaggcaatacgaggtgccgatttcggggcaccattcgattcacggctacttctttggtgcatccagatgaacctacacgaacgcttcagcacacggtggagtggatactacccacgcctacaccatatcgtctagtggagccagtccaagtgatcgaggtgacgtcatccgaggaagaccccgaggaggatctggaggagctacctcttgagcctgccatggatgcccttgactttctagagggtgatgaggatccacttcttgaggtggattctcccgaggaagtcatgtcggcatctgaggtagactctatggaggatagtggcccgggggagatggcgatcagcggaggctcttcaacatag

SEQ ID NO: 29035 - DNA, 330 bp, Glycine max
  Peptide Sequence Number=SeqID_120720
atgggaagaaaccctccgataaagaaacttctggagttcgccacaatcccaatgtcatatagggacctattgctgtcactaatcgccaacctgttggcagtggtgacccctggaatgatttaccagtctcccctcccaaagtggtacaaccccaacgcgacctgcgtgtatcatgggggaaccccggggcattcggtagcaatgcatggccctcaagcacaaggtccagagcttaatcaaggcgggatggttgacattccaagaagacgggccaaatgtaaagacaaacccgctcaccaaccatggaggatcggatgtaaatgcaattga

SEQ ID NO: 29036 - DNA, 324 bp, Glycine max
  Peptide Sequence Number=SeqID_120721
atgccaagtttctacaaagaaaagaccaagaagttccatgatagcatgataattaagaaggacttcatggttgggcaaaaagtgttattgtataattctaagcttggactcatgagtgttgagatcaaaagcgactccacaaaaaagagcttcaaggtcaatggacaccaacttaagccattcctcacaaacccttctttagttggacgtagtggtggaagagacttccttactccaccctactcttccttctaccatgacttacggagtttttctttcctatctccttctttacttttattacatttgtctgattctatttga

SEQ ID NO: 29037 - DNA, 762 bp, Glycine max
  Peptide Sequence Number=SeqID_120722
atgacgaccctgcagatcgcgttcttctcattcctcgtgatcgccggcgtcgggcccatcctgtggctggcgaaggccgcgctctccacgacgcaggacacgatcagcgaaccgttcgcctggttcccgagcggcgtgcagtggggaaacctcgccgccgcgtgggagcagatccaggtcggccgctaccttgcgaacaccgccgtcatggcgctcggctcgaccgtggcgaccgtgctggtcaccgcgtccctcgcctacgtcatcagcatcctccgtccgcgatgggcgccgatcctctccggcgcgatcctcgtgacgctgttcgtccccggtgtgatctcgctggtgccgctgtacctcaccgtcgtcgaccttccgatcgtcggcggctccatcgtcgacacctattgggcggtgtggctgcccgccgcagcgaacgcgttcgccgtgctcgtcgtcacgcgcttcttcgacgagatccctcgcgagatcatcgaggccgcgcgcgtcgacggcgtcggcccgttccggatgttcttcgcgatcgtgctgccgttctcgaagtcgatcctcggcgtgatcgccgtgctcacgatcctgaactcctggaaggacttcctctggccgatgctcgtgctgcccagcagcgagctgcagccgatctccgtcgcgctcgcccggatcgccgggaagaccgacctcagtctgcagatgtccgcgatgctgctcggactgctaatcccgatcgccgtcttcctc

SEQ ID NO: 29038 - DNA, 210 bp, Glycine max
  Peptide Sequence Number=SeqID_120723
atggataagagcttgaaggaaggagaaaatgagtggagggagagggagaaaaggagcacgaaattttgtgcctcaaataagccatggcctgaaatctaccctaaggctcatagaaccctaggacctctcttgcatctctggcataatcttcttggagtcttctattcaattcccttgcggggtaggattgcatcattccctcccccttga

SEQ ID NO: 29039 - DNA, 258 bp, Glycine max
  Peptide Sequence Number=SeqID_120724
atgggggagggatgctgtacgcagccttacccttgcatatgcaaagaggctgtttccggattcgaacccatgaccaacaagtcaccaaggcacaactttaccgctgcaccagggcttgccctcaaaaaaaattgtttccgtgaagaaaatccaagccgaggtgtttccgtaatgctttcgagacgtttccgtgatcaaatccgtgaaggttttccgtcgttcttcactgttcttcatccgttcttcgttcttcaacgg

SEQ ID NO: 29040 - DNA, 930 bp, Glycine max
  Peptide Sequence Number=SeqID_120725
atggccaagtttgatccagaaatagtccttgaattttatgccaatgcttggccgacagaggagggcgtgcatgacatgagatcctgggtaaggggtcagtggatcccgtttgatgccgacgctatcggccaactcctaggatatccgttggtgttggaagagggccaggaatgtgagtatggccagaggaggaaccggtttgatgggtttgatgaggaggccatcgcccagctgctatgtataccggggcaggattttgcccggactgctgcagggaggcgagtgcgaatcatgcgcaccaacatgaccaccctgacccagatatggatgacgttgctcctcagcaacatcctgcccaccgatcataattccgaccttcccatgccgaagtgtcagctggtgtacgccatcctgacacggatgagcatccatgtggctcagttgatcgctgatgccatctatatttttgcagatatggcgcccactaggcaccctttggacccagataagtccaacagggccctgggattccccgcactgatcacaggactctgccagtcgttcggagtcccccgttgcacctaccaaggcgcgcccccaccacctcatcaggttggccaggctggggcatttgacatggagcagtatttacggcatttggttcgccagcaggcggccaaccaccgagcacatgtacggacccatgattgtctgtaccagatgagccttagcatgcagagccagggcttcgcttctttttcatgccctactccagaccagttcagggcagaggttgcatggcccggagattggcccgaggcccaagcaggagaggcacccccagaagctcccggcgatggagaagaagcccacgaggatgaggagatggccgatttgcttgacttcttgggagggagtggagatacgtga

SEQ ID NO: 29041 - DNA, 237 bp, Glycine max
  Peptide Sequence Number=SeqID_120726
atggcagcggaatggagaaggaagagagagaggagacgccacttcaaggagaagatgagtctagaagaagcttatgaccataggaggccatggataagagcttggaggaagaaggagatgaatgaagggagaggaagagaagagcacaaaattttgtgctctaagagagctttgaaatctgaacccactaatccaagatcaattccaagattctccactaattgtgcttgggtgtaa

SEQ ID NO: 29042 - DNA, 1002 bp, Glycine max
  Peptide Sequence Number=SeqID_120727
atgggttctgtcttgatccctattgtaaacaaaccaacggagggtccgtgtcgccttcttaaaaacgtgctttggggcatttcgctacccctagacgtcgtatctaaggaggggacaaattccccggacccccgcattcctagattgcatctgtgtcatatgcattccatcatgcattcatccatcccacccatgagatatcggagttttgatttgcaccagcttttgtctcactttagtaagcatgggaacaaatcaaaccggcaagaggttctaccaagtcaaggtcaaaagcctagataccaccagcatcaaggaattagggcggttgatggaacccctcaaaatgcaagccttccgcaagacttacggaaagatcttagagttgaccatagcagaggtgtccatagaagccattgcatcacttacccatactacgaccagcctttgaggtgcttcacattcggagacttccaattagtaccaaccattgaagaatttgaggaaattctaggatgtcctctcgggggaagaaaaccatatctttcctccgggtgtctcccctctttgagcagaattgcaactgtggtcaaggattcagcaagaggtttggaccgcataaaacaaactcggaacggcatagcgggcctaccacagaggtacctagaagacaaggtgaggggtatggccaatcaaggagactgggtcccgtttatggatgtgttagctttgctaatttttggggtcgtcctctttccaaacgtggatggtttggtggacctagcagtaatcgacgctttccttgcctaccaccatagcaaggaaagtccggtggtagctgtcttggcagatctatttgacacatttgagcgaaggtgcgaaaacccgcagcgcgcggatcatctgttgcttacccgccctctgtgtttggttggtttcgcacttattccaacaagacacaagacatccatgtccgctcctgagccatcgctcgtgtactga

SEQ ID NO: 29043 - DNA, 780 bp, Glycine max
  Peptide Sequence Number=SeqID_120728
atggctacaagcgacatgctatttttgagagatagagctcacattcctaccaaaaagagtttattagagttagcctcccaagatgcattgttggcacaaaacaatgcttctgtacatacttcatatgcttctattttgcaggttgcaggatgtaccatttgtgggggagctcatgaatctggattttgtattcctattgaagaacacctcactcgtgaagtcgattacatgggaaatcagcccataaacaattttaatgcaggaggattttctggattccaacatggccaacaatataatcagcagcaaggacaatggaggaaccaccctggaaatcagttcaatagagatcaaggtggaccatccataaggccacagcaacaaggacctagtctctatgatcgcacaacgaagctggaaaagactctaactcagcttatgcaggtttctatgtccaatcagaagagcatagagtccgccataaagaatcttgaggtccaagtggaacaacttgcaaagcaattggcggatagatcatcaagtagttttacaactaatacagagaaaaatcctaaggaagaatgtaaagctgtgatgactagaagtagaatggcaatccaaggagatgatagtgatgctggaaagaagatgaaggaacataaacaacagttggcacctaagccagcacttgaacttgattctgattttgtagaacttgaagagattaatgaggagactgaagatgataaggaagaagagacaccaatggggatcctctag

SEQ ID NO: 29044 - DNA, 174 bp, Glycine max
  Peptide Sequence Number=SeqID_120729
atggggatacaaaagaattctcaggcggaagaagggagacacaaaagaattcaggcggttatcctatcgttctttgaaaatgggagaagagagacaaaagaattcaggcggttatcttcttgggaattctttcttggcaaagggaaaggagggaatggaaagaagatgagatag

SEQ ID NO: 29045 - DNA, 105 bp, Glycine max
  Peptide Sequence Number=SeqID_120730
atggaagtgtttcactcaaaacttggtgaggctttggttgcttcaaatccaatggtgctcctaggatggttaacctccaagactaaaaaatcttccttcaagtaa

SEQ ID NO: 29046 - DNA, 331 bp, Glycine max
  Peptide Sequence Number=SeqID_120731
atggacaccccaagaaatccagctgactcctccacatgtctatcctccaaagaagaggagtcagaatatggctcaaaggtttctggtatcatctgcacttacagaggcatgaaagaaaatgaaagcaagtcaagatgtccagaagcttcaacatcagaccacttccagggtgctgaagaactacttcacatggatttgatggggccttgcaggttgaaagccttggaggaaagagcactggagccacgatgtcacaacatcagtctcgacatcatggaacgcagcagaaaaggagcaaaagaaagaagtggaggtgtcactactgtggcaa

SEQ ID NO: 29047 - DNA, 634 bp, Glycine max
  Peptide Sequence Number=SeqID_120732
ccggagggaaggtgaggatgacgtcaagtcatcatgccccttatgccctgggcgacacacgtgctacaatggacgggacaaaggatcgcgatcccgcgagggctgcaactcgcctgcatgaagccggaatcgctagtaatcgccggtcagccatacggcgtcgtaacaaggtagccgtactggaaggtgcggctggatcacctccttttcagggagagctaatgcttgttgggaaagagagggatggggtttctcttgcttttggcatagcgggcccggcgggaggcccgcacgacgggctattagctcagtgggctctcagccacatggatagtttaatgtgctcatcggcgcctgaccctgagatgtggatcatccaaggcacattagcatggcgtacttctcctgtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctggg

SEQ ID NO: 29048 - DNA, 108 bp, Glycine max
  Peptide Sequence Number=SeqID_120733
atgtttgtattcaacagtgctttgaaaggacttgatgatactccacaaagtaaatccaaggctgctgctaggtggattgttgttaaaacactacaacaaatctgttaa

SEQ ID NO: 29049 - DNA, 330 bp, Glycine max
  Peptide Sequence Number=SeqID_120734
atggtatggggggacattttggctaaatttgatatcccagaagctgaaaatgccaagaaaaaagaaattcggaaaaaggcaaaggagagtaaaaaatacaatgactgcccccacgtactatctcgtgggggttatgacttgcttgagaaaaaattgttagatgagaaaacaaagcaaagtcaacagcagacacttttgactgagaatccattgtttgatctggaggagccgccatctcccattaaaaggcacgtgaagtggaaaatggctagaaccaaacgatatggccagatgacatcaaaggcagcaaaagaaattttggatagaatt

SEQ ID NO: 29050 - DNA, 588 bp, Glycine max
  Peptide Sequence Number=SeqID_120735
atggctacccgtaaactttatatgaagtttttggaacaatatgtgtatattgatgcggaagaccaggcggcgcttgctgaaatgaggttcgtatgtaatagaatcggcgaatctggtggttttaccgatcaagagaaagcatttttcgacaatattccattgcaacgacaaagtttcattcaatcatgttgtcatctagctagtcaagaattcgaatctacagtattaccggtagtcaattttagtattactggacgaggtaaacaagtggttatggtggaaaaggaagagtttaagattgaaaaagctggacaaaaaagtaccacgtctagttttgaaaatactgggaacgagttagtcagagaacaacttccattgatcttgtcgtgggcgatgtcgatccacaaagctcaaggtcaaactttggacagagtcaaaatagatttaggtagaagttttgctaatggtcaagcatatgttgcattatcaagagctacatgcaagagtcggttagaaatcaaaaatttcaggaaagataaagtaaaaacatctgaacatgtcagaaaatactacgaaagtttgggataa

SEQ ID NO: 29051 - DNA, 255 bp, Glycine max
  Peptide Sequence Number=SeqID_120736
atgttggataaacaggcaattgtgtctccagcaaaacctatagatgggccggatcctcaggttatgtgggatgctaccgtgttcggggtgtttaatgaacacttcccgttgtacataaagcacgaagatctatctgaaattgcacacggagatcaatgtctcaacatatctgttatacagttgtggattctgcatctgactgagacaagtatgcgatcggggaattccgatgtgtatggattcctcgagccatag

SEQ ID NO: 29052 - DNA, 906 bp, Glycine max
  Peptide Sequence Number=SeqID_120737
atgattgagttgcgaaaacttctggataggtatcctacatctgaactgaattctttctggttaaagaatctctttctagttgctctggaacaattaggagattctctagaagaaatacggagttttgcttttggtggcaacatgctatggggtggtggtcccacttatggggtcaaatcaatacgttctaagaagaaatatttgaatctcatcgatctcataagtattataccaaatcccatcaatcgaatcgctttttcgagaaatacgagacatctaagtcatccaagttctataggaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgtgaatgagtcgaattacttatccctcggtcttttagtgaactatctctccagggattgtgaaagatgttctactagaaatattcttgttattgcttcgactcatattccccaaaaagtagatccggctctaatagctccgaataaattaaatacatgcattaagatacgaaggcttcttatttcacaacaacgaaaacactttttcactctttcatatactaggggatttcacttggaaaagaaaatgtcccatactaatggattcgggtccacaacgatgggttcaaat

SEQ ID NO: 29053 - DNA, 407 bp, Glycine max
  Peptide Sequence Number=SeqID_120738
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtttgaaatctggacagatgttgcttctgctgatttcctagagaagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 29054 - DNA, 606 bp, Glycine max
  Peptide Sequence Number=SeqID_120739
atggggacaaatcaaaacggaaaaaggttttatcaagtcaaggttaaaagtctagatgtcactagcctcaaggaattgggacgattgatgggatccctccaaaggcaagccttccgcaaagtctacgggaagattctagatttgaccacagcggaagtatttacggaagctgtcgtatccctcgcccaatactatgaccagccgttgaggtgtttcacatttggggacttccaaatggtgccaactattgaagagtttgaggagatattaggatgccctcttggggggagaaaaccgtatcttttctccggctttcttccttccatgagcaagattgcagctgtggttggagattcggcaaaagagttggatcgcatgaagcaaactcggaatggcatagtgggcctgcctcggaaatacttggaaggcaagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 29055 - DNA, 219 bp, Glycine max
  Peptide Sequence Number=SeqID_120740
atgcgcggagtcgccaccaatgtttatttgtggaaaacgtcggaaaaaccgaaggaaaccggtcaaagtgaaaattctaagttcgggagttgtatttacgctttgaggaaggtcgacaaaagcagggcttttgctcctacgtaccctcatttggagaagaaatcagacctacgtagttctttcttatgcgtgaatcaagtgattgatttttttacttga

SEQ ID NO: 29056 - DNA, 459 bp, Glycine max
  Peptide Sequence Number=SeqID_120741
atgaattgcgttttcgttcatgcgtcctccaccttcgagtttggagccatgcgtagtgattgcttagtggaattctccattctcaaccctttttgggagcccatgaattgcgttttcgttcatgcgtcctccattttcgagtttggagccatgcgtagtgattgcttagtgcaattatccattctcaatctttttcggagccccatgaattgcgttttcgttcaagcgtcctccacccacgagtttggagccatgcgtagtgattgcttactgcaattctccattctcaaccctttttcggagcccattgtcgcaacctacccttcggcgggagggcgacgcgagactcgcgggatgcgtgttccacgaaaggaatacgtgcggagtcgccaccaacgtttatttgaggaaaacgtcggaaaaaccaggaaaagacgcgatctacgaacttttaagtga

SEQ ID NO: 29057 - DNA, 777 bp, Glycine max
  Peptide Sequence Number=SeqID_120742
ggtacatcctttgtggtacaagtagagggtacatctacttgggttattgtgactgagaacaagagagggtacatctcttgtggatcagttctagtggagggtacatccactaggttgttcaaagagaacaagggagggtacatcccttatggatctttgcttgtaaaggaatttacaaggttgaaaagaaatctcaaggaccgcaggccacttgatccaacaaaaaggaagtctacttcaaaatcttatggctctcactcgtatccaaagaaagaccaagttcaagacatcttaggggcgacaacttctaatcccaaagatgataaggggaatacaatagaaaaacaacctcttaaggctagtatgcaggagaagactagctctataaagtgctttaaatgtcttggaagaggacacattacttctcaatgccccaccaagaaaaccatgattatgaggggccaagacatttatagtagccggggtgaggctactacttcaccttcctctagtgaaagtgaagaagcaaaagggaaagaatctagtgaagaaacctacccccaagaagaaggacaacctttaatggttaaggagaagtgtaaggaggtaagtgtctcctccaagaggttatctaagaaggaaagtcattttgcaataaagacaaaaattaaagaaatttccccttttagacaacctccacatcttctcctttataaaaagacacttgttagcactgccacacctcttgggcttgaggttattcctcaagtaaaatag

SEQ ID NO: 29058 - DNA, 423 bp, Glycine max
  Peptide Sequence Number=SeqID_120743
atggtgtcaccacaagggaggaacacatggacagttgatgatctcgtgccttatatggagaagataacgattttatctgaagagcaagagagaatcattgagcctgtggcacatggtccagcatcagagcgtcgatttccaccacaagagtttcacatgtttcagtcaagtgttgaaactcggggttttggtagacataggcaggctgttgaagcggaagaattttcccaacaaatggaggagcgtggccatggaatgtattacacgccaccaacattttctcagtatccttcacagatgtaccagtatcctttcgaaggtcatgacactgatatgtctgcaagcgaacattcgtttggtggtgttgcggaaacacatcctcattatttcatggccgactatgaccccttcacagcaacatga

SEQ ID NO: 29059 - DNA, 873 bp, Glycine max
  Peptide Sequence Number=SeqID_120744
atggttgcttcttttctttatcaccaagagaaaatgaatgttcttgtggaacctgatgtgcatgacatatttgctagaattccaggctttggatttgttcagaccttctatagtcaagataccagtgatctacatgagaaagtcgattttgtggcatgcttgggtggagatggcgttatactgcatgcgtcaaatctattcagagatgctgttccccctattgtgtcatttaaccttggctcccttggttttctgacttctcatgattttgaagattacaagcaagacctacgacaagtcatccatggaaataatacacgagatggtgtgtatattactcttagaatgcgcctccgatgtgaaatttttcgtaaaggtaaagcaatgccagggaaagtatttgacatcctcaatgaggttgttgttgatcggggttctaatccatacctttcaaagattgaatgctatgaacatgatcgacttataaccaaagtacaaggtgatggagtcattgtggccacccctacaggaagtactgcctattctacagctgccggaggttccatggtccatcctaatgtcccttgcatactgtttaccccaatctgtccacattcactctcatttaggccagttatacttccagattctgctcaactagaattaaagattccggaagatgctagaagtaatgcctgggtttcatttgatgggaagagaaggcagcaactctcgagaggcgattctgtccgaatatcgatgagccagcatccccttccaactgttaacaagtttgaccaaacgggtgattggttcagtagcttgattcgctgcctaaattggaatgagaggcttgatcaaaaggctctgtga

SEQ ID NO: 29060 - DNA, 2340 bp, Glycine max
  Peptide Sequence Number=SeqID_120745
atggagattgaagaacagggtgcacctcagacaaaccgtttcagtgctgtaatagagaagattgaacgcctttacatgggtaaggacagcagtgatgaggaggatgcacttgatgttcctgatgatcaatatgatacagacgactctttcattgatgatgctgaattggatgagtattttgaggttgataattcttcaatcaaacatgatggattctttgtaaatagggggaaattggaacgcatggctagccttggtgcaacactaaggctgctgccttgtggccttgaggtcaccagtttgagtcctggaaatagcctctttacttctggggccaagtctgtgtacatcttccctcctcaaatcccattaggttggaacctcatgcactggcaagcaaagaaaaggcgccgaaaagatgtaccgaagaatcctggagaacatattgatagtcatgtatcaaataaacatgtaaaagtgggcaagactgctgctggaaagactgcatcgttacctgtgaaaaatacgattagttcctcccataatttgggtgtacctggtgaacattatgaagacatgacatttcagaatcaattggatgtgtctggaattagtttgaaaaggaaaactgctgacacaagaccaatgttggatcctcctgtttgttcgaaagtatcaactaatgctcctgctgctgcagaagatgctgaaaaacagaagactagagtacttcaatctaagaacacaagtgataaatataaagatgcaagtggcttgcttgatacttctcgtcagaagtaccatgaaaaaagtgcatctgcaaaatccaaatcccagcctggaaaaatctcaattagtgttgacaatctagaaaaggctggtcggtcaaaagataaaaatgacatccatgaactgccagatcttaacttgtatgtcggaaaatctgctatacaagcaccaaaatctgaaaatgtgctcaagaaagatggttctagtgctaggcctaaaactacaacacttgagaaagctattcgagagttggagaagatagttgcagaatcaaggccgccaactatggaaaaccaggaggttgataccacacctcagggtgtcaaacggagattgcctagagaaataaagctgaaacttgctaaagttgccagattagcggcaagccaagggaaagtatcaaaggagttacttaaccgtcttatgagtattcttgggcatctgattcagctcagaacgctaaagcctggaggctctggcacaggtccgagatggactcaaccagggcggtgcagcagcgctgctggaagacttggcatagttagtgcggttgaagcggtagacggggaggaaggagagggctcgttgttggtggcagtggggcagttgttgcagaaccagactagggaggcgcaacggcaatggagagtccgtgtcacggttgtgggggaactgatggggagagagaggagagtgaggctactgcaagtggaggttttgcggtggaaagtggcgagggagaaagatgttaggtttcaactgataaagaaggaagttattgagatgattaagatgcaggccccaaccatagaatccaagctacagcagcaagctgcagcatctggggaacaagaattaggtcctgatgggaaaccaataactaaaaagaattttagtatggacactgcattggaagacaagatttgtgatctctatgacctctttgttgatgggttagatgaaaattcgggtccgcaaatcagaaagttgtatgctgagcttgcagagttatggccaaatggttacatggacaaccatgggatcaagcgtgcaatttgcaggtcaaaagagaggcgcagagcactgtacagcagacataaggagaaaatcaagaggaaaaagttgttggcacctcgaccagaggagaatgttcaagttgatcctagtccaattactttgcaacagcccttgcgagaaagattagctacagactctagtggtcatcctcatgcttcagtaaacaagacagtttctaatacagtcaccaccgcacgggttcacaatcctgtcaatggtccaaaacaagaaaaagcaaagggaagttcaggtggttctctggatgatgtcaagggtgctgatggtgttttaataaagaagaaggtaaagagaaagctagaacagggtttggaaggaactcactttcgccctgagaagataggagcttctctgcaaggagaagaaaaaacaagatccctaaagcagtctgcaggtgttcccccgaaatcaaaccttcagccaacttctctacctggtcttgagcagtcaagctaa

SEQ ID NO: 29061 - DNA, 1701 bp, Glycine max
  Peptide Sequence Number=SeqID_120746
atggtgaaggaaacagagtactacgatatcctcggagtctctccctctgcctccgatgaccaaattcgcaaggcctattaccacaaggcaatgcaagttcatcccgataaaaacccgaacgatcctcacgctgccgaaaagtttcagattttgggtgaagcgtaccaaattttgagtgttccggtgcagaggaatgcgtataatcaaaatgggaagcattctgtatctagggaaactatgcttgaccccatggctgtcttcgccctgctctttgggagtgaattgtttgaggactacatagggcatctagctgtggcatcaatggcttcctctgagctagctgatgaaactgaggatcctgataaactcaatgagaagctaaaggcaagaatgttctacattcacttttcagctgtccaaaaagaaagagaagaaaagctagcaagaattttgagggattatcttggccaatatgtccggggtaacaaaaaaggattcttccaacgcgcagaatctgaaacaaggcggctttctcgtgctgcatttggagttgatatgttacataccatcggctacatatattcaagacaggcagcacaagaactaggtaaaaaagccatttatcttggagtgccatttctggctgaatgggtacgaaacaaagggcatttctggaaatcacaattcacagctgctaaaggtgcttatcagttacttcagctccaagacgacatgcgcaagcaatttaaaatggatggtagtagtgtgcctgaaaatgatgttgactctcacattcgccttaacaaggatacattgatgaattccttgtggaagttaaatgtagtggacatagaagtaaccctcgtacacgtgtgtcaaatggttattgtattcattgtcgcttatccagataccatgaagctcttggtgctaagggaaaataacgttaagaaggaggaacttagacttcgggctactgctcttaaaattcttgggaagatatttcaggacaagtatccaaaaggagaaacattgaagaagaagattgctgctgattctgatgatgaagaaagcagttctgaatcttcagatgatgaatcctctagagcaatttcctaccgaactcccttttttacgcagcaacatgcggctcagcatgaccagattcccgaagtctttcagaatctcgccgcaaagctgattattgttgaggttaaggtgtttcaggcgttgtcagtgaggttcaggactgtcagacatgagaatttgctgacatctgcggggatctcaccggagagcttgttgccgatgaggtccaggatgcgatgggagggaagcgcggtgatgcaggcggggatctccttggcaatgtctttccaatcagcgacaacgagggtggtgagggtgtcgatgccacagatcgctggtgagagttttccggtcacactccccgcggaggttgatgtcggtgacgcggccggtggtggtgtcgcagctgatgtcgtaccaattgaggcagcaattggagcctgtccacgagttgaagaggccaagaccactggtggccgccgtgagccgccgttgcttgccgttggacccccactccaagaggaacactttagtcggagcggaatcctcagaatcctcctcgaagattcgatggagaaaacccctcaatcctctatttcaaagtttctatga

SEQ ID NO: 29062 - DNA, 870 bp, Glycine max
  Peptide Sequence Number=SeqID_120747
atgtggagacagagagctttattggtgttcctgttattactagtccaccaaatttgtgctaccagtgagcaagagcatgcttgccccccttcttcctgtggcaaaatcacccacataacttatccatttcgattaaaaagcgacccaaaaggttgcggcaacaggtatgagctagcttgtgaaaacaatgttacggtgttatatttgtactctggaaaatatcatgtgcaggctatcaactacaacaatttcacaatccgagtggtggatccgggtgttcaacagccaaattgctcctcccttcctcgctacttcttgtctccaaccaatttcagtgatgtttatagtttcttcgataatgaggtggatccatacctagcctttcaaaatcgagattattcttgggagcacgttttccagcatatagttttcttaaattgtaggcacgcagtgattgacaatgagaagtatgtggaaactgatccttgcatcaagtggcactccaaagggtacatatacgctattgctggtgacttaatagcaaaggactttgaagttggttgtgaggtaaagctggttgctcccacatcatggtggggtttggatacaaataattcttcatacactcagatgcacagagcgcttctctatggatttgagctttcatggatgaatctcgcctgtgaccatcattgtggatattccacctgcgcacttgacacttccagtcagatgcttcaatgctcccgtggcaatttcctgggaagggagtaccctcctaagtaccctcctgagtaccccactgaacgagggaaattgtccaagctgctatcatatgcagaaggtaaggattttataaccttaaattga

SEQ ID NO: 29063 - DNA, 414 bp, Glycine max
  Peptide Sequence Number=SeqID_120748
atgacccgtagattacttgccagatcattagcatttgaatgtcgcatcatgcattatctgattgtgtgtatgcttcttcctcggtcatctaaccttgctcaggtttctaaggaagacttggttgtcatataccgcaaagagcgtgatggctcttgggtgaagaaggacgttcctgcacatgcagtagatgaccgctctccatcaccacctcctcagagggatgactcttcatcccttatgaaaagcgttctcgatagactggatggactacacacgtatgtcggtgagcgttttgactccctggaaagccgcattgatacacgatttgcagacatggatactcgtattgatcggcttgaggaggatgtgagtttcatccgtcagtgcttcgaccttccaccaccgccttcatag

SEQ ID NO: 29064 - DNA, 306 bp, Glycine max
  Peptide Sequence Number=SeqID_120749
atggccaaaccaaactccaaccctaaccattctaatggtgacatgaactattctagaccctacacgactcacactcccctgaccgcgtcatcctcgtcagcgccgaggtctccatggcgtatggtgcgctactcaaggtcttcgatcaggttctcaatgttgccaccgagatcgttggcactgaagttggcgactaagtggagaaggtcatggagaagaacagggtggacaccgaatatgtccaaaagttctatcatcagcctgatccaagtatttgtctttgacattacctatggtgatggataa

SEQ ID NO: 29065 - DNA, 216 bp, Glycine max
  Peptide Sequence Number=SeqID_120750
atgtccctagtggagtcaccaattgtcgcaacctacctttcgacaggagggcgaggtgcgatgaggaattcaaacctacgtagtgtggaagcaatgccttccaagattattttgatgatgccaaagaatcaagagtcaaacaagtttcaagaatcaagattcaagaataatcaagactcaagattcaagaatcaagagaagactcaatcaagataa

SEQ ID NO: 29066 - DNA, 417 bp, Glycine max
  Peptide Sequence Number=SeqID_120751
atgtgtcccttgacacagcatctctccgcattcctttctcactcttcactattgattacgatctctccacctcgacgaccagtttcacttcgtgctcgcattcgccttctagggatcactcctcgcattctctcattctcagtctcgcattcttttcagactcttgcatacaaaatcgcatccattcaaggttgttcttgcactgagtgtcatgaagcttcaagattgggaacaacttggaaggaagttaaagaggaagttgcaagtcattacctaggtcagggtggtatcggtctggtttcaacttatgttgcttattctcctaagattgcaagtagatacttggattcttcatgcaactattggcttaattatagcacggttgttctttcactttgcaagagaatggtaaaatga

SEQ ID NO: 29067 - DNA, 816 bp, Glycine max
  Peptide Sequence Number=SeqID_120752
atgtggagacagagcgctttattggtgttcctgttattactagtccaccaaatttgtgcaaccaatgagcaagagcatgcttgccccccttcttcctgtggcaaaatcaccaacataacttatccatttcgattaagaggcgacccaaaaggttgcggtgacaacaggtatgagctagcttgtgaaaacaatgttacggtgttatattcgtactctggaaaatatcatgtgcaggctatcaactacaacaatttcacaatccgtgtggtggatccgggtgttcaacagccaaattgctcctcccttcctcgctacttcttgtctccaaccaatttcagtgatagtgataatttttacttggatcgataccaaattcaaaatcgatgttatccttggaagcgcgctttccagaagcatataattttcttaaattgtaggcatgcagtgattgacaatgagaagtatgtggaaactgatccttgcatcaagtggcactccaaagggtacatatacgctattgctggtgacttaatagcaaaggactttgaagttggttgtgaggtaaagctggttgctcccacatcatggtggggtttggatacaaataattcttcatacactcagatgcacagagcgcttctctatggatttgagctttcatggatcaatctcgcctgtgtcgatcagtgtggaaatcccgactgcgcatttgacgcttacagtcagaagcttcaatgctccatgtacttctgccgcaatttcctggggggacggcggtactttattgaaggtgctaaaggttgtaaaaattgttaa

SEQ ID NO: 29068 - DNA, 154 bp, Glycine max
  Peptide Sequence Number=SeqID_120753
atggaaattcaggtagagcaagagatagagagaaagataccccaagtgcagttagcaattaaagctatgaccatctgctaccacttggggaaatccattagaatcacttacgcatgtccacacaaatgcactctcttcagaatctgcatggaag

SEQ ID NO: 29069 - DNA, 234 bp, Glycine max
  Peptide Sequence Number=SeqID_120754
atgtcgatgacactatgcaaaaaatacggcattagcaaggagaaatgggcccaattttgtcagagccacagagacccctcgtgggaggatgtgcggaaaaaggcacaggccatccagaagcaaaacactgccccccacgtgttgtctcgcggggatttgttggaggagcaggcgtcacatggttcctttgtcccccatggacgtcaggatgtcctgactgctgccattgggtga

SEQ ID NO: 29070 - DNA, 693 bp, Glycine max
  Peptide Sequence Number=SeqID_120755
atgcagtcccagtttcagtcacagatgcaatcacagggacctgcactgcctccagagcctgagtttggtccgtcagctgctcgtgtcagcacaaaggggagttgtgttgatccctcagggaacgatctagacacaggtgacttagacaaatgcgggttgtacatcgaagaaaatcctccccacctggttgccctaggaagagtttttgagagatccacaaccgttcacaacatctctttgttgcatgatcaagtaaaggtcagtgttgaggaggttaaagatgcagatgctctcattcctgtacccactgacgaggttattttagtggggcagacacttaacaccttccttgcttggccgacacatctcgtcaagcatttatcagacaagggagctgtgggaccagcaaaacctgcagataggccaaatcataaggttgatgatcccctatatctgatgacattgaccatcccacaactttttttgaagccattgcagattatgtgggatgctaccgtgttcggggtgtttaatgaagacttccccttgtacataaagcatgaagatctgtctgaaataacacacggtggtcaatgtctcaacatctatgttatacagttatggattctgcatctgactgagacaagtatgcgagcggagaatttcgatgtgtatggattcctcgagccatag

SEQ ID NO: 29071 - DNA, 792 bp, Glycine max
  Peptide Sequence Number=SeqID_120756
atgcagttatatcatcatccgttggatttggacagccagagggtgagatttgcattggaggaggagggtgtagattatacatcccaccatgtcaatccgataactggcaagaacttggattcctctttcttcaagatgaatcgccatggaagggttccggttttccaaaatggctctcacatcatttacaatactattgatataatccagtacatagaaagaattgctgtggtttcctcaggggttgagagtatcagtgccagtagcagggaagtggttgaatggatgcagaagatacatgactgggaccccaagtttttcacactttcacacatacctgagaaataccgcctttatgtttccaagttcataaggcaagtggcgattgctcgcatgtcagagtcgcccgaattagcaagtgattaccataggaagttgaaagaagcctatgagactgaagagaaattgaaagaagcagatgttttgagaaggagcaaggagcatttggttatactgcttgatgaggtggagaggcagctgagtgaaacaccttatttggcaggtcaagagtttaccatggcagatgtgatgctcattccagtattagttcgtttgaaactcttggatttagagaatgagtacataactggaaggccaaacattgctgagtactggattttggttcagcaaaggcctagttacaaaaaggtgattggaatggtgatgctaggtgctggtaaaagaagggatgcttgtcaaaatggccagtctgcaaaagatcttttggcttag

SEQ ID NO: 29072 - DNA, 186 bp, Glycine max
  Peptide Sequence Number=SeqID_120757
atggggtgtttgaatacttcagattgggtttcaaatggatttgagggaaggtattttgtcaaggaggttggcgaaacatggtcgggacgcgacacgtggtggactcgccaatcaagttccgccaggttgactggcgacacagctggcacacgtggcagcgcaggcagtgcatttcgtcaatcttaa

SEQ ID NO: 29073 - DNA, 6147 bp, Glycine max
  Peptide Sequence Number=SeqID_120758
atggatcaacaccacttcctccaccaccaccactatcaccacccccaagaacaccgcaatcgatacacctccctcacacctcaatcccacctccacagtcaccaccacaataatcttcctccaccaccgccaaatccttctccgcctctttcctaccaccgcacaccgcaaccctacacccctcctacaccccaaccccaacatcaacaacaacaattcccttatacacccctcccagaccgccctctcgaagaagaaccccaacctcaacgtcatatcccatacgatcttctccctcgccgcaccaccaccctcccctggaaccctaaccctaaccctaaccctagaattcctgatgatttcgaccgcgattatcaccacaaacaccaccgccctctcccgccgcccccgctcccgatcgaatcccaccgctacgaccccgaccggcaccaccaccccgtggatccatatgagcagaaccctagggagcccctcgcgtggggcggcggtggctaccacgcgccgggccagggcgatgtggaccccacgtcctacgtccgtgtgtacaccgtggagtccgacgccgacgtggcggggagaacaacctccaagagatgggtaatgagtgatagggatagaggaagagagatgcacgagtcttcttctggtttagtgagtagtaatggtaacagtgagaagtattatcatggttctgagaataatatgatgggtaggtatagtagagggaatagtagagagtgtggtcatactcacgaatttgaacgcactcctccgaagaaacaggtacagaagaagagtgctcttcttaggattcagacggttaaacctaataataatcataggaaccgcgagaatcgcgaggttgagcagttgcggtacccgggttatggttctgagaatggaaatggtttttacagggggaaggagcagtattttggtcatggggtgaagggggaagagagagaggagagccctgttgagattgatatttcttttgagtccaattcgttggttgcgaaggcgaaggcggttgtggcgccgctgccaccaccttcgagttcagtgtcggttcctgatttgaatgtgatgccggtttcggattcggatttggtttacggggagaggagtaaaagggtttcaggctctgaaggagattattctggtatgcaattgccgcaaccagttagaatgtcttcggttgttgtggatttaaataggtcgccttgcaaagggaatgatagctctggttctaggaaggaggttatcaggtcgaacaagaagaatgttgatgatggttcttctcggtctcgcaccagggaggctgatggttcccgtgggaaaaaggaggtgcctaattttgttaaggttggcaatgttgtttctggtaaattgacctcgaagattgtcaagaagaagaaaattgttaagagagtggtgaagaaaggtactgcaagttccaagtcatctgcgtcaaattcactaccggctaaaacccttcctggaactgtgaaagcggagagtgttgcacgtatttcattgactgcctctggtcctgagaaaattgaagctaatttggatgagaaaagcaacactgtcatccaaagcaacactgttgatgaggaggctaagcctgactgtttgccccctttaccaaaggaagggaatgtattgaaagaagatgcagaggtaggcttattgcagctgagtttggggccagattccaggtcacaagagtgtaagagtgacaaagattctggtattgggaaagtatccaggtttgaaagagatggaaacatttcaaattctctatcttgtgcttctataagtgaagataaaaagagtgattctgattgtttagatgcaaatgattctgtccatgacattggaaatactatttctgttcatgataatgcaaatacatctgattgtttagatgcaaataattctgtgctaaatacttacaaggttactaaatcattaagtggaagtaatatttccgtagtcactaacatcgattatgataataagcaattatgtcagaatgaagtgtctctatcacctgggaaatattcaaatgtaggatccccacagaataggaatcttgaagatgtaggggatgaacttttgaaaagcagtgataccttttcatgttcaggaaaaactaggattcaggatggtctagattgcctacaacatgccagtgcactgaagcacagttccgataatggatcatctaatttagaagatagtacttgtgttgactgttctggaattatgcattgtgctggaaagcaagtgtcccctggtgatgtcgtcatatcccctgagaattgggacacagaaaaagcattcccaaattctaatatttctgctggatctggtgaaggggacacaaataagataaaaaaaagaagagctagaacactcttaaattttttgagttcagagatggagtgcttatcttcaaaccatgtaaatccagacagccttgcaaataatgtggatggaggctctagtctgttgttgaaagatccatctccttcagaagttttagagcaacctgttcaaagcttagattttaactcactatccggcgtgaatggggttactgctttacatggaaaagggggggttttagaggctcagttttgtgttggacatattgacaatgatgatgcaaatgaggtttcaccagcttctaaaaggaaaaaagtcacagctaacccaaatttcacaaaatgtcaatcggaattgagtgctgtgattgtgccttccaccacatctgaagctcctatgagtttcagtgataaccaagaacatcagaaagaagttgcttttgaaagcatgggtatgattattctgtctagtgctcagtcaatgccttattcagaggatattactaaaatgcctgagaatgttttggctgggggatcttttgagtctattgatgcaaataaggaaaccatgagttctgagcatttggaattgtggcattcggatatagtctctttttcaccatgtgaggacttggcatttccaaatgttcagttctcatcattggaaggtgagtgcaaagaaaacactactccaattgtgcctacaagtaatattcaaacagatattttggctgtgggaaatatagctggagaaaagactgatttacaggccgttgaagaaaattaccagtatagagagcatgtacaaaggtcaccaagagctgatatggaacctaatgatcacaatatgaagaatgatttgcttgctcagtggaaccttatgtcctgtccagccagtggtgatgaagtcactacaaataattcaaatgacgaagtgattgaggatgcacctggattatcagatatgttttctcaagggatggtatctgaagtaccggatagaagggttttagaatttacagcaatcaacgatgaaaatatttttggagttcaagaaaatccagataacatatctatggttggacatgattccaacttaaatacttcatcaatacagcagactaaaaaaaatatgaagtcagatcatgcaattgaacatagtaacctgatcacaaagaagacaatgtcagaacaatcccaagtttcttccaaagttacaactcaggctctaaattcatattgttttgggttgagtgggaccaaaaatcagtcaggtagtatcattcccaaaacttttccaggtcattctttcaccttttcaaagacatctgcctcctcacctcatgtatcaaagcctcgaacttggcatcgtacaggtaataatcctccggcttctctacctagaatcaagccttcattaggaacagttcctcccaaaaagccaattctagaaatgaaagggaactttcaaaatacctcctatgttcgtaaaggtaacagtcttgtaaggaaacctactccagtttccactctacctcatatctcctctgttaatcagacatctttgggcatagatgaaataccaaaaagcattaaatctggagggagggctgatgtgacagataaacaaatgtacttgagaacaggagcaacaaatgctccacagcagagaacacctccactaccaattgacaccaaatcagaggaaaatacatcttcctcattggtagaacctccttctggtggttgctgtgaaaatgcatcagaccttaggaaatttatagaaactgataatattgcaccaaactcttctgaagatgcactgaagcattatgaaactttagaaaatcaacctggtccatctgataatggggatagccaaggtgaagcaatcgatggaaatgtttttcctttgaatacaaagagaatagtatacataaagcccaaaacaaatcaattggttgcaacatcaaattcttgtgatgtttctgtctctactgatgacaatctccaaactgccttctctgatggctactacaagagaagaaaaaatcaattgattaggactacatttgaaagccatatcaaccagacagttgcaatgtccaataacacggcatattctggcggacaaggaactagcaatgctctttgcaacaggaggtttagtaagaggcggacacataaggttggtaggagttcatgcaaacgttcaagagcctcattagtgtggacactctgtagcaaaaattcttctgaaaatgacagggactcacaacattatcaaagggctttacctcaattgtttccatggaaaagaccaacatttgcttcaagcttgaataacagttccttatctgcaatcagcaaaaaattgcttcagttgagaaagagggatacagtttacactaggtcaatccacgggttttcacttcagaaatccagagttttaggtgttggcgggtgtagtttaaaatggtccaaatccattgagaagaagtcaaagctagctaatgaggaagccacacttgctgttgctgcagtagagaggaagaggagagagcagaaaaatgcagtttgcatcagttctcagtcaaagagagagcgtatatttcgcattggttcagttcgctacagaatggatccttccaggaggacacttcagaggatttcagatgatgaatccctgtcctctgcatctacctgttcaggtttggcttccaaaagagcttacattccaaggagattagtgattggaaatgatgaatatgtccaaattggcaatggtaaccagcttatcagagacccaaagagacgaactcgaaaattggcaaatgaaaaagttagatggagcctgcacactgccagacagcgattggcgcgaaagcagaagtattgtcagttttttactagatttgggaaatgtaacaaggatggagggaagtgtccttatattcatgatccctcaaaaatcgctgtctgtactaagttcctgaatggtttatgttctactcccaactgcaaattgacacataaggttattccagagagaatgccagattgttcttatttcttgcaaggcttatgctcaaatagaaattgtccatatagacatgtcaatgtgaaccccaaggcatctatttgtgaaggatttctcaaggggtattgtgctgatgggaatgaggctgtttttcagatccccatgaccaaccggtcaccaaagaacaactttaccgctgtgccagggctctccctcgcattcttcctttgtcggaagaagcacagctatgtctgtcctacttttgaagcaacaggaacctgtactcaaggaaccggatgcaaacttcatcaccccaaaaaacaaagcaagggaaagaaaaggaagagaactgcagatcagaacaacagtagagggcgttattttggttttattcctgctgatgtttctaaatctgggatgatggtggctccaaagcgacatagacagaatggtgaacttgaagaggaactttctgactacatcagccttgatgttgtgaatgaagaagttgcagatgtggtcgatcaatcatttgagccagcagctttctgtgacaacgattccttggatttacagttggatgattttgatggacttattaaaccagttcttctgttgaaaacaaagttcacattgcaatcacctcagtctagtagcctccaagcttttaggcaagtagcggagacatag

SEQ ID NO: 29074 - DNA, 180 bp, Glycine max
  Peptide Sequence Number=SeqID_120759
atgccgcgccaaaatgagtttgttggttattcgttcacaggaaaaaatccccaaaagtttgacattccttccagatgtaccatggatgaactgaaggatttgatcaagcaacttgcgcctcatgggattcccccttatggtatccatgaaacacaaatgctaaatcaagaaattggttaa

SEQ ID NO: 29075 - DNA, 420 bp, Glycine max
  Peptide Sequence Number=SeqID_120760
atggtcattgaccaatccctattctatgatttaacccaattatccagtgaaggtgtaccatttgaaggtacactgattgatgattggaaatatgaattctctgtgcatgatgcccgccggttggtttgcaccaaccaagcagatatgaccggaaggcttcttgctggttcattggcttttgagagccgcatccttcattacctcattgttcgtatcttgcttccaagatcttcaaaccttgcacagattttggataggttcgatggtcttcaaacctttgttggtgaaaggtttgatactttggagttacaagtggacatgcgattcaatgaaatggagtcaagaattaccaaggtcgaaggagatgtctcttacatccatacaagctttgatctaccaccaccaccaccatcatcttag

SEQ ID NO: 29076 - DNA, 752 bp, Glycine max
  Peptide Sequence Number=SeqID_120761
gagatcgtgatgattccaatgatgctccgcaacgtcgacggcctacggcatccgcacgcaggcaacgagtacttgtcactgttgtggacgatgagccagtggtccttgcgacaaaggctgacggagcttcggttgaggctgacgtatatgcggatgagccgatggcaggaggtgatgtacaggacactggagcagacactcttgcagacacaggcgcacatgctgctgaggatgagcttgagggatttccgggtggtccgagggacccatccgtgctgaccgagtatgcggatcacgttgcaggcaacatatggacgggagatcgtcctgagttgaagttattctctcacggaaggaaggtgcatagtttaggcaggcctgtccttgccattgaggggctagttgctgggacagaactaagtcctttgattgcatgtttgatagacactggcgatcggggacttttgtcatcgtttgttgagcggtggcaccgggagacttgtagtttccatctccctgtgggagaggtgacgatcacactggacgacgtcatgtctcttctgcatctgtccgtggtgggcgacttgcatgcctttcagcctgtgcacgtggatgatgctgcctttcgtgacctcagtcagactgggaggtacgcctggggagtaactgcgctggtgcatatgtacgaccacctgaatgatgcttctattagcaccagccgacagcttggtggttacatcacgctgttgcag

SEQ ID NO: 29077 - DNA, 1390 bp, Glycine max
  Peptide Sequence Number=SeqID_120762
tgctggatttatgagcactttccctcggtcgcggagtccaccgctgatcaggactacgacgaggcttcctgcgagtgcgcaggtggattgcgacgaagaagaccgtgaagagcattcgcacgtcggcgtacagggagcgcctggaccgactctggattccggatgtctgttggatcccttatggggagcatcgggaggtccggaacttccacgtcagatcatgttattctggtctcttgtgctggagagggtcgtcgccaaaatgtttgaggttgagtgtcacgatactggcagaggtgtgggcagaggagatcgtgatgattccaatgatgctccgcaacgtcgacggcctacggcatccgcacgcaggcaacgagtacttgtcactgttgtggacgatgagccagtggtccttgcgacaaaggctgacggagcttcggttgaggctgacgtatatgcggatgagccgatggcaggaggtgatgtacaggacactggagcagacactcttgcagacacaggcgcacatgctgctgaggatgagcttgagggatttccgggtggtccgagggacccatccgtgctgaccgagtatgcggatcacgttgcaggcaacatatggacgggagatcgtcctgagttgaagttattctctcacggaaggaaggtgcatagtttaggcaggcctgtccttgccattgaggggctagttgctgggacagaactaagtcctttgattgcatgtttgatagacactggcgatcggggacttttgtcatcgtttgttgagcggtggcaccgggagacttgtagtttccatctccctgtgggagagatgctggtggagttattgatggtcactgcagaggctgccagggctgagacaacgcagtgttgtggaccgtacgtacgcctgcaatgggcctttcgtgacctcagtcagactgggaggtacgcctggggagtaactgcgctggtgcatatgtacgaccacctgaatgatgcttctattagcaccagccgacagcttggtggttacatcacgctgttgcagtgctggatatacgagcactttcccttagtcacggagtccactgctgattcgaactacgatgaggattcgccatgtgcttgtaggtggattgctacaaagaagatcgtgaagagcatacgtacaccgacgtacagggagcgcctggaccgactccgaattccggatgcctgttggatcccatatggggagcatcgaccagtccgagacttccatatgatttcatgttattccggtctgctgcgctgggggcccgttgctgtgtattaccgaccagagagggtcatgcggcagtttggatacacccagaccattcctgctcctcctgccgattcatag

SEQ ID NO: 29078 - DNA, 477 bp, Glycine max
  Peptide Sequence Number=SeqID_120763
atggcggttcatggcggaaagtcaaaaatccgccataaaaatatggcggatggcgtagcggaaaatgacggatgtcatggcggacagaaaaaaggggtgtcaaacagcaaaaatagcatgccgccgttcgtgacaggtgcgttgctgccggagctcgtcgccgccgttcgtgccggtgcgtcgctgccggagctcgtcacagctgcgtgcgcatgtggactgcaggtgtcgcagctgcatgcgcgtgcggactgcgggtgtcacggctgtggctgggtgcggcggggtgcgggagggacgcggctgggttcaggggaggctcgcgatgtgtcatgcgccaaaaaggaggatgcacgtgaacttcacacaccggagaagaagcgcgtgggagcacttgcggtggcggatggcagcatgccgttggaggttttggtcgccaggaaagggcgacggtggttggaggtccctacaagataa

SEQ ID NO: 29079 - DNA, 192 bp, Glycine max
  Peptide Sequence Number=SeqID_120764
atgacgattcttacactaacaatgacaacactcaagccaacatcgacgaccgatgatatggccaagagaggtgcctccgacattgtagtgaaattgaagggaagaggggaagagatgagggagaaaggaagaagaataatggagggagatgctgccaccgaaaatcgtctccgacggctgcaaatggcgtaa

SEQ ID NO: 29080 - DNA, 435 bp, Glycine max
  Peptide Sequence Number=SeqID_120765
atgattcaggtcgttgcaccaacactaaacacacttcctatagctcaagaccaacaaaatccaacctttgcaagggagtcaattcccactacccctattggagatgcttcacctttagcactagattattctcttacacctaagtttcaaccaacatatgaatgttcgaatatcatatcagatatcattagttggttgaaggtattagttgaccttcacgataggtggtttggagagtttaagggtcctacaaatttcctagacaagagctccactgctaaggcgaatcgatctgttaacagaggagccttaacatactgtggtggttccatatctactgcagttcactttgaaaagcagtcaaaggagtttcaaggaccaccaactgcttgggaaatgatggagaaaactatgaaattgaagtcgggagaatag

SEQ ID NO: 29081 - DNA, 1887 bp, Glycine max
  Peptide Sequence Number=SeqID_120766
atggcaacacccccaacgtccccgccacatttagaaaaccctcttaaggttacttcaaaaaggactagacgatccacccggctcagaaggctgactactagaagcttaaataacccaacaccagttgtgaacatcaatcctgctacaggtagaggctcggggccttataaagagaaatttcacagttatttaggggttgtcacaagggaaaaaattcttattgtccacgcgaattggaatgttgtcccaaacgatctaaagaacctaatatgggaagatattttgttagttttaaaggaatcatttacttactgttacataacaccttttgttgtgcaacgcaaatttgacatccctgaatgtaagcaaatatctgatcctacggtgaagtatagtcttcatccagcaacatgggccaaatttgcaaaaagccgccaaacccctaattggcagggtatacggaagaaggtgcaggaaattcagaaattcaatgacttcccccacgtactgtctcgtgggggttatgaacttcttgagaacaaacttatggatgagaagaggaagcgtcgagatcagcaagatgagtttactgaaaacccaacactcaacctcgaccctctatccccagtgtcgagacaccttaagtggaagatggtccgcacaaagtgttttggccaaatgacctctaaagcggcacaacaaattgcagacaaaattgattcattagaggaacaggctacgacaggtgtcacaataagccaatactttggccaagcgtcatgtgcttctaccacgtcctcaccaccaatcagccaacaacagctagctgaaatcatcgatggaattaaggatgagataagaaaggaggtggaagaagaacataagcagcaacaagaggcttggaggagggcaattgaagaacaacacaaccgcaatttggagataatgaagcaagagttaaaacaagcacttaaaatagagttatctcatattgcatcacatcagtcagcccccattgagccgccaaaaatgcaagctttagttgcacgtgtgaccacaaagggtagctgtgctgcacctgaggcacaaggattacctaaagagccttatgatgttgatgtggatctaatggggttgttcaaagttgaagatgaaattactttgctagtggccttgggaaaaatgtacaacaattcatccaccatacacaatgttcgttatgcagatgacgttgttagggtgaatgttgtcacatattaccaccctgacgctgaggtcccttttcctgcatcagagcctccactgaagtctgttgaacagccagatagggccaatgttgtggccacaattgatcccctgggagagttggttaagaagttgtatgtcgtttaccaaaagtcaatggagttgtcatgggataaggcgaaatttgggatacctaattccacaaatggttttttcatcacacatagtcatgtacaagccggagcctatgagtgtggatattatgtgatgcattggatgtggtgcatcgtcaccagcggtttgaagaatgaatggaacaagtgcttttctaatggaacaccattagacagtgacaccatgacgacactacgcaagaaatggccagcctattttctacaagttggaaagatggatgtctgcattagccacactatatatggtcgtccctttcaaagtttgtctaacaaaaagacaataagtagttcaaaacaattttgtctatacaaccattctttgatatgcaagttaggtggtactcgtacaatggaagtaatgattacagttggaaaaatagttccaaagttacaggatgatccagttattcttgaacgattacatgctccaactaaagctcctctttag

SEQ ID NO: 29082 - DNA, 672 bp, Glycine max
  Peptide Sequence Number=SeqID_120767
atggcccaaggagtcacttcagattctctgacttttgagtcccttagcccagccattaacttagtttacataaagaagaattgttggaacttggacgaccccacggtcagcttttcagggacccacaaagtcagggctagaggatttgaaggtctatcttctgttgcttaccagccttctactgcaccagctcctattccttcaacaccaccagttctagctacttctggttcctccacacagagcacaaacctcatgatggcgatgctgcagagcattcaccagggtcaaatcctggtgatgcagagtttacataatttggctcagcatcaaccaattatggaggagttttctttgcaggtggcctggccaagagtccatccttcttctcatggagaaggtgaggccttcgcagctcaggagcctcagccagatccgaagactacccctactgctcaggaagatgattcagaggccacttccccagagtcatttgtaccaaagactgatccagaggtcgatccaatgattgcggaggccagtccacaggcatcaccagtatctacaccagtgctaaagctgaacaccccacaaggatcaccagcaggcacgcctgtgttgcatttgaccgatgatgaggccatggatcaggacccaccgcaggaccagtga

SEQ ID NO: 29083 - DNA, 309 bp, Glycine max
  Peptide Sequence Number=SeqID_120768
atgggtgatcaagccacaagcatgcataacataagcatagatagaaacattgaacacataaagcttaaaaagagctttctgttcgcgaaggcacaatcgatccagatctgcgctaagcgcacgagcacgaacaaggccacctatttaagcctgaaatcagatttgaaaagggagtttggcacttttcttgagaagctctgcatgcacgaaggttctagagagagaaaggtccaagttctagagagttctgagagattttgctctgtgaagatctgcagagacgcgagttcgaagcggaagccgttctga

SEQ ID NO: 29084 - DNA, 864 bp, Glycine max
  Peptide Sequence Number=SeqID_120769
atggttaggactaaaggcttaggtcatgccttagatagggttattggcagagctctagggagagaggatcgtcataattcagatgatgctccccagcggcgaaggcctacagcatcggcccgtaggcaacgggaatctgcccctattgccgaggataagcctgtggtacctgcggacgagcctgtggtaggtacatatgagattgtggtagttgcggacgtacatgcacctggtgcagaggctactgcaaatgagcctaagggatttccaggtggaccgagcgacccatcagtgcttaccgagtatgctgagcatgaacgtcttgaattgaagttatcctcccatgggaggaaggtgcagaaattaggtaggcttgttcctgcaattgaggggctagttgttggcacaggactaagtcctttgatcgtgtgttcaatagacactggcaatcggggacttatattctcatttgtggagaggtgggacagggagactagtagtttccatcttcccgtgggggaggttaccatcaccctggacgacgtggcatctcttcttcatcttcccattgttggcaccttccatacctttcagcctttgcacgtcgacgaggtggtgttgatgttggttgacttactattggtctcaagagaggtacgagatatatatcaacgcagatgtcaagccggacattggacaactgcatctcatgcctatcttcttcatattctaggttgcactctttttgctaaaaagagtgcaacttatgttcatgttgtcttcttagacactctgcatgacctcagtcagactaggaggtatgcatggggagctgctgccctagtgcatatgtacgatcactga

SEQ ID NO: 29085 - DNA, 270 bp, Glycine max
  Peptide Sequence Number=SeqID_120770
atggaacatattaagatagctccagcaaaggtgagcttcggtgaaggtgaaggggcagatgtccattattgtggtggttggatcgacgtcggcggcaaacggatggacgaaaatcaatggatatatgacactataatgtctgaagaagttgatatggatgatcaaaatgaacaagaatgtggtgtgaatgaacgacaagttgattgtttggatgcgttcaatacttctcaggtgtttgacagccgagatgatgttttgcagtgggcttga

SEQ ID NO: 29086 - DNA, 168 bp, Glycine max
  Peptide Sequence Number=SeqID_120771
atggcgagcaacccctctagagctcagaagaaactcaagtcttctaagaggaagcaaggagagtactctcaaactgctctcaacaggctggatatagggtttactattgaaaaatgtgagaatacccaagtatttggacttggagtggttctctcagtaagggtttaa

SEQ ID NO: 29087 - DNA, 414 bp, Glycine max
  Peptide Sequence Number=SeqID_120772
atggagaacaacagccttcgatgtttacaatgcaatggagaaaagagcgcgaaagggttcacagaaaagaagaaagcgagagaggctagggtaaacgaagaagaaaggagcgcgaccgaaataggtcatttcaaatacaatttaaaatggagtttgtcttatgtctggggtagtagtcttgacgagcatagggtgacaagtttttcgagccccccaagtgttgacgagtgttgtctagtgtcgggcgtggtggccttgacgaatgtgagagttgcgagtcgatgtggcttgtcaagcccccgagctgggacatgtgttgttcgggctacttctatcaagttgttcgtgatagacttgtctttggcatgccaggtaaggtcactattcaataaccgaagctctaataccagttga

SEQ ID NO: 29088 - DNA, 309 bp, Glycine max
  Peptide Sequence Number=SeqID_120773
atggggagtggagacgacttcttgaggggaaatgttgtagaaatttatctttatggtggaaggatttatgtaaggatctcaaggtacctgccaaggaacaaaagtctgtcaagttcaacttgccagaggaggatgaatttgatgccagtgatgatgattatgatgaggaagaggatggattatgatgaggacataaccaaggaccatgaagcacttgaaggtcccatgaccagagacagacttaaacaagcccaacacgtcatagagacaaggctggtcatttgtatagctgccattgatgatgattga

SEQ ID NO: 29089 - DNA, 336 bp, Glycine max
  Peptide Sequence Number=SeqID_120774
atgaggcttaagaatcaaggaagtcactcagtccattatgcaagccaccaagggaatcaaggagctgaaaagaaatttgtgaagaagcatgataaaggcaaagggtcattaaagataaatgacgactctttgcaaatccagaaaaaggtatcaaagggcaatagttgtcaattttgtaggaaatcaggacatttccagaaagattgtctaaagtgtaagtcttggttcgaaaagaaaggattccttacaatccaaaccttaagcccaaatgagaagttcgtcttcatggggaatagagtgaaactccagtgtaagcaatcaagacttattgtttaa

SEQ ID NO: 29090 - DNA, 342 bp, Glycine max
  Peptide Sequence Number=SeqID_120775
atgacgtggatgccgccattgttgccgacgggaaagcttgtaccgccattgacaactacgggaacaaggatcccgccattggcaactgcgggactcagcctaaaccgtcagtacgaacggcgggacaggctgagtaggagagagagagactgtaccgctgctggggctagcgggacgaggagagatggagccatgccgccattcctcctggcgggacatgccaacgtggcagtcccgccactgcctcctgcggaacacgttgacgggacgcaagcttttgaaaggctaaggctagttcacatgcacccacctcttgctttaacactattggattggatatag

SEQ ID NO: 29091 - DNA, 516 bp, Glycine max
  Peptide Sequence Number=SeqID_120776
atgtacaacctgtccaaggaggatgcactttctggcattgcagcagaatctgtttgtagagtggatggtattttcccatgcaccaactcaaatgccacaagtcaatatatgtttgacgacggagactatgcaccaccctcactgtcagcctctcccctccacgtcccacgaatcaacccaagcatgccaccgttgaagacttcggaagcgtacaagcattgcgcaccgtgcacggggccagcgatggccaacgacgcagggatgaaggcgcggctgaaggggatttcgagcggggaggggatttcaccaatcaaagcatctcatcaggttgtccacccaatccatgctgaggttcccgtcttcagccaccatattgggactcgcagttctggcagtggagttggatgcggcggtggtggtgatggtggttgtggggcttcctctacggtgggggagatgccgttggtggctggggaatccggtggcggtggtggtgttggtgctgaattagcttga

SEQ ID NO: 29092 - DNA, 273 bp, Glycine max
  Peptide Sequence Number=SeqID_120777
atgtcacgtcaaaacaactttgtaggttacgcgttcacaggaaaaaatccccaaaaatttgatattccaaaaggatgtaccatagatgaactaaaggatttgatcaagcaagtagcacctaaagggaatcctcctcatgggattcatgaagcccaacttgtgttggtagagtccaattacaggaaacaatttgtgccaatagaaattttggctctttttagtaaaccggttatggaaaatgaggacgaggtggttacgtcgttgcaggattga

SEQ ID NO: 29093 - DNA, 274 bp, Glycine max
  Peptide Sequence Number=SeqID_120778
atggataagagcttggaggtaggagaagaagaatggagggagaaggagagagggagcacgaaatttgtgcctcaaaagagcccgaaatctaccctaaggctcatgagaaccctagggcattctcttgcatctttggcccaatctacttggagtcttctacccaatgcgcttgcgggctgcaagagccttccatctcataggctttgggggcaaatgatgatggtctctgctcataggaccctttatctgaagcggtgctctctaaattcaggag

SEQ ID NO: 29094 - DNA, 297 bp, Glycine max
  Peptide Sequence Number=SeqID_120779
atgaagggatatcgatataaggtgtgtttggatagaagggtacctgttatgaacatcaaagataaaagcactgaatacaaaaagagaaagaagcttaagacagttgggaaggaatttccttataattttgcatattccttctgtgaatacacctctgtgttgagtcgttatcttcctcttcctatcatatcattccctggcccatcaaaaacacctcgtcctcaaggtgttgggcttcaaaccatggcttcaaaagttgaatcgggatcccaaattaaaatgggtgaaggaaaatag

SEQ ID NO: 29095 - DNA, 140 bp, Glycine max
  Peptide Sequence Number=SeqID_120780
tagcagccttgggattcgtgatagggggtgatgcaattctccctaggaagggaccaatcactagaaccatgagcaagaggctccaagaagattgggctagagtcgctgaagaaggccctagggttctcatgaaccttagg

SEQ ID NO: 29096 - DNA, 267 bp, Glycine max
  Peptide Sequence Number=SeqID_120781
atgtattcatttgcatttcaaaagacttcaatgtcttcagtcatttatgtagaagcaaagcttcatggtgaatcaaagaacaattcaagagttcaagataagaatcaagaagaattcaagactcaagaagaaagtttagagtcaagaatcaagattcaaggttcaagatctcaagaatcaagatcaagattcatggctcaagattcaagaatcaagagaaggcttaatcaagataagtatgaaaagtttttctcaaaaattgagtag

SEQ ID NO: 29097 - DNA, 426 bp, Glycine max
  Peptide Sequence Number=SeqID_120782
atggctgaaataacatcatctctaacccaattacaactctcttccaaacctaaattgaatgccccagattactacgatgctccttctcagaaagcagttgtaggtcatcattaccatgctggtctttattcagcttctgatgatgaaatacccacggttgattactctctactattctctaataaccctgttcaacggtttcttaccctagaaaacctccgtcaagcatgtcaggaatatggcttcttctatctggtaaaccacaccatcccagatgaagtgttggacagtgttctaaaggggtttgctgattacgttgatccaaaaaccatagatgaaagaaaggtctaccgcaaaaatggcccatcggataaaattcgatgggacctaaactcatctgccggggaaaatagggaatatctcaag

SEQ ID NO: 29098 - DNA, 228 bp, Glycine max
  Peptide Sequence Number=SeqID_120783
atggcgaaaataaatcatcaagcatggccaacaaaaacatatcatccaatgaaatgctcaaaggggctatcaaaggaattaattcaaggtaggctcatttggctagaggcttataagaacaaaatgcctaaatcatctcccaacatgcatgtgaagcaagaagtatcaacaagagtcaagccaaggctattatgcaagcaatcaatgggggcaaaacacaccgaataa

SEQ ID NO: 29099 - DNA, 495 bp, Glycine max
  Peptide Sequence Number=SeqID_120784
atggagagaagtatgatagatgcagccagtggtggagcccttggagacatgacccctgctgaagctaggaatttaattgagaagatggcttccaactctcagcaatttagtgccaaaaatgatgttattgtcattagaggagtgcatgaagtagccacgaattcatcttcatcagctgaaactaagaagcttgaaggtttactagatgccttggttaacctggtaactcagctggccttgaatcagaaatctgaacctgtcgcaagagtttgtggtttatgctcctctaccgaccaccatacagacctttgccttgaaggtaaactagatgccttagttaacctggtaacccagctggccttgaatcagaaatctgtacctgtcgtaagagtctgtggtttatgctcctctaccgaccaccatacagacctttgcccttctgtgcagcaatctggagcaattgaacagcttgaagcttatgctggaaacatctag

SEQ ID NO: 29100 - DNA, 96 bp, Glycine max
  Peptide Sequence Number=SeqID_120785
atgactcagtcccatgtgataggaggaggtactaagaattgtgaagccacaacattttctacccatacatggagaactcttcttgaacgagcatga

SEQ ID NO: 29101 - DNA, 573 bp, Glycine max
  Peptide Sequence Number=SeqID_120786
attgctgaaactgcaaaacggattgcaacaattgtgattgctgatgaagtttatggtcaccttgcatttgcgggcaagccttttgtgccaatgggaatttttggctctattgttcctgttctgactcttggctcattttctaagagatggatagttcctggatggaggcttggttggtttgttacaaatgatccatctggcacttttagaaatccaaaggtagatgagcgaattaaaaagtactttgatcttttgggaggtcctgccaccttcatccaggcagctctacctcagataattgcgcatactgaagaggttttcttcaagaaaaccattgataatttgaggcatgctgcatatatatgctgtaaagagttaaaggataatccatacattatttgcccttataaaccagaagggtccatggctatgatggtaagactaaacctttcacttctggaggatattagcgatgatattgatttttgtttcaagcttgctaaggaggaatccgttatcattcttccaggtccaatagggagaaaaggaaattctaaaaacaaagaatgttga

SEQ ID NO: 29102 - DNA, 118 bp, Glycine max
  Peptide Sequence Number=SeqID_120787
ttggtcgcctccaatatcagggggtgcccaggaactgataaaaggaaactactggccccttaaccgggagcgcaagtctcggttaagcatctacggggaaaggccttatatcttctaa

SEQ ID NO: 29103 - DNA, 656 bp, Glycine max
  Peptide Sequence Number=SeqID_120788
aagaggatagtaaggccttgtcttcaaaggccaaggggaaggaaaaggaggaaaaggtttcttccaagaagattgttaagaaggaaaatcattttgcaacaaaaggtgatattaaaatagcactccttcttaaacaatctttctaccttcttctatcaagggaaacatcccttagcaccaccatacctcttgagcttgaggttattcctcaagtaaaggagttgttggatgagggtttggttcgcaagagcttaaatccttgtgctttgttggtgcctaaaataggtattattaggcaccaaatccctatgataggtggtatgatgaatgtgttgagtggtgcaacactctttggtaaaatcactcatgcacccaacatcttcatgatttgcgtacataggggctcattaggtaggaataatctacatgaaaataaagaaaaaggtatgctttattccattactttccttaactttttaaatagtgatcaagggcttcccatggacccaaagagaataaaggacattcctgagtggcctactcccccaagtgttgaggaaagaaataatgagtttcaagaacctctggatttgaggtcaaatccttttcaagggggagggaatgatgcaatcctaccccgcaagggcattggatag

SEQ ID NO: 29104 - DNA, 264 bp, Glycine max
  Peptide Sequence Number=SeqID_120789
atgtttcttcgagcatctcaatttcataattgcattttccatgcatcgcatacgtattcccgagtctttcatctctatgaaatgttgtcgaagtattggcaatcgaattgccattccttggattacggggttgaaccaaactcatgcttttacgaaaaggttcatcaagtcaagttgaagcatggaagtaaccatcttgcaaaaattggggcaaaagatgaatcgagttacatcactgcttcgtctactgccaaacacatttag

SEQ ID NO: 29105 - DNA, 366 bp, Glycine max
  Peptide Sequence Number=SeqID_120790
atgtccaaatcttttgaatttgggatgactggctctctcgatgagtcgatctcttgctttctcataaggatggacccttggttaccctcaccgttgagaggattacacgtcctcgccttgagaggactacacgtcctcaccatcagagggctgcacgccctcacctccagaggactacatgtcctcgccttgagagggctacacaccctcaccttgggtactagttaccctcatcgtcagaggactacacgtcctcgccttgagaggactacacgtcctcaccatcagagggctgcacgccctcacctccagaggactacatgtcctcaccttgagagggctacacgccctcaccttgggtactag

SEQ ID NO: 29106 - DNA, 354 bp, Glycine max
  Peptide Sequence Number=SeqID_120791
atggttgtcattctgcctaaggaaaacctagttgtctggttttgttctttacataatagaccaggcaactaccttaagggaataattaacagtgctttgaaaggacttgatgatactccacaacctaaatccaaggctgctgctaggtggattgttgttaagtgtagtaaacaaaaaggaagcactaaatgtggctattacgtgatgcactggatgtccacgataatcttaggatctttcaggaataattgggagacgtattttaatgaagttagaccattggaagcagagagattcaaggcgtttcgcatccagtgggcacagcattatctaaaagttaaaaatcaaatatag

SEQ ID NO: 29107 - DNA, 237 bp, Glycine max
  Peptide Sequence Number=SeqID_120792
atggttcacaacatccctttgttgcatggccaagtgaaggttggtgttgaggaggttaaagatgcaaaggctctcgttcctgtacccactaacgaggttaccttagtggggcaggcacttaacaccttccttgcttggctgacacatctcgtgaagcgtttatcagaacaggcagttgtgtctccaacaatcctccagaaagcccagatcatgaggtcgatgatcccctatatctga

SEQ ID NO: 29108 - DNA, 543 bp, Glycine max
  Peptide Sequence Number=SeqID_120793
atgtggcaggcacttaacaccttccttgcttggccgacacatcttgtgaagagtttatcagaacaagcagttgtgtctccagcaaaacctccagaaagcccggatcatgaggtcgatgatcccttgtacctgatgacattgaccatcccacaactatttttgaagcctctccaggttatgtgggatgctaccatgttcggggtgtttaatcaaaacttctcgttgtacataaagcacaaagatctctttgaaattgcacacggtggtcaatgtctcagcatatctgttatacagttgtggattttgcatctgactgagacaagtctgcaagcggggaattccgatgtgtatggattcctcgatccacaatccattcaaagatctgggcaatcgcaatttgaatcgaaaagttacatcaagagttggatgcagagtttaaaacgagatgtctaccttggagcctacctgaatggcggacactggcaaatggtcgtcattctgcctaaggaaaacctagttggtctagttttgttctttacataa

SEQ ID NO: 29109 - DNA, 1005 bp, Glycine max
  Peptide Sequence Number=SeqID_120794
atgccacccaattggccaccgcgctgctgggagacgccatcgccgccaatctgttcatcctcggctatgcgtggcagcagggcctggccttcgcctggggtcgcatggccgtggtcgacccgcaggccgtgcagcaggcggccggcctggtgcgcaaccgccacaccgataccgaatccaccccgggcccgctgcacccagctgccgccgggcgagtgggaaggcaacgaatggggtgccaccgccgcaccgcgcaacaccggcgacgaacgcgaactgcgtggcctgccctcgcacggtggcgacgtggcgttcctgccgctggacgatgcgcgcctgtcgcgctcgctggacgaaatgatcgagcgtcgcgccgccttcctggtcgagtaccaggatgccgcatatgccaaccgctaccgcagcctggtcgagcgcgtgcgcaccgccgaagccgaccgcatcggtggttccaccgcgatgaccgagacggtggcccgatacctgttcaagctgatggcctacaaggacgagtacgaagtggcccgcctgtacaccagcggcgacttccagcgccggctgcagcagcagttcgagggcgactaccagctgcgtttccacctggcaccgccgctgttcgccaagaaggacgagcagggccggttgctgaagaaggaatacggcccgtggatgttcaaggccttcggcctgctggcgaagctgaagttcctgcgtggcggccgactcgacgtgttcggccgcaccgaggaacgccgcatggagcgcaaactgatcggggattacgaggcgaccgtgcagctgctgctggatggcctcgatgacgaccgcctggcgctggcggtggagatcgccagcgtgcccgagcacatccgcggcttcggccacgtcaaggaagcgcatttcgcgcaggccaaggcacgggaagcggcgctgctggcgcagtggcgcaatccgaaggcgctgcatatcgtgcaggtggcttga

SEQ ID NO: 29110 - DNA, 467 bp, Glycine max
  Peptide Sequence Number=SeqID_120795
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatggaatcggccaacgcgcggggagaggcggtttgcgtatgggcgctcttccgcttcctcgctcactgactcgctgcgctcggtcgttcggctgcggcgagcggtatcagtcatcaaaggcggtatacggttccacagaatcaggggataacgcaggaaagaacat

SEQ ID NO: 29111 - DNA, 294 bp, Glycine max
  Peptide Sequence Number=SeqID_120796
atgggttgtccctgtgtgcctatccctcttaagattattgaggccacaaggttccaacaaaagaatggaaaaatccgacaagatgaatttcaaagagaagaaagaaaagaaaggatatatcacttgggaagattgatgcaagctccattggagcttgtaggcctaggatcttcttcatcaatggattcctttgcttcttggaagatgaatggcagcggaatggagaaaggaagagagagagaggagacgccacttcaagaagaagatgagtctagaagaagctcaccaccatag

SEQ ID NO: 29112 - DNA, 399 bp, Glycine max
  Peptide Sequence Number=SeqID_120797
agcttcggtattccatttcgagcatctcgatatattacgggactcaatcagacatccaactcagagcttcgatcttcaatttcgagcgtctcgacatattacgggactcaatcagacatccgagtaaaaagttattgtcgtttgaatttgctcaaagcttcaacattcaatttcgagcatctcgatatattacgggactcaatcagacatccgagtaaagagttgttgtcgtttgaatttgctcagagcttcgacattcaagtttcgagcgtctcgatatattacgggactcaatcgacatcgagtaaaaagttattgtcgtttgaatttggtcagagcttcggtattccatttcgagcgtctcgacatattacgggactcaatcagacatccgagtaa

SEQ ID NO: 29113 - DNA, 366 bp, Glycine max
  Peptide Sequence Number=SeqID_120798
gctaacattaacctcccatacttccatgggaaggacaatgtagaggctaacttagattgggaaataagggctgagccttctaagcccaaagatgataaggggaagacaatagaaaagcaaccccctaaggctagtatgcaagagaagactaactctataaatagccaagatgaggctactacttcaccttcctctagtgaaaatgaagaagcaaaaggggaagaatctagtgaagaaatctacccccaagaagaaggacaaccattaatggttaaggaggagtgtaaggagacatttgttagcattgccatacctcttgggcttgagttttttcctcaagtaaaggagttgttggatgaggatctg

SEQ ID NO: 29114 - DNA, 114 bp, Glycine max
  Peptide Sequence Number=SeqID_120799
atgtggacaccacggaaaattgggggagaagcttgccacccagctcgcccaggcgagcaaggttgcttcctccagaagcaacaaccttctggaggaagggtttggaaggcctaa

SEQ ID NO: 29115 - DNA, 342 bp, Glycine max
  Peptide Sequence Number=SeqID_120800
atgatcgaaagttttcaacaacaacaaatgtcagttctagaattgtacgtagaaaaggatgttgctggtggttctatgtttcatgctgcaaattctgttacgtcatgtggacataatgcatctcatcatgagtcggaactaccaagaaatataagcaatttacatgatgaagatgatgatgatgattatcttgcatctaactcatacgttgaagagtctttcgatgaagatgatagtgttgatggaatatctgatacagacgatgaagtcatcgacatcgttgaaccagtttcaattgttcacccaattgaaggtgtaccaggaattcaaaatccattttga

SEQ ID NO: 29116 - DNA, 266 bp, Glycine max
  Peptide Sequence Number=SeqID_120801
atgattggtacctcaaagccttacactggggcaatgaggggcaccgtgcatgagcctcaagtgaacataggggctgatcaaaagttcacacccgtcgatgtttttaaacaagaaaaaaaaagggagacaagccctggaaatttcaatagattgattaaacatcaaacgactccattcccgtcactccaaaacggtcaagtgactaaatcaaacatatcacacactctgagagagttctcggagagatttgcaaaagataggataag

SEQ ID NO: 29117 - DNA, 127 bp, Glycine max
  Peptide Sequence Number=SeqID_120802
atgggggacaaatccaaacggcaaaaggttttatcaaggtcaagggttaaaggtctagatgtcactagcctcaaggaattggggacgattggatggggacctctccaagggaaagcctttctgcaag

SEQ ID NO: 29118 - DNA, 886 bp, Glycine max
  Peptide Sequence Number=SeqID_120803
gctgtcgtcccttgggacggacgtgtggggtgctaataccttcgccgtgcgtaaatacaactcccgaacctttcacttaaaagttcgtagatcgcgtcttttccggtttttccgacgttttcctcaaataaacgttggtggtgactccacgcgtattcctttcgtggaacacgcatcccgcgagtcacgcgtcgccctcccgccgaagggtaggttgcgacacataggaacaaggggttgcattaactacaatcccgcgtttgctataagacaggtagggtaccccatgaggggagcaccggcggaagagagcctctctccattccttatgagagatttcggcgtggaaagcccgttgaggaaagataaagaacttaggggcatccgtaatggcatcatcggtggttatcatgaatggctgaaagttcgtacacgagggttagattggctctccaagttgaaaattatcaaagaagagaacttcgaagctccggaagaggatgaagaagttcgagctctaaaaaccgaattaggaaaagctaggcttgccaaagaaagattcaagttagtcgctacagacatccggaaagagtgtgccgagttacgagaagaaaatacggctaccgcaagagcccttgaacaagaaaccaagagggctcgcaaggaagaacatggccgagacaaattccgtggagctttgtgggcagagttagctgcttgctcaaggtccaagagaagcttgtctcagcgtttatgcgagacagagaccaacatgatagccatcgttagcaagtaccaagaagaattaaatctagccacagcccacgagcataaagtggcggacgagtatgcccgagtgtacgcagaaaaggaggctagaggaagg

SEQ ID NO: 29119 - DNA, 216 bp, Glycine max
  Peptide Sequence Number=SeqID_120804
atggaagaagtagaagattcatcacctttctcagaatgcagaaagttaaggttgtggatcagagaagagagttggagtgagaggttgaagataaagagaaagggagtgaaagaaagagagggtttgagtattaataaggaaagcagaacagacagaagagccataaagaaagaaagagagagagaggaagggttgaggtcaaaaagagaaagttaa

SEQ ID NO: 29120 - DNA, 654 bp, Glycine max
  Peptide Sequence Number=SeqID_120805
atgttggtgcgcatgatccgcactcgtctctttgcagcggcacgggtgaaatcttgccccggtatgcatagtagctgtgtgatagcctccctctctggttgtgctcgcacagttggccctcctccaatatcagggggtggcccaggaaccgtgtggatatggagcccactgaaagtgaggacgcgtagccctctaaaggcgagggtgtgtagccttctgaagttcaggacgtgtcgccttttgaaggcgagggagtgtagtcctatgatggcgaggacatgcaatcctctaaaggtgagggcgtgtagccctacaaaggtgaaggtacatgaccctttaaaggcgaggacgtgtagtcctctgaaggcgaggacgtgtagtcctctgaaggtgagggcgtgcagccctctgttggtgaggacgtgtagtcctccaaaggtgagggcgtgtagccctacgaaggtgacgacatgcagtcctctgatggcgagggcgtgtagccctctgaaggtgaggacatgcagtcctctaatggcgagggcgtgtagccctctgaaggtgaggacgtgtgatcctctaaaggtgagggcgtgtagccctacgaaggtgaggacatgcagtcctctaatggcaagggcgtgtagccctctgaag

SEQ ID NO: 29121 - DNA, 213 bp, Glycine max
  Peptide Sequence Number=SeqID_120806
atgtcagtgaaaaaccaagtcgggcgcctacgagtacatgacaagacaaaccacacactagcaagtcaatgttttgcgagaatgctccaaccatatgggatcaacataggcttaaaggagcactcaaaccgggtgacccccaaggcctacactccgaagagttcgttagggcctctccctcctgattcaggtccaacccagaaaacattttag

SEQ ID NO: 29122 - DNA, 711 bp, Glycine max
  Peptide Sequence Number=SeqID_120807
atggctgggtctcctcaggaacaggtgcaggagatggctcatggcttaggaggggtgagctcatcctccccctctgctgttgctgctactgctggctcctcaggagcaggctcttgggctgcgaaggcctcaccccctccagaaggagaaggctgggctcctggccaggccacctgcgcatcaaaaacatccatgctcataatggatggcaagcccaagccctgcaggctctgcatgatgatggactgccccctgtggatgctctggagcatggagtgcagcatttgtggtgtaaatataaagtctgaggatcctgcatataaaggagctggaagaacaaatgtagatgcatatggggtagatggaattggtgctggagccgaggaaggagaaggagctagtgtctctagtgctgttgaagtagtggggacctctgatctcttacccctggctttccttggccctctaaatgtcactgttggatcatcaagattccaacagttcttcttaatatataccaagttaatggcagggctcaagttctctagggatctagaatctgattggactcctctggccttgcatagagctatgatcaaggcagggaatccaagtatggatgtgtcatgttgtgcaatcagagagatctggtgggagatgtggtaccccaagttcatatctgatgtgtcatcattttctcatatttcttaa

SEQ ID NO: 29123 - DNA, 119 bp, Glycine max
  Peptide Sequence Number=SeqID_120808
atgaagactaagaacttgtcacaacagtgttgggctttgctcgtctgcaatgagattatggtactcaaccaagaacctgtcgaaggggacacaacaggcaataatgtcagaaaatcatg

SEQ ID NO: 29124 - DNA, 348 bp, Glycine max
  Peptide Sequence Number=SeqID_120809
atggcttctatggacacctctgctatggtcaactctaagatctttccatgcaatttacgaatacgggggtccggggaatttgtcaccttcttagatacgacatctaggggtagcgaaatgccccaacgcacgtttttaagaaggcgacacggaccctccgttggtttgtttacagtagggatcaagacagaacccatatgcaatgcctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaactttttaagtga

SEQ ID NO: 29125 - DNA, 288 bp, Glycine max
  Peptide Sequence Number=SeqID_120810
atgtctatcaggtgtgatagtcaggcaactttggctaaggcatatagtcaagtgtataatgggaagtctagacacttgggtgttagacacaacatggttcgggagttaatcatgcatgaaagcttaacatgtagagattggaacacatcatcgaaagtactcccaaaacctgaagtattcggttctggcaagaaagaaaaggactaccatataagcatgaagtttagccgcttcaagaagctgagacttggctttgatatgcttatgaaggatagggacacaggctag

SEQ ID NO: 29126 - DNA, 153 bp, Glycine max
  Peptide Sequence Number=SeqID_120811
atggatacctcagagccctacactgggacaatgaaagggaaagaatatcatgaacattgtacatgcattgttgcatacgaagtctgcatttaccgcatttcaagacaaaggttgcatgcatctggatccccaaaaatcatgttaactgcatag

SEQ ID NO: 29127 - DNA, 267 bp, Glycine max
  Peptide Sequence Number=SeqID_120812
atgaacttaatcattgttatcaaaaggaaagaccacgctttacggcgcccttaccgaacccatgctagagctagagtaatgggtgaagtagaggaggtgcaaaagcagatgaagtccgacatggaggccatgaaagagcaaatggctacaatgatggaggccatgatgagcatgaagaagataatggaagccaatgcggttgcaattgccgctaccagcgctgttgctaaggtgaacccgatgccccatctggcctcgaccaaatga

SEQ ID NO: 29128 - DNA, 300 bp, Glycine max
  Peptide Sequence Number=SeqID_120813
atggctggagtgacaaaggaggacgagtcgggtagtcctagttggggtgcttcattttttacacagacaacagaggatgtggctagagctgttgctgctgcaatgaattctccgaggccatctgtgagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 29129 - DNA, 660 bp, Glycine max
  Peptide Sequence Number=SeqID_120814
atgtccaaatcttttgaatttgggatgaccggctctctcgatgagtcgatctcttgctttctcataaggatggaccctcggagggctgcacgccctcaccttcagaggactacgtgtcctcactttcagaggactgcatatccccaacttcagagggctacacgccctcgccatcagaggactgcatgtcttcaccttctagggctacacgccctcacctttagaggactacacgtcctcgccaataaagggctgcacgccctcaccttgagaggactacacgtcctcgccaacagagggctgcacgccctcaccttgagaggactacacgtcctcgccaacaaagggctgcacgccctcaccttgagaggactacacgtcctcgccaacagagggctgcacgccctcaccttggagaaggctacacgtcctcgtcaacagaggactgcacgtcctcaccttgagaggactacacgtcctcgccttgagaggactacacatcctcaccatcagagggctgcacgccctcacctcatcttcagaggactacatgtcctcaccttcagagggctacgctccctcgccttcgtagggctacacgccctcaccttccgaggactacatgtcctcaccttcagagggctacgcgccctcaccttc

SEQ ID NO: 29130 - DNA, 489 bp, Glycine max
  Peptide Sequence Number=SeqID_120815
atgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgatacgcggagataccttacggttatccgcacccttttaggcggcgggcccgatgacaagcagagaccaagtttgtcatttgcaccttgtatcatccagagcgcgggcccgatgatacggagatacttacggttattcgcaccttttgtcatccagagcgcgggcccgatgacaacagagaccaagtttggtcattctgcacccttgtatcatccagagcgcgggcccgatgatacgcggaatacccgagtggttatccgtatacattcttttgctatctgtaagacagacgcttga

SEQ ID NO: 29131 - DNA, 684 bp, Glycine max
  Peptide Sequence Number=SeqID_120816
atgcaagatgtcaaaaccattgtggtccctccgccacaaatggtggccaatatgcgtatcggcaatatggatggttactgtgtgggtgaaccatggaatgcgcgtgcgatttacgacaaggttggttactcagtagccacctcacaagacatctggaccgatcacccggaaaaagtattgggcaccaccgccgagtttgtggccaaaaacccgaatacagcactggcactgaccaaagccattctggaggcttgccgttatatcgatgccaccaagaaccgtcctgaagtggccaagctgattgcaggcaaagcctatgtgaatgccccggaagaagtgattgaaggccgcttccttggccattacgacaatggcatcggcaaaaaatgggaagaccccaactacatgaagtttttcaatgacggcaaggttaacttcccttacctgtctgatggtatgtggttcctgacccagcacaaacgttggggcttgctgaagtctgaccctgactacctgggtgtggcgaaaaaagtgaaccgcatcgatatctacaccgaagcggcgaaatctctgggcattagcgtgccggccgacgtcatgcgtactagcaagctgatcgacggtgtggtgtgggatggcaaggatcctaaagcctatgccaacagctttaaagtgaaagcctaa

SEQ ID NO: 29132 - DNA, 685 bp, Glycine max
  Peptide Sequence Number=SeqID_120817
atggatggtcgtttctccgtggagcgacgcgtacagctcagggacgacgagtatactgatttccaggaggaaatagggcgccggcggtgggcaccactggttactcccatggccaagtttgatccagaaatagtccttgagttttatgccaatgcttggccaacagaggaaggcgtgcgcgacatgagatcctggggccaggaatgcgagtatggccagaggaggaaccggtctgatgggttcgatgaggaggccatcgcccagctgctatgtataccggggcaggattttgcccggactgctgcagggaggcgagtgcgaatcatgcgcaccaatatgaccaccctgacccagatatggatgacgttgctcctcagcaacatcctgcccaccgatcataattccgacctccccatgcctaagtgccagctggtgtacgccatcctgacacggatgagcatccatgtggctcagttgatcgctgatgccatctatatttttgcaggtatggcgcccactaggcaccctttggacccagataagtccaacagggccctgggattccccgaactgatcacaggactctgccagtcgttcggagtccccgttgcacctaccaaggtgattcggccgcccatcacccgggcttttattgagaagtactgtacccagagacagggtcagg

SEQ ID NO: 29133 - DNA, 663 bp, Glycine max
  Peptide Sequence Number=SeqID_120818
atggatcagaagggggggctgggttctatttccgggccgggcgggaggggagtttactcaacccattccccagtcttccgcactgctcaagtaagtgtgcgactccgtatgaggacctccttcccttctgcccactctccgttcacacggttctcaaagcagaggaggaagggtgggcagcaggtaccacgagccctctgtcccacacatctatccagaagcaagtgtagttcaccggttccaccgaatgctcctatctctcggcaaagatcgtgtgagtgtgcagttatgcttcggatgcttcgccatagaatagatcgacccagttcccgttcttttccggtgcactcgctttatatctccgacacacaaggaaggacgcggtgggaaggaagcagccctagcctctgtccggccgatcattccgctggcatcttgcattcacgcctccgtttgactgccgctcggggatggagttgtagatacgttagtcttagcggatcgttggctccacctgttatctccttctacgacatgctgttgtcgtcgccatattccatatgtaacttagtcatctctgcctcgctgcgggtcagcacctccgaaagaaacggaggacttcattcagtgactccgcgatcgccctctaaacgatcagaataa

SEQ ID NO: 29134 - DNA, 462 bp, Glycine max
  Peptide Sequence Number=SeqID_120819
acagccaaaaagaatggttatacggataaccactcgggtatttccgcccgtcagcgggactcaaatgtcagtattacagatcttgtgagcgcggaagatgacacagcaaaaaagaatgtttatacggatgaccactcgggtatttccgctcatcagcgtgactcaaatgtgagtatgacagatcttgtgagcgcggaagatgacacagcaaaaaagaatgtttatacggataaccactcgcgtatttccgcccgtcaacatgactcaaatgtcactatgacagatcttgtgagcgcggaagatgacacagcaaaaaagaatgtttatacggatgaccactcgggtatttccgctcatcagtgtgactcaaatgtgagtatgacagatcttgtgagcgtggaagatgacagttcaaacaagaatgcttatccggataaccactcgggtatttccgaccgttag

SEQ ID NO: 29135 - DNA, 351 bp, Glycine max
  Peptide Sequence Number=SeqID_120820
atgactgaagcacgtcaaaaggggctgaaatacatcaccaggggatccgagacccttagagcagcccccttcagcctatttataggaaaaagggggaggaggttgccgcccagctcgcccaggcgagctgggttgcttcctccaaaagcaatccagcttcaaaaatactctgaaaggcccaatttcaaaaattcaaaatttctatttgcatcccccatttttgataaaagcattacgggtgtcccagacgagggaggtggttgccacctagctcgcccaggcgagctcggttgcttccaccttaagcaagaaattgcccagaaacctctatttgcacccccattttactaa

SEQ ID NO: 29136 - DNA, 462 bp, Glycine max
  Peptide Sequence Number=SeqID_120821
atggtaatcgattaccagagagtaaaaactctttgctttgcttctacactagagacacctgtggtattagctaagggagaaactctacccgtatactccttgtcataccctaatttcgtccggggactattgcttgatggcatgcaacctttgattgaccgcttcgaagtacttggcaccctttgttgcacaatatgtgaagtccagagacgcgccggaattcaaaaggaagcgtggcccacttgggccttccagattcttcctcagaaggcgattgcttttggaggaagcaacctggctcgcctaggcgagctgggtggcaagctcctcctctattttgctataaatagggggaggaatgaagaaggaaggggttcagccttcttggcacttcgtattctcttgaatttgctgaggaaaattgtttccgtgaagaaaatccaagctgaggcgcttccgtaa

SEQ ID NO: 29137 - DNA, 438 bp, Glycine max
  Peptide Sequence Number=SeqID_120822
aagctcctgtctgagaagacaaagaagaagctggaggaagctgcacagtcaggaagcgttgatggtgtcatcgaccctctatccccggtcagaagccacgtgaagtggatgatggcccgcacaaagaaaataggcgagatgacgactgaggccgcaaaggaaatcgctgagaagattgattcctttgaggagcaggccacacagggatccttcatcccccatggacgtcaggatgttctcgccactgctattggacgtccagagcaccctggacgtgtccgtgctgttggagtcagtgtcaccatcaagaaatactttggatcggctccacggatgtcccacatctcttcctccctgtctcctgaagaattgcggcagctgacccagcaaatcagggacaagctagaggagtccatcacagagagagtgacacgatag

SEQ ID NO: 29138 - DNA, 303 bp, Glycine max
  Peptide Sequence Number=SeqID_120823
atgggtctgaaatctatcctaaggctcatgagaatccaagggccttctcttacatctctgacccaatcttcttggagtcttctatctaatgaatgcccttggggggtaggattgcatcatgttaagctagagcttctagtgattagacttgatgtacatttccattctatctttccaattaggatagtcttctcctgtgaagcctggtggccttgtgagagagaccccctcaatgatgaattgaccgttgttgttgttattttccatcaagatcttttcctcttgacattgttaggtgcttaa

SEQ ID NO: 29139 - DNA, 528 bp, Glycine max
  Peptide Sequence Number=SeqID_120824
atggataatgaagagggcgtgctggaacagatgaaggccgatctatcggccttaaaggatcaaatggcttccatctcggaggtcatgttaaaactccagaaaaccatagaggataaagccactgcaactgcctccagtacagttagggaagtggagccggtgctgcagcccgccttgaatccgggcctagacagaaacacggtcgtgttcggtcgaaggtatagtccgcaagcttatccttatggcctgcctccggacttcaccccctgtgccaccccggaagatttaagccaagcccctactttcgaggggcaactcccaccttatgaagactatcccgggcaagatgatggggaaggagatacccatcctggccccctgctccacctcaaagatccgtccccgcatgaactaccccaaccgaacatagttcgtcataccccggcctcacccacactcgtaaaagaatctgtttccttggcggaagataggggaaagattgaggcgcttgaagagaggttgagggca

SEQ ID NO: 29140 - DNA, 939 bp, Glycine max
  Peptide Sequence Number=SeqID_120825
atggccccgaggaagcttgcctcaaagaggtccaggaaggacaaggcggccgaaggaactagttccgccccggagtacgacagtcaccgctttaggagcgttgtacaccagcagcgcttcgaagccatcaagggatggtcgtttctccgggagcgacgcgtccagcttagggacgacgagtatactgatttccaggaggaaatagggcgccggcggtgggcaccactggttactcccatggccaagtttgatccagaaatagtccttgagttttatgccaatgcttggccaacagaggaaggcgtgcgtgacatgagatcctgggttaggggtcagtggatcccgttcgatgccgacgctatcagccagctcctggggatatccgatggtattggaagagggccaggaatgcaagattttgcccggactgctgcagggaggcgagtgcgaatcatgcgcaccaatatgaccaccctgactcagatatggatgactctgctcctcagcaacatcctgcccaccgatcataattccgacctccccatgccgaagtgccagctggtgtacgccatcctgacacggatgagcatccatgtggctcagttgatcgctgatgccatctatatttttgcaggtatggcgcccactaggcaccctttggacccagataagtccaacagggccctgggattccccgcactgatcacaggactctgccagtcattcggagtccccgttgcacctaccaaggtgattcggccgcccatcacccgggcttttattgagaagtactgtacccagagacaggctcagggtgatgctccacaggccgcaggcgcgcccccaccacctcatcaggcgggccaggctggggcatttgacatggagcagtatttacggcatttggttcgccagcaggcagccaaccaccgagcacat

SEQ ID NO: 29141 - DNA, 361 bp, Glycine max
  Peptide Sequence Number=SeqID_120826
ctgttataaaacgtatttggccactagtaatcgattacatcctctgaacctgtcgcctttagaaggactacacgtcctcacctttcaagggctacatgtcctcgccattagaggactacacgtccccacattcagaggacttcacgtcctcaccttgagaggactacacgtcctcgcctttagaggactagacttcctcgccttcagaggacttcacgtcttcaccttcagaggactacacgtcctcgcctttagaggactacacgtcctcacctttagaggacttcacatcctcacctttagaggactacacgtcctcatcttcagagggcttcacgccctcgccttcagaggactatac

SEQ ID NO: 29142 - DNA, 174 bp, Glycine max
  Peptide Sequence Number=SeqID_120827
atggagcagaatcgtctcaggccacggttagaagtcaagacaagtcaatggcagaaatcaaccaaggtacttagggatagaggcaaatggaggatagggtcacggccgaccgttgttttgtccgcgggtttgaaaaaccgagaacgaaagaaatggcagcccagtatcctttga

SEQ ID NO: 29143 - DNA, 324 bp, Glycine max
  Peptide Sequence Number=SeqID_120828
atgtccaaatcttgtggatttgggatgaccggccctctcgatgagtcgatctcttgctttctcataagggtggacccttgggtacttgtacctatcacctttagaggactacacgtcctcgccttgagaggactacatgtcctcgccatcagaggacttcatgtcctcaccatcagagggctgcacgcccttacctccagaggactacatgtcctcgccttgagagggctacacgccctcaccttgggtactagttaccctcatcgtcagaggactacacgtcctcgccttgagaaggctacacgccctcacctcgggtactag

SEQ ID NO: 29144 - DNA, 172 bp, Glycine max
  Peptide Sequence Number=SeqID_120829
tgatcaaagggttcccacgaaccctaagagaataaaggtcattcctgagtggcctactccaccaagtgttgagggaagaagcccagagtttcaagaacctctggatttgaggtcaaattcttttcaagggggagggaatgatgcaatcctaacccctaaggacattggatag

SEQ ID NO: 29145 - DNA, 459 bp, Glycine max
  Peptide Sequence Number=SeqID_120830
gaccctcaaggcaatcctccattctcaccctttttcggagccccatgaatgtcatttcctagcgttgttcatttgtcctcctttatcaagcgcaaagcctctggtgactgggaagcacaagaaaaaagaaggagtagagacgagagtcatcatcacggaaagggcagggcggacgaaatcagtgtcctatctttgctttcctcttatctccgatgagaggcttgcgcgatccgtgaaattccgtaatgtggcggaaatcgaaaagagacccacttgggccctccagaagattcctccagaaggccgttgcttctggaggaagcaaccttgctcgcctgggcgagctggaaaatccaagccgagacgcttccgtaacgtttccgtgagtaattacgcgaagattctcgaccgttcttcaagattcatcgttcgttcttcgtttccttcagtcttcaacgg

SEQ ID NO: 29146 - DNA, 495 bp, Glycine max
  Peptide Sequence Number=SeqID_120831
atggtgggttacacaccttcaagctttgcggatttggtcttcgctggcgaaatgatcgaagtgggtctaaaaagaggcaaatctgataatcatgccttgataaattcaaaaaaaaaaactagggcaagtgaagagggtgagaatgagggagaaacgcatgctgtgactgccattcctatacatccaagtttcccaccaacccaacaatgtcattactcagccaataacaaaccttctccttacccaccacccagttatccacaaaggccatccctaaatcaaccacaaagcttgtctaccgcacttccaatgacgaacaccacctttagcacaaaccaaaacaccaaccaagaaatgagttttgcagtggaaaaaaaacctgtagaattcaccctgctaggtttcctcaacctccatttttccgaggatacgactcgaacgcaatgtgtgcttttcatggagaagccccggggcattccattgagcactgtatga

SEQ ID NO: 29147 - DNA, 621 bp, Glycine max
  Peptide Sequence Number=SeqID_120832
atggttaaggaggagtgtaaggaggtaagtgtcttcttcaagaggttagctaagaaggaaagtcattttgtaataaagacaaacattaaagaaacataccttcttagacaacctccacatcttgtcctttgtaaaaagacacttgtcagcactgccacacctcttcggcttgaggttattcctcatgtaaatgagttattggatgaaggtttggttcgtaagagtttaaatccttgtgctctgttggttccaaaaataggtattattaggcaccaaatcccaaaaataggtgatttgatgaatgtgttaagtggtgcaaccctcttttgtaaaatcactcatgcacccaccatcttcatgatttgtgtacatagggactcattaggtagtgatcaagaggttcccacataccctaagagaataacggtcattcctttgtggcccaccccatcaagtataaggaaaatttggggcttccatgacttaacaaacttttacaaaaggggagggaatgatgcaatcctatccccaagggcattggatataagactcaaggaagattgggtcagagatgctaaagaaggtcatagggttctcatgaaacttagggtagatttctga

SEQ ID NO: 29148 - DNA, 483 bp, Glycine max
  Peptide Sequence Number=SeqID_120833
atgtctaatgcatggactgatcggaaacaaagatgcatcattaattttttgcttaactctcaagctggtacaatgtttttgaagtctattgatggctctgattttgtgaagacagaaaggctccacaaagagaaagctaatattataaagatgtttatttctgatgaatggatcttaaacaagttatctaaggagcctaaggggaaagaagctgcaaaggtagtgctcatgccttcttttggaatagtgtggtttacactcttaaagtcatggctccacttgtcacagtgcttcgtcttatgggtgatgaaaggaaaccagccatgggctatatttatgaagcaatggacaagacaaaagcaacaattatcaagtctttcaacaacaacgaaagcaagtacaaagatgtgtttgcaatcattgataaaagatgaaattgtcagcttcataggccattgcatgcagctgcgtgggatcctctag

SEQ ID NO: 29149 - DNA, 138 bp, Glycine max
  Peptide Sequence Number=SeqID_120834
atgactcatcagggtttccaagtttatgccattattccattggtttgtttgctcaagcgacctgcgctcttgagtgttgacttccaagactgttcaatcagagattactcgtctgcacgtttggtgggggtgccgtaa

SEQ ID NO: 29150 - DNA, 183 bp, Glycine max
  Peptide Sequence Number=SeqID_120835
atgaccaagagcaagggcaaggatccacttgaaggacttggaggacctatgacaagagctagagcaaggaaagccaaggaagctcttcaacaagtgttgtccatactatttgaatacaagcccaagtttcaaggagaacagtccaaggttgcatcagccttttgggagaccaatggtggctga

SEQ ID NO: 29151 - DNA, 255 bp, Glycine max
  Peptide Sequence Number=SeqID_120836
atgtgtccagctcaagacgttaaagaagcgctactaggaggcaacctagtaccttttaaatctatgcttgttattcatagcaggacacacctatttgctcatgatcctaagaatttaaataaaacaagcacaagctcggaagaacatcccctttatccccgaaccactggccaaaccctgacatatatcatgaccagccgttctacaagccttgagccaaaatcccaacttatcataaaccttgacccagggtga

SEQ ID NO: 29152 - DNA, 669 bp, Glycine max
  Peptide Sequence Number=SeqID_120837
atgaaacccccagatgtccaagaggatcacatatttctgaaggcttttcctcattcattagagggagtggcaaaggactggctgtattaccttgctccaaggtccatcacgagctgggatgaccttaagagagtattcttagaaaaaattttccctgcttccaggatcacaaccatcaggaagcatatctcagcaaccctagagcaattgagcagcctgaagctttatgctgcaaatatttacaatagacctcctcaacctcagcagcaaaatcaaccacagcagagcaattatgacctttccagcaacagatacaaccctggatggaggaatcaccctaacctcagatggtccaaccctcagcaacaacaacaacagcctgctccttccttccaaaatgctgctggcccaagcagaccatacattcctccaccaatccaacaacagcaacaaccccagaaacagccaacagttgaggcccctccacaaccttccctcgaagaacttgtgaggcaaatgactatgcagaacatgcagtttcagcaagagaccagagcctccattcagagcttaaccaatcagatgggacaattagctactcaattgaatcaacaacagtcccagaattctggcaagctgccttctcaagctgtccaaaaccccaaaaat

SEQ ID NO: 29153 - DNA, 519 bp, Glycine max
  Peptide Sequence Number=SeqID_120838
atggtggttcgagccttcaacggtagtaggcgggaagtgatgggggaaatcgacatccccattcagataggcccccacacttgcaatgtggtttttcaaaaattgaagttcgcggttggtggacttttggtgatagtgtcaggcgaagaggatatgttggtgagctgcccctcctccgcaccatatgtagaagcagcggtagaatctttggaaacagctttccaatccttcgaggtggtgagttgtgcctctacggaaacgagcccgttgctaccttctctctccaatgcggccataatggtggcacgggtgatgctcaagcacggatatgagcccggaatgggtctgggcaaggacggcctcgggaatgccgacgtggtcgatattagaggaaacccgtacaaatatgggttggggtatgaacccgggatgctaggaaggagaaatgcgccatcaagattccgggcggatagggatggcccgaccatgttagccagtgtttcaccagtgccggaataa

SEQ ID NO: 29154 - DNA, 486 bp, Glycine max
  Peptide Sequence Number=SeqID_120839
atggtgggttacacaccttcaagttttacagatttggtcttcgccagcaaaaagatcgaagtggatccaaaaagaggcaaatttgatcatcctactaggacgactgagaaaactggggcaaatgaagagggtgagaaagagggagaaacccatgctgtgactgccattcctatacggccaagtttcccaccaacccaacaatgtcattactcagccaataacaaacctcctccttacccaccacccagttatccacaaaggccatccctaaatcaaccacaaagcctgtctaccgcacttccaatgacgaacaccacctttagcacaaaccaaaaaaaacaccaacaaaaaggaattttgcagcaaaaagcctgtagggttcaccccaaattccgttgtcatatgctaaacttgatcccatatctacttgataattcaatggtagccataaccctagccaaggttcatcaacctccatttctctga

SEQ ID NO: 29155 - DNA, 781 bp, Glycine max
  Peptide Sequence Number=SeqID_120840
agtgctacacgccctcgccatcagaggaccatacgtcctcaccttcagagggctacacgccctcgccatcagaggactgcatgtcctcacctttagagggctacacgccctcgccatcagaggactgcatgtcctcaccttcgtagggctacacgccctcacctttagaggactacacgtcctcgccaacagagggctgcacgccctcacctttagaggactacacgtcctcgccaacagagggctgcacgccctcaccttgagaggactacacgtcctcgccaacagagggctgcacgccctcaccttgagaggactacacatcctcgccaacagagggctgcacaccctcacctccagaggactacacatcctcgccttgagagggctgcacgccctcacctttagagggctacgtgtcctcattttcaggaccagtagtttccttttaacggttcctgggccaccccgtgatattggaggaggcttgagaggactacacgtcctcgccaacagagggctgcacaccctcacctccagaggactacacatcctcaccctcagaggactgcacgccctcacctttagagggctatgcgtcctcattttcatttttgggccaccccctgatattggaggagggccaactgtgcgagcacaaccagagagggaggctatcacacaactactatgcatactagggcaagatttcacccgtgccgctgcaaagagacgagtgcggatcatgcgcaccaacatgaccactcttacacagatatag

SEQ ID NO: 29156 - DNA, 317 bp, Glycine max
  Peptide Sequence Number=SeqID_120841
aagcctttgtatacagggtgcaagaattccttaaccctgttgtctgcggtgttaagtctgccaatcaggatggtgtggacaacactgtctgtgagaaatacgacataagcaaggaaaaatgggcccagttttgccaaacttgcagagacccttcttgggaggatgtgcggaaaaaggcaaagcataagctcctggctgagaagaccaggaagaagctggaggaagctgcacagtcaggaagcgttgatggtgtcaacgaccctccatcccccgtcagacgccacgtgaagtggaagatggcccgcaccaagaaatag

SEQ ID NO: 29157 - DNA, 744 bp, Glycine max
  Peptide Sequence Number=SeqID_120842
gattcctttgaggagcaggccacacagggatccttcgtcccccatggacagcaccctggacgtgtccgtgctgctggagccggtgtcaccatcaagcaatactttggatcggctccacggatgtctcgcagctcttcctccctgcctcctaaagaattgcagcagctgacccagcaaatcagggaccagctagaagagtccatcacaaagagagtgatgcggcaggtcatggcatccttcagccagatgcagtcccagcttcagtcacagatgcaatctcagggacttgtagtgcctcctgaccctctggttggtccctccggtcctcgagtgagcacaaaggggagttgtgttgatccctcaggaaacaatcttgagacgggtgactctgataggtgtggcttgtatatagaagcagatcctgccctcctggttgccatagggagagtttatgagggatccactattgttcataacactcctttgttgcctggccaagtaaaggtgagtgtggaggaggttacagatgcagatgctccagttcctgtacccactgatgaggtttccttagtggggcaggcacttcacaccttccttgcttggccgacacatctggtcaagtctttttcacagcaggtagttgtgtctctggcaaaaccacctccaaagcctgatctggaggtcgatgatccgctttatctgatgacatcgaccatcccagagcttttcttgaggccttatcag

SEQ ID NO: 29158 - DNA, 249 bp, Glycine max
  Peptide Sequence Number=SeqID_120843
atgacaaatgcgggaatgatatgtccattgcgatgccatgaagagatgcatgatgcaatcaatgaatatgccagacgacaatgcatcactaaaagaggaaaactttatatgaggtttcactgtcatcaagcgagtcagagactcagcatgaccacagatcgacctccactccttatggctcacatagacctgggtgtagggcctaatatctcaatgtgtgtgcgaggtgtaggtgtcatgtgtgcgtag

SEQ ID NO: 29159 - DNA, 810 bp, Glycine max
  Peptide Sequence Number=SeqID_120844
atggccatccacgaacatatacgccaggatggcgaaaaagagatggagcgcgatgctatggccctcttctggtcggctatcgctgcgggtctgtcaatgggggcatccctgctcgcaaaagggatatttcatgttcagctggaaggtgtgcccgggggctttttactggagaacctcggctatacctttggctttattatcgtcattatggctcgccagcagctgtttaccgaaaacacggtcaccgccgttctgccggtgatgcaaaaccctaccctcggcaatttcggtctgttaatgcgtctgtggagcgtggtgctgctgggcaacatcatcggtaccggcatcgcggcctgggcgtttgaatatatgcccatttttgacgaacccacccgggacgcatttgtgaaaatcggtatggacgtgatgaaaaacacgcccgtcgaaatgttctcaaacgccatcatctccggctggattattgccacgatggtctggatgtttccttctgccggtagcgcaaaaattgtggtgatcatcctgatgacctggctgatcgccctggccgacaccacgcacattgtggtcggtaccgtggagatcctctatctggtctttaacggtacgctgcactggagcgattttttctggccgttcgccctgccgacgctggcgggaaatatctgcggcgggacgtttatcttcgcgctgttaagccatgctcaaatccgtaacgacatgtctaacaaacgcaaagctgagcgtaaggcgcgggaaaatgatgataaatcgacaaaaaaatcgacctga

SEQ ID NO: 29160 - DNA, 617 bp, Glycine max
  Peptide Sequence Number=SeqID_120845
acgtccggaaagagtgtgtcgggttacgagaagaaaatgcagctaccgcaaaagcccttgaacaagaaaccaagagggcttgcaaggaagagcatggctgtgaaaaattccgtagagcattatggggcaacaacagtgagctcaagcttcgtagggaagagagagaccgatcaagagcacatagcatggtcttaaaagaagagttagccgcttgctcaaggtccaaaaggaacttgaatcagtgtttgtgtgagacggagaccaacatgttagctatcatcaccaagtatcaagaagaactaagcctagccacgacccacaagcatagggtagcggacgaatatgcccaagtgtacgcgaaaaaggaggctagaggaagggtgatcgactcgttacaccaagaggcaaccatgtggatggaccgatttgctcttaccttgaacgggagtcaagaactttcccgattgctagccaaggccaaagcaatggcagacacctactccgccccggaggagatccatcagacttctcgactattgtcagcatatgatagatttaatggcccatataattacgaaccgctagggaacttgtattgtcactcagatcttgactag

SEQ ID NO: 29161 - DNA, 281 bp, Glycine max
  Peptide Sequence Number=SeqID_120846
ctctggttacggcctctgtagtcctacagggtgcctgttccctccggcaaggtcacgtcatcatgacatagctctaattacgggtctctgtcagttctacggaatgcctgtcacctccagcaaggtcatcaagccccctactaatcgagttttcatcaagaagtactgcgtccccaggcaggcgcagggcgaaacaccacagcagcctggggatggccggcagcgggcaacagacgcaccgccatcacctctagagttcacctcagctcatccacaaaaag

SEQ ID NO: 29162 - DNA, 504 bp, Glycine max
  Peptide Sequence Number=SeqID_120847
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccaagctcgaccccgtgatttcccagatttttctctctcagatgagttcatcctttacaagggcgccatctggattaatcctaggaatccgctcatcccggctttgctacacgaataccactccactcccctcggtggtcactttggtataaagaaaaccttgcatcgtctccgttga

SEQ ID NO: 29163 - DNA, 243 bp, Glycine max
  Peptide Sequence Number=SeqID_120848
atgcattctcttgatttcaggattgtcatcatcaaaaagggggagattgtggaagcaatgtcttccaaggttattttgatgatgccaaagaatcaagagtcaagcaaaatccaaagattcaagaatcaagtttcaagattcaagattcaagaatcaagtgtcaagaatcaagattcaagaataatcaagatcaagattcaagactcaagattcaagaaacaaggaaagactcaatcaagataa

SEQ ID NO: 29164 - DNA, 247 bp, Glycine max
  Peptide Sequence Number=SeqID_120849
atggctgaagaggcaaggagagtgacccttgaagattactcaagttcaatggttgagaaatttctgaagaagtatttcccagagtttaagactgcagaaggaaaaacaaccatctcttcttttcaccaatttctagatgaatccctgagcgaggccttagaaagattctgtgacgcttctgctgggggaaagataaagttgaaaacccctgaagaagccatggatcttattgaaaatatggctgcaa

SEQ ID NO: 29165 - DNA, 426 bp, Glycine max
  Peptide Sequence Number=SeqID_120850
atggcgagggcatgtagccctctgaagctgaggatgcgtagccctctgaaggcgagggcgtgtagccctctgaaggcgaggacgtgtagccctacgaaggcgagggcgtgtagccctctgaaggagaggacgtgtagccctctgaaggagaggacgtgtagtcctctgaaggtgaggacgtgtagccctctgaaggcgaggacgtgtagtcctctgaaggtgagggcatgtagtcctttgaaggcgagggtgtgcagccctttgaaggcgagggcgtgcagccctctaatggcgagggcgtgtagcccttcaaagattgactgtccttttgaaagaggtgataattcatgcaaccttatcgtatcttttgcaaatctctctgggaactccctcagagtgtatgttctgtttgatttaaacacttga

SEQ ID NO: 29166 - DNA, 186 bp, Glycine max
  Peptide Sequence Number=SeqID_120851
atggctcccgttgtgtgtgctgttgctattgctgctgttgtggaccgggaccatacctcaagttcgaatgatctctccaaccatgattataggtgttggagtaaggattatattgctgttgttgagaaacatcaacaacattttatgttccctggagtgtggaacatgcatctgttggatgattag

SEQ ID NO: 29167 - DNA, 498 bp, Glycine max
  Peptide Sequence Number=SeqID_120852
atggtggcacgggtgatgctcaagcacggatatgagcccggaatgggtctaggcaaggacggcctcaggaatgccgacgtagtcgatattaggggaaatccgtacaaatatggattggggtatgaacccgggatgccgggaaggaggaatgtgccatcaagattctgggcggatagggcatggcccggccatgttagcctgtgtttcaccagtgctggaataatgtttgaggaagaggtggcagcaatcggagaggagtgccctcaagacccgccaagtttcgtgcggccatgccatcccgattcccaagtggggaactggcgcatgataagccaatcagaggtctataccgctgattcaatatatgagggtcgattctttgaggatcctaatgacgagggtttgacaatcgatttcgaccgatatgtaagccaaacgatgaacgaagaagtggaagaggacgtcctttcaccagagttggagaggttgatcgcttag

SEQ ID NO: 29168 - DNA, 687 bp, Glycine max
  Peptide Sequence Number=SeqID_120853
atgagtcatggcccgagaagaatgagaagaaaagctataaagaaagaagatccaagaaggcgtatattgcttgggatgacaatgactcatccgatggtttggagaaggagatcatccttctatccaaggactatgaaagtgatgagaacatctctcaagaagtttaaattaaaacttccaaaaacacctccaaatggaagaaccatcgaagaagcaaaagggggttgcaacttcatccgcagtcactggaactcgaagccacggaacatccaaagcgcagacatctcaaattcctccctttcctatgttgttttcctcggaagaacaatgtattcgtttatctccatgaaactaactttttaccctgaattggttaaagctttttattctaacttggaaattcaagaagattccttcatttccgaagtttatgggattaagatggtcatagaccagtcccttttctttgaactcactcaattatccagtgacgacataccatttgagggtacacttgatgatgagtggaagtttgatttttctgtgtctaatgcccgccggatggtttgcaccaaccaagcggatatggatggaaggcttcttgccagttcattggcattcgaatgccgcatcatgcactacttgattgtgcacatcctactccctagatcttccaaccttgcacag

SEQ ID NO: 29169 - DNA, 297 bp, Glycine max
  Peptide Sequence Number=SeqID_120854
atggcttcgaggaagctttccgcaaagagatctaggagggacgccacggccgaaggaaccagtgccgctcccgagtttgacaaccatcatttcaggagcgccgagcacctgcagcgtttcgaggccatcaaaggatggtcgttccaccgagagagacgcgtcccgctaaggataggcgtgcgggacatgcggtcatgggtaaggggccagtggattccttttgatgcagacgccctcagccagttcctgggtgacccgctagtgttagaggagggccaggagtgcgagtttagctag

SEQ ID NO: 29170 - DNA, 612 bp, Glycine max
  Peptide Sequence Number=SeqID_120855
atggatgagaagagaaagaaaaaactagaggaagctactcaatccggaagcactgacatcgtcattgatccttcatctcccatcaaacgacacgtgaagtggaagctagcccgcaccaagaaaactagtgacatgacatctgaagcagcaaaggaaattgctgacaagattgatgcgcttgaggagcaggcctcacagggttcctttgttacccatggacgtcatgatatactgactgctgccattgggcgaccagaacaccctggtcgtgtgcgtgctgtaggagccggtataaccatcaaacaatactttggatcagcttcaaggacctccttcattgctctcgaatacttgcaacagttgacgcaacaaatcaaggaccaactagaggattcaatcacagaaaaagtcactcgacggctaatgttatccctcagccaaatgcaatcacagggacttgaactgcctcttgaacctgatgttggtccttcagctgctcgtgtcagcacaaaggagagttgtgttgatccctcaggaacgatccagacacgagtgactcatacaaatgcgggttgtatattgaagaatatcctcctcgcctggttgccctag

SEQ ID NO: 29171 - DNA, 240 bp, Glycine max
  Peptide Sequence Number=SeqID_120856
atgcagtatctaggaagtgatcctaggtcgtctcccaacgagcaatggaataatcaacatgaaaataaagaaaaaggtatgttttattccactactttccttaactttttaaatagtgaccaacggcttcccatggaccctaagagaataaaggtgttgaggaaagaatccctgagtttcaaaaacccttttcaagggggagggaatgatgcaatcctactccctaagggcattggatag

SEQ ID NO: 29172 - DNA, 510 bp, Glycine max
  Peptide Sequence Number=SeqID_120857
atgcatagatctcccacaggcaacctagttcctctggacttggagattgaagccaccttaagaaggaacagagccgggaggagaaggaagttgttgcaagataggacagtagcttctattctagaagaagaagctcaatcttttgactctacatcatctgattcactatcatcaagggaatcagctatatacttactagaagcctctgtcatggctgatgaacaccagcaaagggttacccttgaggattattctagtagctcagtgtcgcaattctttacaagagaagccaagaagtggctccattcattcaaaggtaacagtctggagacgtgggagcaagttgttgagaaagaaagagaaaagaggaaagaaaaagcttcagataagggtatggaagtgccatatcctgtggtacagtccaagaaagataaggaccgccatctggcgagattcctagacattttcaggaaactggaaataactatgccctttggagaagctttgtag

SEQ ID NO: 29173 - DNA, 210 bp, Glycine max
  Peptide Sequence Number=SeqID_120858
gatgattcacgtagacatagccccggtaacagttcaagaaatagccgtggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 29174 - DNA, 315 bp, Glycine max
  Peptide Sequence Number=SeqID_120859
atgaggaggccgtggaccgtgaaaacatgctgcgggtgttccgctcgtttctggatgccaaccagctggaagcggattgggagagtgtggaaagggccggcaaccgtgttctgtaggatcgccgccatggacgacaggatgaacaacgtcgatccgaagcttctcgaattgcttgtctgccctttgacgaagggccgcctttcctatgaccgtgcccgcaatgaactcatctccgaaaatgcgcggcttgcttatccaattcgtgacggtgtgccgatcatgctcatctcggaagcgcgtaaaatagaggactaa

SEQ ID NO: 29175 - DNA, 207 bp, Glycine max
  Peptide Sequence Number=SeqID_120860
atggatgtgaagagcgatttctggaatgcgatgaatgaagaagtctatgtggagcagccaaagggtatttgcagcccgactcatccaatcttatacagagaaggctctcatggattgaagcaagctccaagaagcagaactaacagtgttccctatctacagcagaagccgagtatattgacaggaagcagctgttcacagacctag

SEQ ID NO: 29176 - DNA, 189 bp, Glycine max
  Peptide Sequence Number=SeqID_120861
atgccgatctccccctgcgaaagtatcggttggtctgtgccatcccgacataggggtcgcgcccacaagacacccagtggacccggaggagcccaacagggccctggggtttccagctctggttacgggcctctgtcagtcctacagggtgtccgtcccccccaacaaggtcatgccatcgtgacatag

SEQ ID NO: 29177 - DNA, 324 bp, Glycine max
  Peptide Sequence Number=SeqID_120862
atggacaacgtcgccggggatttgccggtgaaaggggatgccggcagcgctaaagcgctgctgcacggggggatccccggccaggcctgggagacgctcagggcggtaaaaaacggcaaggttttctcgacgccgatgggcattcataactgggggggcctgtcggcggaaacgtcactgctgccgctgtttatgatcaaccgctatgcccctgaagacattagcgacaagacgctgcgggaggagacgcgccgctattatcagacgatgttctcctatgcgatcccggaccgtttgttggatgaggtgctggcacagcgctag

SEQ ID NO: 29178 - DNA, 447 bp, Glycine max
  Peptide Sequence Number=SeqID_120863
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcatagcattgcagaagcgcttcttacactatataaaggttgctaagggacaagttcccgacagtaataacaagaaagtcgggaaacctgtcgtgccagctgcattaatgaatcggccaacgcgcggggagaggcggtttgcgtattgggcgctcttccgcttcctcgctcactga

SEQ ID NO: 29179 - DNA, 480 bp, Glycine max
  Peptide Sequence Number=SeqID_120864
atgaggggagcaccaacggaagagagcctctcgcctttccttgtgagagatttcggcgcgcaaagtctcaaggttgtacaaagagtccacaaggcgtggaaaagcccgttgaggaaagataaagaacttaggggcatccgtaatggcatcatcggtgattggccctccaagttgaaaattatcaacgaggagaacttcgaagctccggaagaggatgaagaagtccaagctctaaaattagagctaggaaaggtgagactcgccaaagaaaaattcaagttagccgctacaaacatccggaaaaagtgtgccgagttacgagaggaaaacgcggctactgcaagagcccttgaacaagaaaccaagaggcccacaaggaagagcatggccgagataaattccaaggagctttgtggggtagcaacaatgagctcaagctccggagagaggaaagagaccagtcacgggtacatggcatga

SEQ ID NO: 29180 - DNA, 906 bp, Glycine max
  Peptide Sequence Number=SeqID_120865
atggttagaaccagagaattgtgtttggctttaggtagagttataggaagagccttagggacacaagttagtggtgatgcggatgaagcccctcagcgtcgaaggccgacaacatctgcacgtagacaatgggctgctgcacctgttgttgaggatgttgagcatgtggatcatgcagctaatgaggttcatgagcagcctcaggaggcagttattgatgatgtatgtgctgatgcccagggttttcccatcgggccccacaatacatcagttttggcggattatgttcatcatgtgacaactatagtttgggcaggagaggaacgtcctaagttaaagttgtcctttcatggaaggaagagaaccgccagacaacttgcaggatatatcacactgttacagtgttggatttatagacatttccctactgctgctttgtgtgttgctgatgaggattatcatgagaggaaaccatgtgcttgtcgttggaagtttgggaaggcattatcgtttggttatgtgcaaaccatccctccacaccctgctgccccatctttatccatcgaggagattgacgatagatggatgcagttctctgaataccttgcaccgcctagggatcctcctagacatcctcctgtgatgcacgatgatacatttattgaaccaaatcctcctcagcaatccgtcgccgcagcggctatactagaaccacctacacctgcacttgctgatgtagacatgcctcgacatgtaatggaggcttgccaacagataacagaaatgttggaacacttgatcaacacgaggatagttactactggaactgaagcacacattgtgaccgagcaatgcctgataatcaccaagggtaccggacacatgaagattcttgggattgattaa

SEQ ID NO: 29181 - DNA, 211 bp, Glycine max
  Peptide Sequence Number=SeqID_120866
gtcgactctagaggatcccgatcgcgccgcaggacacccggtggaccaaagaagtccaacagggtcctggggttccagctctgattacgggcctctgtcagttctacggagtgtccgtcgccccaacaaggtcattaggccccgcattaaccgggctttcatcaagaagtactgtgcccccagacgggcgcagggcaagacaccacagtag

SEQ ID NO: 29182 - DNA, 315 bp, Glycine max
  Peptide Sequence Number=SeqID_120867
atggaattgattgagaatatgtctgctagtgaccatgcaatcttgcttgatagagcacacatcccaaccaaaagaagcctactggagctttcatcacaggacgctttgttggcccaaaacaagttgctatccaagcaaattgaagctttaactgaaacactaagtaagctgccaactcaattgcatgttggacaaccttcaccctcttctgttttgcaggttgcaggatgtgttatatgtggtggagcacataattttggctgctgcattcccacagaagatacaacacatgaagtgaactacattgggaactag

SEQ ID NO: 29183 - DNA, 432 bp, Glycine max
  Peptide Sequence Number=SeqID_120868
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccagggcttcgtcgatggcgttgtcgatgacttcctgggccaggtggttcgggcgggcggtgtcggtgtacatgcccgggcggcgtttgaccgggggatcctctag

SEQ ID NO: 29184 - DNA, 549 bp, Glycine max
  Peptide Sequence Number=SeqID_120869
atggcgcccaccaggcaccctctggacccggataagtccaacagggccctgggatttcccgccttgatcacaggactctggcagtcgttcggagtccctgtcgcacctagcaaggtgatttggccgcccatcacccgagcttttattgagaagtactgcatgcagagacaggtccagggtgatgcaccacaggccgcggacgcgccgccaccacatcagactggtccagccagatcatttgacacggagcagtatttgcggcattttgttcgccagcaggcggccaaccaccgggcacatgtacagacccatgattgtctttatcagatgagtctcagcctgcaggaccagggctttacttcttttccgtgccctactccggaccagttcagggcagaggtcgcatggcctagagattggcctgaggcccaggcaggagaggcaccggcagaggcactagcaaaggctctcgacgaggcagatgaggcccgcgaggacgaggagatgaccgatttactggatttcttaggagggagcggggccacatga

SEQ ID NO: 29185 - DNA, 189 bp, Glycine max
  Peptide Sequence Number=SeqID_120870
atgactttttgttttcttagttgtatgctgttaggggtgaagacccctgtggttctgtctggaaatcgcgatgaacgcgctaagcgcgcctgtgtgcttagcctgttcatcacaactgttaaaattttggatttccagatgaacgcgctaagcagaccatgtcgcgttaagcgcgttcatccctgctga

SEQ ID NO: 29186 - DNA, 156 bp, Glycine max
  Peptide Sequence Number=SeqID_120871
atgaccacattggcctctgcttgtcaatcgaacttgggatcttcgaatgacaaggtgcggataaccggaagccccccccaaggtggggtggtcgacaaaagcgaggcttttgctcctacatatcctccatttgtgatgaggaactcagacttatga

SEQ ID NO: 29187 - DNA, 396 bp, Glycine max
  Peptide Sequence Number=SeqID_120872
atggcatttttaggagaaactagcagtcagacgattgtcaactcaaggttggctttcatttttccaaatggatcgattattcacaatgatactggggtttacttccaaacttctactccggtgcccattcgattattatgcaccgttggaagaacaccagatggaataataaacttacttcaacgcattatgccccatactcatgacgtgatcctgtattacaacgggaaatggaacatgccaccgcagaacaaatttgttggatgcgcgttcacaggaaaaaatcctaagaaatttcaaattccttcaacatgtaccatcgatgaactgaaggatttaataaagcaagttgcacctaaaatgattctccctcttggaattcacgaatcacaaacg

SEQ ID NO: 29188 - DNA, 351 bp, Glycine max
  Peptide Sequence Number=SeqID_120873
atgaggaaagatgtagatcgatcgcctcagatagacaactacatagagggtctctacaagtctatatattcgtttttatgtcgttccccccgtaagatcaccaatgagttaggagaggtgcgccagcggcgagcagaagcaaggttattagatacctcaggaaagcccggccagaaccacacgtgcaagtttccctgcatgtggctcgtccgtgataacttattcggatttgcgcgaactagcggaccgatcactaagtggggatgctccctccagcatgagcgaaccttttcgaaactggttaggaatgggcgtcactatcccagccctgatccagccaggttctattga

SEQ ID NO: 29189 - DNA, 372 bp, Glycine max
  Peptide Sequence Number=SeqID_120874
atgacgacacgtagccctcaaggtgagggcgtgcagccctctcaatggcgaggacgtgtagtcctctggaaggtgagggcgtgtagccctacgatggcgaggacatgcagtcctctgatggcgagggcgtgtaagccctctgaaggtgaggacatgcagtccctgatggcgagggcgtgtagccctctgaaggtgaggacacgcagtcctctgatggcgagggcgtgtagccctctgaaggtgaggacatgcagtcctctgaaagtgaggacacacagtcctcttaaggtgagggcgtgcagccctctgttggcgaggacgtgtagtcctctgaagaccagggtactagtacccgagggtccatctttatga

SEQ ID NO: 29190 - DNA, 1119 bp, Glycine max
  Peptide Sequence Number=SeqID_120875
atggcgatcaccgatacgctgatccatgaactcgacgtgctgcgctggctgctgaacgatgattacgtcagtgcgcaggtgatttacccacgcaagacccgccacgcgtcatcgcacctgaaggatccgcagattgtgctgctggaaaccgcgaagggcatccgcattgatgtcgagatcttcgttaactgcgcctatggttacgacatacagtgtgaggtggttggcgagagcggcattgcgcgcctgcctgaaccgatgtcggtgcaaacccgtcatgcggcgcagctctccaccggcattctgaccgactggaaaaagcgttttatcgctgcctatgacgttgagctgcaggatttcattaacaacgtgctgtcgggcaatatgacaggcccgtcggcgtgggacggctatgccgccgctgtggcggccgatgcctgtgttgcggcacagaacaacggtgacattgtcccgattaccatgccgccacctgtcttcccgtcagtgaccgcccgcgcctcacatttgttagcaatcccgtgtatcatcgccgcctttatgctgtgcaaggaaaagtgtgatgacggagagcgtaatggcgcgccgccagccctcggtatggtggggcgccatgatcatctgtgggacggtagtgggcgccggtatgtttacgttgccgatcgtgatggccggggcgtggtttggctgggcgctgctgctgctgggcatcagctggggcgcaatgctgctctccgggctgctgtttatgcgtgtcagcctgcattatccgccaggcgcgggctacgatacgctgacgcgcgatttgcttgggcgcggctgggccagcatcaatggcctcagcatcctgtttgtgctgggcattctcacctacgcctatatctcagccagcggtccggtttatcagcactcgctgaatcagcttggcgtgccgctctcaacggccggggccaaaatcgcactgacgttgtgtgtcgccgccgtggtatggctcggcaccaccggcgtcagtcgtttgatgacgttctgcgtgctggcaaaaatcctgctattgattttgctgttcggcggactgttaacccaggtcgatgtgccctcgct

SEQ ID NO: 29191 - DNA, 823 bp, Glycine max
  Peptide Sequence Number=SeqID_120876
atggtcccgaggaagcttgcctcaaagaggtccaggaaggataaggcggccgaaggaactagttccactcctgagtatgacagtcaccgctttaggagcgctgtacaccagcagcgcttcgaggccatcaagggatgggcgcccggcggtggacatcactgggttactcccatggccaagttcgatccagaaatagtccttgagttttatgccaatgcttggccaacagaggagggcgtgcgtgacatgaggtcctgggtaaggggtcagtggatcccgttcgatgcggatgctatcggccagctcctgggatatccgttagtgttagaagagggccatgagtgcgagtatggccagaggaggaaccggtctgatgggttcgatgaggaggccatcgcccagctgctatgtataccggggcaagattttgcccggactgctgcagggaggcgagtgcgaatcatgcgcaccaatatgaccaccctgacccagatatggatgacgttgctcctcagcaacatcttgcccagcgatcataattccgacctccccttgccgaagtgtcagttggtgtacgccatcctgacgcggatgagcatccatgtggctcagttaatcgctgatgccatctatatttttgcaggtatggcgcctactaggcaccctttggacccagataagtccaacagggccctgggatttccctcgctgatcacgggactctgccagtcgttcggagtccccgttgcacctaccaaggtaattcggccgcccatcacccgggcttttattgagaagtactgtacccagatacaggctcagg

SEQ ID NO: 29192 - DNA, 525 bp, Glycine max
  Peptide Sequence Number=SeqID_120877
atggttaaggaggagtgtaaggaggtaagtgcctcctccaagaggttagttaagaaggaaagtcattttgaaataaagaaaaatattaaagaaacttcccctcttagacaacctctacatcttctcctttgtaaaaagacacttgttagcactgccacacctcttgggcttgaggttattcctcaagtaaaggagttgttggatgagggtttggttcgtaagagcttaaatccttgtgctttgttggtgcccaaaataggtattattaggcaccaaatccctacaataagtgatatgatgaatttgttgagtgttgcaacccttttttgtaaaatcagtcatgcacccaacgtcttcatgattcatgtacatagggactcattaggtaggaataatcaacataaaaatacagaaaaaggtgtcaagggaaagagcccagagtatcaagaacctcaggatttgaggtcaaatcctttccaaggtggaggggatgatgcaatcctaccccctaagggtattggatag

SEQ ID NO: 29193 - DNA, 627 bp, Glycine max
  Peptide Sequence Number=SeqID_120878
gacaaagccgcggcggcgctgcgggagttgggggaagaacaggtgttctgccaggtgtgcgacgtgaccgattccgactcggtggctgccgccttcaatgcggctcagcggcgctttggcccgctcgatatcctggtcaactgcgccggctacgtcaatctgcaaccggcgacggaagtgacgctcgaggagtggcagcgccacttggcggtcaacctcaccggtccttttttgtgctcgcaggaactggcgcgccgtgcgatagccgccggccacggcgggaaaatcatcaacatcgcgtcgcaggcggcctccatcgccattgacgatcactgcgcgtacacctccgccaaggcggggctgctgggcatgaccaaggtgatggccaaagagtgggcgccgcacggcatcaccgtcaacacgttatcgcccaccgtagtgctgacgcctatgggagagaaggcctggcgcggcgagaagggcgaggcgatgaaaaagctgatcccgctggggcggtttgcctataccgatgaaatcgcggcggcgatcctgttttttgccagcaacggcagcgacatgattaccggcgcggacctgatgatcgacggcggttttaccatttggtaa

SEQ ID NO: 29194 - DNA, 246 bp, Glycine max
  Peptide Sequence Number=SeqID_120879
atgcgttcctcgtcattaatatgtttgctagtgccccggactgtggaacaaaggagtatcccgacctacaccgagatttcggaatcaataaaatctccccaagtaggattcgaacctacgcccagtcagttaacagccgaccgctctaccactgagctactgaggaacaacgggaaattcgagctcatagagttcaattcccgttctcaacccatgaccaatatgagctcgaagtatccttcgtaa

SEQ ID NO: 29195 - DNA, 252 bp, Glycine max
  Peptide Sequence Number=SeqID_120880
atgccaatgccatcacgtcggctcgacggctcctcaccagaatttcactccctgcaccctgccactgtcattctgcactcacaaacaaggttcgtgatcatcacaggaatcttttcaagaaagcttctcaaggaggtgagcttagttattagagggatgtgtgtagctaagctctatcttctcaaggaagttttctcaaagaagcttcttaaggaagttttctcaagaaagcttctcaaggaagctacctag

SEQ ID NO: 29196 - DNA, 214 bp, Glycine max
  Peptide Sequence Number=SeqID_120881
acttatcaaggtaatccttgtggcgtctaccctgacttatcttccttcactggaagtggggtctaccttgacttatcttccttctttgggaagtggcgtctaccttgacttatcttccttcgctggaagttgcgtctaccctgacttattttccctctttggaagtggcgtcatccaaatctctgtagcctgtatcaagcgatccgccccgtaa

SEQ ID NO: 29197 - DNA, 90 bp, Glycine max
  Peptide Sequence Number=SeqID_120882
atggaggagatacatggagaagacgatgaagaacaaatagaggaagcaaaacgacatcacctagatgaagatgctcatgataccacataa

SEQ ID NO: 29198 - DNA, 264 bp, Glycine max
  Peptide Sequence Number=SeqID_120883
atggagaattggcgaatagcgccagacaatcaattcgcggggctccagactcgaaggtggaggacacatgaactagcgctaggcaatgaattcatggggctcctaataaaagtggagaatggagaattggcgaacagcgctaggcaatcaattcgcggggctccagactcgaagaatggagaattggcgaacagcgctaggcaatcaattcgcggggctccagactcgaaggtgggaggacacatgaacagcgctaggcaatga

SEQ ID NO: 29199 - DNA, 339 bp, Glycine max
  Peptide Sequence Number=SeqID_120884
atgtcaaacaatagggttttgaaagagcataacaagactttcctaaattggtttaaagatacaatctttggtgacgataatgcttctgaaacgttaagaaagctagcagatgggcctaaaagaaatgttataacttgcaatattggtgtatggaccaatgatgtacaatttatgttggtagatcttaagaaactcgcttaccagaatgaccctttcatcatagaagaacaaactaaagagaaaatggctacaccacccagctctcatcctcctcctccttctactgattcaacttcacattcaccttctaccatgaagaggacaagaaaagtgacctga

SEQ ID NO: 29200 - DNA, 858 bp, Glycine max
  Peptide Sequence Number=SeqID_120885
atgtacctagaagcctacttgaatggtacacattggcaaatggtcatcattttgcctaaggaaaatgttgtcatctggctttgttcgttacacaataggccagacaactacctgaaaggaattattaacaggcaaaaaggaagcactgagtgcgagtattacgtcatgcactggatttcaactataatcttaggaagttttaagaataattgggaaatatatttcaatgatactagaccattggaaccagagagattaaaggcgcttcgcatcccgtgggcaagctactatttgaaagcgcatctaacctcgcttcacttctcagagtatctgagccagcctcagcgagtttcaacctcaaactacaccaatcccctcgacgacgacgattggggcgagttcatgaaccattccaatcagatcaatagcaaacccttcaactcgttcggggttcccacagatcccacgaacaaacacgtgaacgatgaaaaaggcgttgtcgttcaacccgaggcagtgaaaaatcccaagggagctattcttctttcaatcttcggcgaggaagagggaaaagaagaggagaaacttgtttctgccaatgttttctccaacggcgatgctggtgcgatgaaaaggggatccagttcgaacaggtctgtcagaatcagtgatttgatttccagtttgtataatcagcagcgccctcaggtggattctcacaacaacgaatcagtttcggtatccaatgttgctgctcccaatttgatgtactcaaacggaagcaaattgaattcggatgaggatgaggatggatgggaattcaagtctgcagagtgggaaactggaaccaagagctag

SEQ ID NO: 29201 - DNA, 267 bp, Glycine max
  Peptide Sequence Number=SeqID_120886
atggaagcaaagatggcagagttgagtaatctggttagagagaactctacgaaaaaggaccacactcaaacaaataaccaagttcctcctggtgaatatcgcttgtcagccattgctgctactcttgagaatggtgttggactcaggggggaatcaaaattagaatcctttatcgacatagttgagcatgacatgattatcttatatggaataagggctacgcccaaatcagttcttgaactaatggatgtcaaggatgccctctag

SEQ ID NO: 29202 - DNA, 258 bp, Glycine max
  Peptide Sequence Number=SeqID_120887
atgtgtccaagagcacatcgaggcagcttgcaggatatatcactctattacaaatggggccccttgacggtcattcatcgaccgaaaagggttgtacaacagtttggctacatccagactattctgccacatcttgctacatcttcgctctctattgaagaaattgatgatggatggatgcagttcggtgagtacattgcacctgtaggacaattatgtgtagtgcctggccactattcaccagattacatggattag

SEQ ID NO: 29203 - DNA, 203 bp, Glycine max
  Peptide Sequence Number=SeqID_120888
gcctctatcagttctatggagtgcctgccacctccagcaagggcatcaggccccctactaatcgagctttcatcaagaagtactgcgtctccaggcaggcacagggcgaaataccacagcagccttgggatggccggctgcgggcaaccgacgcaccgccatcacctctagggttcacctcagctcatccacaaaaaggttag

SEQ ID NO: 29204 - DNA, 108 bp, Glycine max
  Peptide Sequence Number=SeqID_120889
atggagggcaccacgggtttgagtaaaaaggggccctatactcgggttcatggaaatctaaggagtggaggtgaatctatggtcatgctaggtctccgacttgcttga

SEQ ID NO: 29205 - DNA, 342 bp, Glycine max
  Peptide Sequence Number=SeqID_120890
ggctatgccctaaaaagcgtcgatattaactaccactgtgacgataacgccgttggtaataatgaccggataaagctcaccctgacggccgaccagggcatagtggatagcagtacgccctacattgctaagctgcttgaaagggacgatctgggcgtgcgggtgtacgacgaaaatagccagaacgtggcgctggatgggacttatgcatttccagtaaatctggacgagcagggaaacggcagcgttaaaatacaggcggttcccgtcagcactacggatgccacgcccgcaccggggagcttcgaaggaaacgtcacggtgaagatggatctgcgctag

SEQ ID NO: 29206 - DNA, 1081 bp, Glycine max
  Peptide Sequence Number=SeqID_120891
atgcgggcggtggaggcgctacgcaacagcgagacgaagctgcgactgatcgtcgaaggcgccaaggattacatcatcctgacgcttgatgaaaaccaacgcatcaccagctggtttggcggcgcggaggagactttcggctggtcggaagcgcagatgctcggcagaccgttcgaagaaatttttacacaggaagatcgggcggcgaatattccgcagtttgagatcgaaacggcgggccgcgacggtgttgcacctgatcgccgatggcatcttgccgccgatggtacgcgggtgtttcttgacggcaccatacgcccgatgcccaatcactcctcatcccatctttccggcttcatcaaggtggcgagaaacgcgacagcccaaaagctgtcggaagaccggcagctggcttttctggagctgggcgaaaagatccgcgaactcgactcggtcgccgaggtcgctttcgcagcagcggaaatcatggctcgaaacctgcaaggggcaacgcgagccggttatggcatcgtcgatccgatcgccgagaccgtggagatgctgcctgactggcgcgcgcccggaatgttcaccgttgccggccagcatcaatttcgcgattacggttcctatattgaagacctcaagcgtggcgaactggtcatcatagctgacgttgcggccgatccaagaacctcggcgtcagcggagcttttgaactcgctgggcatctccgtcctcggcaacgtccctattcttgagcggggcgctttcgtcggcgtcatgtttgtgcattacgaaaagccgcacgaattttcttcagaagaacgggatttcgtgcggacgattgccgatcgcacccgcgaagcaatatcgcggatacgtgcggaacaggaacagcaggttctcaaccatgagataagccatcggctgaagaacacgatggcgatggttcaggcaattgcgacccagacccttcggcccgtcaccgaaagagcgcccgtcgaagcgtttgtcagcaggctgcacgcactttcaaaggcgcatgaagtactgctcactcacgactggtcatcggcgc

SEQ ID NO: 29207 - DNA, 307 bp, Glycine max
  Peptide Sequence Number=SeqID_120892
atggaaaaatctgaaaagaaaaatcatagtgaaaagaaactgaagaaagcatacatcacatgggatgaaaatgatatggaatcttctgaagattcagaaaatgaagagataaatctctgccttatggctaaaatttacgaaagtgatgaagaggtgtctttgaggaagaagtggtacatagatagcggatgctcaaaacatatgactggagatgcatcaaattttacacatatctctccaaagaaaagtgggcatgtaacatatggtgacaacaacaaaggtagaatccttggagttggtaaaatag

SEQ ID NO: 29208 - DNA, 421 bp, Glycine max
  Peptide Sequence Number=SeqID_120893
aactcaccctggtaatcagttcaataaagaccaaggtgggccatctaacaggccacaacaacaagagcctagtctctgtgatagaatgacgaagctggaagagactcttgctcagttcctgcaagtatccatgtccaatcaaaagagcacagagtcaaccatcaagaatctaaaagtccatgtgggacaattggcaaaacaactagcagaccgaccgtcaagcagctttggagccaacacagagaagaatccgaaggaggagtgcaaggctgttatgactagaagcaaaatggtgagcttgaatgaaggtgagaagaggataggtgatgaaaaacaacagctggtgactaaactagaaattgacccagtggtggaacctttgagtgaggctgaggaagaagtggaagcagaagatgattag

SEQ ID NO: 29209 - DNA, 67 bp, Glycine max
  Peptide Sequence Number=SeqID_120894
gtcgactctagagcatccccggttagacactgaatttggaatgcttcttagtccaatagctcttaag

SEQ ID NO: 29210 - DNA, 433 bp, Glycine max
  Peptide Sequence Number=SeqID_120895
gatccccgattaccctgctggtggtgttgctgctctcctccaaaggggcggcgggcgtgaccggcagcggctttatcgtgttggccgccaccatctccgccgtcggccacctgccgttggccggcctggcgctgatcctcggcatcgaccgcttcatgtcggaagcccgcgcgctgaccaacctggtgggcaacggggtggcgaccgtggtcgtggcgagggcaccagaattcatcttatagttggtgggctgctattggctgcagccaggggcgctggccaacgggttttcatggcaaattctcgatacgccgcagcggccaagcgaccgcgtggaactgcggctgatcgtcaataccggctctctggtggagtcttcacaacagaccggcttcgcccagctgctgccgcggctggcgttgacgcgcagtga

SEQ ID NO: 29211 - DNA, 216 bp, Glycine max
  Peptide Sequence Number=SeqID_120896
gctgttgcttctggaggaagcaacctggctcgcctgggcgagctgggcggcaagcatctcccatattttgctataaatagcggaggaagtgaagaagaaaaggccgaggcgcttccgaaacgtttccgtaacgttttccgtgaggaatttcgcaaaagtttcagccgttcttcgacgttcttcatccgttcttcatcgttcttcgatcttcaacgg

SEQ ID NO: 29212 - DNA, 117 bp, Glycine max
  Peptide Sequence Number=SeqID_120897
atggtgtataaaaactcacacaacattcgttattcgctctcccttgatgagattctgctgtccttttcttcaggggcacccatgaggattctcttcacaggccaaggttcaaagtag

SEQ ID NO: 29213 - DNA, 623 bp, Glycine max
  Peptide Sequence Number=SeqID_120898
gtgagaatttcagccctatctctccttcggggttcaacctccttaagcggtcagcgggcataattgaaaaaagaaaggcactctatgttctcgttctcggtgctccggtcaagggcttgacctctgatgtatggaagtacgtggttgaagtgaattcctcggaaatgcagccggagggcaatctctcttttgacccgcatatggctatggttcagatacagactaaagactttctttcgtgctttgatctcagtggaagtagacttttcaaaatcttccggatagtcaccgcgccattcatagccatcagggaaactgccctcttccctcaagatggtccgtcttgcttctgcttgatggaaactagggttcaagttcagacttttcgaaatcagacatggcgggggcaggattcgaacctgcaatctcagggggcggcaactaaagaggtagcgagactgaccgcaattgcagatcgcttcacacctcgcggtgcttacacctctcgcctatcgaagttctgttcaaaaacctcgtccgagaacttgtatagagaaggatttcccgcggcgcagcagttcttccataccaacttagcagcccggcgctgggggatcctctag

SEQ ID NO: 29214 - DNA, 93 bp, Glycine max
  Peptide Sequence Number=SeqID_120899
atgttccttcatgggaagatgcccaggaaatgggttttcagaccttaccttacttcaacttcccaaaatccactaatatggctccatatgtag

SEQ ID NO: 29215 - DNA, 348 bp, Glycine max
  Peptide Sequence Number=SeqID_120900
atgcagtacaacgagaaatggaaaataccacgccaaggtgggtttttggattactccttcactggaacaaatccaataagatttgacattctttcgggatgtagcatagacaaactcaaggatataatcaagcaagttgcatctctaggagttcccccttatggaattcacgaattacaggtggtcagacgattgttctttagacaaccaggtcatgctaagtattcagaaaaattaatcgaatatgaaataacagagttgaaaaacggagaagatatgctaaaggtgttagtagaatccaactactggaaacgattctgcccaatagaaattttgttaaacaagtga

SEQ ID NO: 29216 - DNA, 460 bp, Glycine max
  Peptide Sequence Number=SeqID_120901
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 29217 - DNA, 399 bp, Glycine max
  Peptide Sequence Number=SeqID_120902
atggaaaaacgccagcaacgcggcctttttacggttcctggccttttgctggccttttgctcacatgttctgtgggtgggtgatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 29218 - DNA, 153 bp, Glycine max
  Peptide Sequence Number=SeqID_120903
atgtgggatcggcacatgcttaaaggagtactcaaaccgggtgtatttacccccaaggcctacactccgaagagtttatcaggacctctccctcctgattcagacactgctcatgaattatacaatactcacgacctcacacttgtgttttaa

SEQ ID NO: 29219 - DNA, 502 bp, Glycine max
  Peptide Sequence Number=SeqID_120904
gaaatgggcagttgcagtcgacaaggacggtgcagacgacattgtctgtgaaaaatatggcattagtaaggagaaatggactcagttttgtcagacccgcagagacccctcatgggaggcctcccagaagcaaaacactgccccccacgtattgtctcgtgggggttatgaatatttagaagaaaagctcatggctgagaagacaaagaaaagactggaagaagctgcccagtctggaagcactgagggcatcattgaccctccatctcccatcagacgccacgtgaaatggaagatggcccgcacgaagaaaactggacagatgacgtctgagacagcaaaggaaataactgacaggattggatcgttcgtcccccatggacgtcaggatatcctgactgctgccattgggcgaccagaacaccctggccgtgtttgtgctgttggaagccggtgtcaccataaagcaatactttggatcagcttcacgaacatcccgtag

SEQ ID NO: 29220 - DNA, 390 bp, Glycine max
  Peptide Sequence Number=SeqID_120905
atgtcctcttgggggaagaaaactgtatcttttctccgggcaccatcctctcccaaacgtggttggatgagaaaaaagcacactggggcacatcagcaaccccatttgggatacaactgggtggcttacccttatggagtaccacctaattacatgccaccagtcatgcgtgatgaagccggtcatgtcccttcccccatccttgaaggggagcctcctcgacagtcggacgaggttcacgaggatcgtagggagtatgcccaaggtgacatcgatttctaccccctggtacccgttgaggggccggcacccaacacattgcctcagcccaaccttctagcacaaccaatatttttgtccacagaaggatcacccccggcagcggaataa

SEQ ID NO: 29221 - DNA, 372 bp, Glycine max
  Peptide Sequence Number=SeqID_120906
atgaaaagtaagtttatcgtcatcgaagggctggaaggcgcgggcaaaaccaccgcgcgtgaggcggtggttgcggtcctgcatgagcagggcattgaagacgtggtctttacccgtgagccatgcggcacgcctttggccgaacagctgcgcgtgctggtaaaacagggcattgatggcgaacaggtgagtgataaagccgagctgctgatgctgtatgcggcgcgggtgcagctggtagaaaacgtcatcaaaccggcgctggcacgcggtgcctgggtggtgggcgaccgtcacgatctttcgtcgcaggcgtatccgggcggtggtcgcgggctcgatacccagctgatgaccacgctgcgtgatgcg

SEQ ID NO: 29222 - DNA, 255 bp, Glycine max
  Peptide Sequence Number=SeqID_120907
atggaccttttcaggtcttggagaggatcaataataatgcctataggttggacctcccaagagagtggaactaatatagaggaggaggaaccaacaaatttgaggtcaaatcctcttcaaggtggaggggatgatgcaatcctccctaggaaaggaccagttaccaaagccatgagcaagaggctccaagaggattgggctagaggtgataaagaaggccttagggttctcatgaaccttagggtagatttttga

SEQ ID NO: 29223 - DNA, 609 bp, Glycine max
  Peptide Sequence Number=SeqID_120908
atgagtgaaatagaggaggtacaagagcggatgaaggctgacatggaggccatgaaagagcaaatggccacaatgatgaaggccatgatgagcatggaaaagagaatggaagtcaatgtagctgcagttgctgctaccagcatcgcttctgaggtggacccgactcctccgtctggccttaacccaataaatcatccaacctcgaatatggtaggcaaagaattgggaagtatgggcattccccattttgtgcaagttcaaaataagcattccttcccaccatatggcttgccccccgactatgcgccacccaatgtggtgcacactcccgatgagaatgtcaataactccactcccatactcattgagagccaacaaactcagtttgatcatgcacatgtcactcaacccatgggggagacacatgaaataccccaccacaatctagccaactttgagccttgcctcggatatgcccctgagggaagcagttggtggtgtacctttgccaaacactttggagggccctcagtttctcccacaaccacaaccctttcattttgtagtgaggagagtccctcctgctatggtggaaaagggaaagtttga

SEQ ID NO: 29224 - DNA, 378 bp, Glycine max
  Peptide Sequence Number=SeqID_120909
atggttgaagatccaagaagagttactctggaatattattcaggagaagccaagaggtggcttcattcattcaaaggtaatagtcttaagacatgggatgaggttgtggagaaatttttgaagaaatatttccctgagtctaagactgcagaaggcaaagctgccatctcttcttttcaccaatttcccgatgaatctttgagtgaggccttggaaagattctatggtgggaaaatcaaattgaagacccctgaagaagacatggatctcattgaaaatatggttgcaagcaacattgttattttgagagatagagctcacattcctaccaaaaagagtttattggagttaacctcccaagatgcattgttggcataa

SEQ ID NO: 29225 - DNA, 342 bp, Glycine max
  Peptide Sequence Number=SeqID_120910
atgaagctttgcttctacaggaaccaccctggaaatcagttcaatagagatcaaggtggaccatccacaaggtcacagcaacaagggcctagtctctatgatcgcacaacgaagctggaagagactctagctcagtttatgcaggtttctatgtccaatcagaagagcacagagtcctccataaagaatcttgaggtccaagtaggacatcttgcaaagcaattggcggatagatcatcaagtagttttacagctaatacagaccttgcgctaagcaattggtggatagaccttacgctaagcgcaatctcttcacgcgttaaacgcaaggaccctgattga

SEQ ID NO: 29226 - DNA, 327 bp, Glycine max
  Peptide Sequence Number=SeqID_120911
atgtcggctcatggaggtggtggaggaggaggagttacggtttctgggctgaggttgagagcgaatagagctcaaaccatgcagttttatgttgttggacgtatttataatctgcagatctcacgtagcaagcatgtcttgctaagcaggaatccattttcggtgctaagcgtgaatttttgtgctgagaacaattcctctagggtaggaattgcattgagcacaacatttcgtgctgagcataattcctcttgggttggaattgcgttgagcgtaattcctctttggcaaataccaacggttaaaatgtcaattacaaacctatag

SEQ ID NO: 29227 - DNA, 201 bp, Glycine max
  Peptide Sequence Number=SeqID_120912
atgtcctatgctgacttgctcccatatccactcgataatgcaatggtagccataacccctgctaggtttcctcaacctccatttttccgaggatacaactcgaacgcaacgtgtgcttgtcatggagaagccccggggcattccattgagcactgtatgacttcaaagcgtaaggtgcaaggtccaattgatgcaggctga

SEQ ID NO: 29228 - DNA, 537 bp, Glycine max
  Peptide Sequence Number=SeqID_120913
atggattttcaaataagatgcgtttaccttgtggttgctttagatgttattggcgtggttgatgaagtggtatttcgatatgtgtcatcgaaaaatacgagggttgttttgaaattaaaggatttgagtggacaggtgctatcctgcacactctgggaaaattactgcttacagtttttgtcttatttgaatgacattgaagatgaaagactggtcgttattcttttgacatatgccaggattaaggaagcacagggatcatatctgctgtcggtcagtaattctttcaaggcgtttaaactcatgatcaacaaccttgtgttggaaattcaagaatttagagagagccttttagatttagggatcgaggttagatcagttttgacgcctattggacaagggagttcacaggtttcaaggtcatctcaattatcatcaaaagatgtgtttctgtcaaaggctgaagagaaaaatatctctcagattaatgccacttccgaggtgatgttcttattcatttgtagcttctctttgtag

SEQ ID NO: 29229 - DNA, 222 bp, Glycine max
  Peptide Sequence Number=SeqID_120914
atgacgggagatgcatcaaaatttactcatatatctcctaagaaaagtggacatgtgacttatgaagacaacaacaaagttgatgattattcaagattcacatggacattatttcttactcacaaaagtgatgtttttcatgcttttaagaacttgctaaactcgatcaaacaagaaaatcttaacattgtatcattaggagtgatcatggaggagatttga

SEQ ID NO: 29230 - DNA, 213 bp, Glycine max
  Peptide Sequence Number=SeqID_120915
atgagtttgagacatcctgatgaggacatgaccaagagcaagggcaaggatccacttgaaggacttggaggacctatgacaagggctagagcaaggaaagccaaggaagatcttcaacaagtgttgtccatactatttgaatacaagcccaagtttcaaggagaaaagtccaaggttgtgaattgtatcatggcccaaatggaggaggactaa

SEQ ID NO: 29231 - DNA, 354 bp, Glycine max
  Peptide Sequence Number=SeqID_120916
tctcctccacctctaggacctcataatcactcacaaactcatctcaagctctcaggacggcttcctcttcaagctctggtctctgcagatcatcacacaacaaaatctctcaaactctttggaacttggacctttctctctctagaattctctagacgtgcagaagcttcaagaaaagcgtggcttttctcgctcagcaaatggactaaagcggtgcacttagcgggatggccctttgctcagcgaacatgcgcagctcatccttcttccagattcttcgtcgcacttagccgaggaatgttgcactcagcggatggctcgataagccagaagattggcttagcgagagggtga

SEQ ID NO: 29232 - DNA, 258 bp, Glycine max
  Peptide Sequence Number=SeqID_120917
atggaggttgtcaagagtggtgcgcagagtgtctgcaaacttttggcatcgtctacacctcctagtgaagtcgagggtcccctgagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 29233 - DNA, 618 bp, Glycine max
  Peptide Sequence Number=SeqID_120918
atgggatcaagtcaaaagccttcgcttaaaaagaggttctatcaagtcaaaatcaagagcttagaggtcactagtttacgagagttggggcaattaatgggtcaacttcaacagcaagccttccgcaaagcctatggtaagatttgggacctagctagggtagaagtctccatggaaccgattgcatccctttcccagtattatgaccagcccctaaggtgcttcacattcgaggacttccagctagtgccgactgtgaaagagtttaaagaaatcctgggatgcccactgggaggaaggaagccatatcttttctctgggttctatccctccacgacaagagttgccaaggtagtgaaaatctcagcacaagagttgaaccaggcgaatgggctttcttttattgacatcttggcgcttttgatctttggagttgtcctctttccgaatatggaagggttagtggacctagcagcgattgacgctttcctcgcctttcatcatggcaaggaaagctcggtcgtcgccattttggccatgtatgacacgttcgaccggggatgtgaaaagagcagtgcaagaattgtttgttgtgcactggctctctatgtgtgcctg

SEQ ID NO: 29234 - DNA, 270 bp, Glycine max
  Peptide Sequence Number=SeqID_120919
atgcttttttcaatcgcctgtaagggtgatgaggttttagaaaacgtcgatgcctacttgtgtcttcttcacaaatgggccatgcacgatggcccttactataacccgctcaaaccttctcatatgtggaaagttgttaatgatacaaaaaaaccttcatcaccaagaaatgtctcattccgaaacccatcaaacactaaaacccttcgtcccacaactttgtcaagtcttcaatcaacagacttagataaacatacgatgtcatcttga

SEQ ID NO: 29235 - DNA, 250 bp, Glycine max
  Peptide Sequence Number=SeqID_120920
atgtttgaagatgaggaggcttatgatcctatgtctcaacgaggtggacaaaagtgcatcaacttctatcaatacatagatgttgtatacacaaatgatcacatcttacgtgcttactctcctccatctgatgcgtcgtggacacttgtgcctgatccaagttttaatcgtatgaaaggaaggccaagatcaacacggttaaggaatgagatggattggagggaaccttctcaaactcgtaaaaaatgtg

SEQ ID NO: 29236 - DNA, 516 bp, Glycine max
  Peptide Sequence Number=SeqID_120921
atggctactccacctgcctcgcctcctcctcctcttcctcctcctcctgcaaacgcagtagcgtctccatctacgttgaagcggacacgcaaggcaacacggctacgatcattggccactagaccacctggggcagaaagacctgtggtcaacgtcgatcctgctaccggcaaggccgacggtccccacaagaggaaattaagaacatatttggggattgtcgctcgtgataaggtcaacgtgacatatgacacctggaagaaagtccctactgctcaaaaagatttgatatgggaggatattcaagtggaatttgaaatccctgaagcttttgacaccgacaaggacggtgtggacgacattgtctgtgaaaaatacgacattagcaaggaaaaatggacccagttttgtcagacccacagagacccgtcatgggaggatgtgcggaaaaaggcacaggtcatccagaagcaaaacactgccccccatgtattgtctcgtgggggttatgaataa

SEQ ID NO: 29237 - DNA, 611 bp, Glycine max
  Peptide Sequence Number=SeqID_120922
cctaagtgaagaacttcgtgactattatgaaggaaggcataggtcagatcttagaactcactcccatgggagagaaaaggaaagaaagcctcaagaggctaacattaacctctcatacttccatgggaaggacaatgtagaggctaacttagattgggaaataagggtagagcaacaacttaaaaggaagtctacttcaaaattttatggctctcactcttatccaaagaaagaccaaggtcaaggcatcttaggggtgacaccttctaagcccaaagatgataaggggaagacaatagaaaaacaaccccttaaggctagtatgcaagagaagactagctccatgaagtgctttaaatgtcttggaatagaacacattacttctcaatgccccaccaagaaaaccatgattatgaggggccaagacatttatagtagccaagatgaggctacaacttcaccttcttatagtgaagaggagtgtaaggagacacttgttagcattgacacacctcttaggcttgagtttattcctcaagtaaaggagttgttggatgagggtttggttcgcaagagcttaaatccttgtgctttgttggtgcccaaaatag

SEQ ID NO: 29238 - DNA, 1110 bp, Glycine max
  Peptide Sequence Number=SeqID_120923
atgtcccaacatcttccaccccaaatgctgaagtcctcgtgtcatccagtgaagagaaatcaacagaggaagaggatcaagccacagaggagacccctgcaccaagggcaccagaacctgctccaggtgacttcattgacctagaagaagtagaatctgatgaggaacccattgccaaaaagttggcacctggcattgcagaaagattacaaagcagaaagggaaaaacccccattactaggtctggacgaatcaaaactactgcacagaagaagagcacaccaatcactcctaccacatccagacggagcaaagttgcaatcccttccaagaagaggaaagaaatttcctcatctgattctgatgatgatgtcgaactagatgttcccgacatcaagagagccaagaaatcaaggaaaaaggtgcctggaaatgtccctgatgccccattggacaacatttcattccactccattggcaatgttgaaaggtggaaatttgtatatcaacgcagacttgctttagaaagagaactgggaagagatgccttggattgcaaggagatcatggacctcatcaaggctgctggactgctgaaaactgtcaccaagttgggagattgttatgaaagtctagtcagggaattcattgtcaacattccctctgacatatcaaacagaaagagtgatgagtatcagaaagtgtttgtcagaggaaaatacccaactgaaggagtggtggatattgctgtttctgagcatcaaattgccaaggaaatcactgccaagcaagtccagcattggccaaagaaagggaagccttctgcagggaagctaagtgtgaagtatgcaatcctgcataggattggcactgcaaactgggtacccaccaatcatacttccactgttgccacagaatcttttgctgtcaaattacccattgccttcccaactgtattgtgtggcattatgttgagtcaacatcccaatattttaaacaacattgactctgtgaagaagagagaatctgctctgtccctgcattacaaactgtttgaggggacacatgtcccagacattgtctcgacatcagggaaagctgttgcttcag

SEQ ID NO: 29239 - DNA, 639 bp, Glycine max
  Peptide Sequence Number=SeqID_120924
atggccagggatagattggcaggtgatcaagccaataatatcaaattgcaactcatagctgcttggggaaaagatggccgtgtatataatatgcctaatgtttcggaaattgctgcacttattgttggcgattttcagccaggctcaaaaagagatattattgttgaaactcaaaatggagaattacaaagaatccatgaacttcaccctagctatctaccactacattatcctctactctttccttatggagaagacggatataaagctgacatacttcaccgttctacttcatccagcaaaaaaagaaggcgaaaccgtctaacaatgagagagtggtttgcttatagacttcagtccaggtcaaatgaagcacatactttattgcattctcaaaaattatttcaaaaattcattgttgaaggttataccatggtggaatctgaaagacttagctatatcagaaacaaccaaaagaagcttagagttgataagtattctagcttacaaacttcattggatactggaacagctaaaggcttaaccaagggaaaaagagtcatcttaccctcaacgtttgttgggagcccatgttatatggatcaactttactttgatggtatggccatatgcagtcat

SEQ ID NO: 29240 - DNA, 1089 bp, Glycine max
  Peptide Sequence Number=SeqID_120925
atgggcaccactggttatcctatggccaagtttgatccagaaatagtccttgagttttatgccaatgcttggccaacagaggagggcgtgcgtgacatgagatcctgggttaggggtcagtggatcccgttcgatgccgacgctatcagccagctcctgggatatccgatggtgttggaagagggccaggaatgcgagtatggccagaggaggaaccggtctgatgggttcgatgaggaggccatcgcccagctgctatgtataccggggcaggattttgcccggactgctgcagggaggcgagtgcgaatcatgcgcaccaacatgaccaccctgacccagatatggatgacgttgctcctcagcaacatcctgcccaccgatcataattccgacctccccatgcctaagtgccagctggtgtacgccatcctgacacggatgagcatccatgtggctcagttgatcgctgatgccatctatatttttgcaggtatggcgcccactaggcaccctttggacccagataagtccaacggggccctgggattccccgcactgatcacaggactctgccagtcgttcggagtccccgttgcacctaccaaggtgattcgaccgcccatcacccgggcttttattgagaagtactgtacccagagacaggctcagggtgatgctccacaggccgcaggcgcgcccccaccacctcatcaggctggccaggctggggcatttgacatgaacattggaggactacatgtcctcgccaacagagggctgcacgccctcaccttaagaggactgtgtgtcctcactttcagaggactgcatgtcctcaccttcagagggctacacgccctcgccatcagaggactgcgtgtcctcacctttagagggctacacgccctcgccatcagaggactgcatgtcctcaccttcagagggttacacgccctcgccatcagaggactgcatgtcctcaccttcgtagggctacacgccctcacctttagaggactacacgtcctcaccaacagagggctgcacgccctcaccttgagaggactacacgtcctcgcaacgtag

SEQ ID NO: 29241 - DNA, 450 bp, Glycine max
  Peptide Sequence Number=SeqID_120926
atggcggcgcagctaatccatgatcgagtagagatggagtgcctagagggagcctgggagaccctcgaaggcaacacgaggtgccgattttggggcactattcgatttacggcgacttctttggtgcatccagatgaacccgtgcgcacgcttcagcacattgtggagtggatactacccacgcctacaccataccttctagcgaagccagtccaagtgatcgaggtgacgtcatctgaggaagaccctaaggaggatcccgaggagctacctcctcagcctgctgtggatgctcttgactttctagagggtgatgaggacccacttcttgaggtggattctcccgaggaagtcatgtcggcatctgaggcagactctacggaggatagtgcccgagagagatggcgaccagtggaggcccttcatcatagtggacagttccatggacta

SEQ ID NO: 29242 - DNA, 498 bp, Glycine max
  Peptide Sequence Number=SeqID_120927
tatgagtacgacggcgtggaggcactcggtcctcggatttcaagggccgcgggggcgcacggacaccacgcgacgtgcggtgctcttccagccgctggaccctacctccggctgagccgtttccagggagcggcagtctgggcacgaacccagcattccggttcaactcccggcatcgccagtttgctttacaaaaagtcggatcccacttggagctctcgtaccagttctgagttgactggcgcccggggtcaacagagcgccccgaagggcccgttcccaatccgtcccccgaccggcacgcgacgacccgctctcgccgcggaagcagctcgagcagtccaccgacagccgacgggttcgggactgggacccccgtgcccagccctcagagccaatccttttcccgaggttacggatccattttgccgacttcccttgcctacattgttccatcgaccagaggctgttcaccttggagacctgatgcggttatga

SEQ ID NO: 29243 - DNA, 270 bp, Glycine max
  Peptide Sequence Number=SeqID_120928
atgtccactgggactagaaaatgtgattgtccctttaggttgagaggaagaccactgaagaatggtgaagaatggaaagttagggtgctgtatagactacctttgcttgagattgttggtgttacgtgtaccgggatgaaattttatgttgcttttgcttacttggaagttgaatatgaaaataactttgtgtgggcacttgaaaggtttagaggcatttttcacatatttgatggattgccaaagtggttgtcactaacagagatctag

SEQ ID NO: 29244 - DNA, 826 bp, Glycine max
  Peptide Sequence Number=SeqID_120929
cacaaagggtagctgcgctggacctgaaggaagcggattacttaaagagcttttgaatggtgatgacgatctgatgggcttgttcgtagttgttgggcaaaatattgtgcttgcaggcttgggaaaagtgtttgagaattcatccaccatacataatgttcgttatgaaaatgatgttgttaaggttcaggttgtcagaacatacatgcctcacgctgaggtccctattcctacatcagaggttcattatcttgagcaggctgttggcacattcgtcgcatggccgacacatcttgttagggaagtaactaatgaggtggtcgtaggacccgataagcctccatcaaagtctgttggagagccgaacaggttaacatctgtggccacagatgacccattgggagaattggttaagaagtcatatgtggtttacacaaagccaatggagttggcatgggacggggcgaaatttgggttatctaatgcctcaaatggttttttcatcacacatgcagatgtgactgaaataattttaggtgacaaatgtttaaatatatttgtactgcagctgtggatgatgtttatgaatgattggagtacaagcattggtttttctccagtgtacggtttccttgagccccagtctatacgctgcacaaaggacacgcgtgaagaatgtcaaaagtacatagaaatgtgggtcaaggagtcacatcgagaaatctacttaggaccttacttcaattatttgatggggaatttcatgttgttgacttcagggcacattggcaacttcttgtgttgtgtccacaagagaacattatag

SEQ ID NO: 29245 - DNA, 423 bp, Glycine max
  Peptide Sequence Number=SeqID_120930
atgtcagcatttacacgtgattctcctcaaatttcagccagcccgcatcaattagaccttgcaccttacgcttcagagccctacaatgctcaatggaacgccccggggcttctcaatgacaagcacacattgcgttcgagtcgtattctcggagaaatggaggtgggttttgttgtcgatttagggatggcctttgtggataaatgggcagtaggtaaggagaagggttgggtaatgacattgttgggttggtgggaaacttggccgtacaggaatggcagtcattgcatgggtttctccctcattctcaccctcttcatttgccccagttttctcattcgtccaagcaggatgattaaatttgcctcttttcagacccacttcgatctttttgctggcgaagaccaaatctataaaacttga

SEQ ID NO: 29246 - DNA, 387 bp, Glycine max
  Peptide Sequence Number=SeqID_120931
atgtggaccaccacgggggagaagcttgccgcccagctcgcccaagcgagcaaggttgcttcctccagaagcaacagccttctggaggaatcttctggagggcccaagtgggcctggtgctatttacacccctttttactaaatctttcgaagaagttatggaaacttacggattgcgcaaaaacacctcttttcgacttccgccacattacggaatttcacggatcgtgcaagcctgcttcctttagatttctgagacgtctcgggacttcatttattgtgcaacaaaggacgccaagtatctcaaagcggctaaccaaagattgcatgtcatcaagtaataatccccggacgaaattagggtatgacaagtgggctgaaccataa

SEQ ID NO: 29247 - DNA, 642 bp, Glycine max
  Peptide Sequence Number=SeqID_120932
atgggtgaagtagaggagatacaagagaagatgaaggccgacatggaggccattaaagagaaaatggccacaatgagggaggccatgatgagcgtgaaaaagataatggaaaccaatgcggttgcaattgccgctaccagcgttgttgctaaggtgaacctgatgtccccatccggcatcaatcaaatgaatcatccaacctcagatatggtaggcaaagatttgggaagtacggatgaccccatgatgtgcaaattcaaaacgagcacgccttcccatcatatggcttgcctcccaactatacaccacccaatgtggcgtacactcccaataagaatgtcaataactccactcctatacccattgaaagccagcaaccccaaactgatcatgcacatgtctcttaaactgtggaagagacccatgaaattccccatcacaatctacccgacttcgagccttggctcggatataccactgaagggcaagcagttggtggtatacccctacaaaaaccctttggagggccctcagtatcacccacaactgcacctcttgcattccacagcggttaaaaaccctcatgactatggcaggaatgggaaagttggatcatctagaggaaaggctcagggccattga

SEQ ID NO: 29248 - DNA, 411 bp, Glycine max
  Peptide Sequence Number=SeqID_120933
atgtctctaaacgtgggggagacacatgaaattccccatcacaatctagctacttcgagctggctcggatatgccactgaagggcaagcagttggtggtataccccttgaaaacacttcagaaggccctcagtatcacccacaactacacctcttgcattccacgacaagtaaaaaccctcatgctatggcagaaatgggaaagctggatcatctagatgaaaggctcagggccattgaaggaggtgaagattattcctttgctaacctagaagagttgctcccaatacccaatatcatcacccctctcaagttcaaggtgctggactttgacaagtacaaggggattacttgccccaagaaccatctaaagatgtattttcggaagaatgggggcatacgcaaaagatga

SEQ ID NO: 29249 - DNA, 177 bp, Glycine max
  Peptide Sequence Number=SeqID_120934
atgtcataccctaatttcgtccgggaacctttgctcgatgacgtgcgaccattctttggtcctcgtgaggttcctccagaaggcggttgcttctggaggaagcaacctggctcgcctgggcgagctgagctcgcctgggcgagctgggcggcaagcatctcccctattttgctataa

SEQ ID NO: 29250 - DNA, 633 bp, Glycine max
  Peptide Sequence Number=SeqID_120935
atgcctggtaaagcatcacgctgcgatcctgcgccaacgggagatgcgttactgggctcgagatcgccctcgccgagcacgtgtcggcagtttctgctcctcgcggcggacgcgcggtgcacagcgaccttcagcccagcccagggcctggagcaggagctatggcttgtcagtggaccgctggccagcaaggcggcgcccgcgccggggccaggggtgctgcaacacgcgcgagcactggtgcaggggtcggcaactgcaccacgagggcgccagcaagcaggatgccggcgagctgcgcttcggcagcgggccggcgccggcccagcaactggtgccggacgcggtggccgacttcatcaaccgtccacccgcgggtgcagtcagcctggacgggacaactgggaaaagctcagccgcggccatgtccgcgcaagagatcgaattcttcgtcgcgacatccggacttcgaagggggccggaccgagacgcgcccgctcagaccccgggcgccaggggccagttcttcgccggtcgacgcggaagggcattcggaacggcggaggtggggcggcaaaggcaccggtgcagaccatgttcacgctcctggggtctatctatacttattactaa

SEQ ID NO: 29251 - DNA, 475 bp, Glycine max
  Peptide Sequence Number=SeqID_120936
gtcgactctagaggatcccccgggagaaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaagtcggccttag

SEQ ID NO: 29252 - DNA, 55 bp, Glycine max
  Peptide Sequence Number=SeqID_120937
atgggtgccaagcacctcacaaggaccaagaaaggtcgcatgtcatcaagcaaag

SEQ ID NO: 29253 - DNA, 309 bp, Glycine max
  Peptide Sequence Number=SeqID_120938
atgactcatcaggatttcaagtgcaagcatggtcagtttgctcaagcgacctgtgctcctgagtttggacttccaagaccgttcaatcatagattactcggcttgcacgttggtgggggtgccgtaaaacaacgagatgttggacaaatggcctcagttaccttaagaaaaaggggggttgaattaggatacgaagtttattccccgattaaactttcactctctcttttcgaattaacaatgcacacagggacaacccttcccttgtgttcgagaatatcctacaacaagagacccacggtctcttaa

SEQ ID NO: 29254 - DNA, 969 bp, Glycine max
  Peptide Sequence Number=SeqID_120939
atggccccgaggaaacttgcctcaaagagatccaggaaggataaggcggccgaaggaactagttccgctcccgagtatgatagtcactgttttaggagcgctgaacaccagcagcgcttcgaggccatcaagggatggtcatttctctgggagcgacgtgtccagctcagggacgatgagtatactgatttccaggaggagatagttcaccagcggtgggcatcacaggtcacccccatggccaagttcgatccagacatagtcctcgaattttatgccaatgcttggccaacagaggagggcgtgcgagatatgaggtcttgggtaaggggtcagtggatcccgtttgatgcggatgctatcggccagctcctgggatatcctttagtgctggaagagggccaggagtgcaagtatggccagaggaggaaccggtccgatgggttcgatgaggaggccatcgcctacaacatccagcccagcgaccataattccggacctccccctgtcgaagtgtcagctggtgtacgccatcctgacgcggataagcattcacgccctgggatttcccgcctgatcacaggactctgccagtcgtttggcgtccccgtcgcacctagcaaggtgattcggccgcccatcacccgagcttttattgagaagtactgcacgctggtccagccggatcattttgacacggagcagtatttgcggcatttggttcgccagcaggtggccaaccaccgggcacatgtacaaatccatgattgtctttatcagatgagtctcagcctgcagagccagggctttacttcttttctgtgccctacttcggaccagttcagggcagaggtcgcatggcctggagattggcctgaggcccgggcaggagaggcaccagcgaaggcaccagcagaggctcccgacgaggcagatgaggcccgcgaggacgaggagatgaccgattaa

SEQ ID NO: 29255 - DNA, 600 bp, Glycine max
  Peptide Sequence Number=SeqID_120940
atggtctgcactaagaaaactaggcagatgacgtctgaagcaacaaaggaaatagctgagaagattgattctttggaggagcaggcgtcacaaggatcgttcctcccccatggacgtcaggatgtcctgactgttgccattgggcaaccagagcaccctagccgtgtccgtgttgctggagccgctgatccaacaaatcatggaccagttggaggagttgatcacagaaaaagtgactcgatagctgatggcatccttcagccagatgcagtcccagtttcagtctcagatgcaatcacaaggacttgcgctgcctccggagctggagggaacgatccagagatgagtgactcagacaaatgcgggctatacattgaagacaatccttcccacctggttgccctaggaagaatttatgagggatccacagtagttcacaacatccctttgttgcatggccaagtcaaggttggtgttgaggaagttaaagatgcagaggctctcgttcctgtacctactggcgaggttacctcagtggggcaggcacttaacaccttccttgcttggccaacacatcttgtgaagcgtttatcagaacaa

SEQ ID NO: 29256 - DNA, 171 bp, Glycine max
  Peptide Sequence Number=SeqID_120941
atggatacctcagagccctacactggggaaatgagaggcaccatgcatgagcctcaagtgaacctaggggcagatcagaagttctcacctagtagcaaaagcaaaatagaaaccctaagtgggaccaccgctaaaccgacgggaagagcaatgcaaagaacacatgcatga

SEQ ID NO: 29257 - DNA, 312 bp, Glycine max
  Peptide Sequence Number=SeqID_120942
atgtctcctcaacctctagaacctcacaatcactcacaaactcatctcaagttctcaagacagcttcctcttcaagctcggttctctgcaggtggctttgttcgtgcttgcgcgcttagcgtaattctgaaccgctttgtgctcattagtggatttcggcttaacgcgtgcttttctcgctcagtggatggactaaagcggtgcgcttcgctggatgacccttcacttagcgcaaatgcacaactcatccttcttccagattcttcctcccgctcagccgaggagtgttgcgctcagcggatggctcgctaa

SEQ ID NO: 29258 - DNA, 261 bp, Glycine max
  Peptide Sequence Number=SeqID_120943
atgcttcctctagaagcaacaaccttctggaggaagaatctggaaggcccaactttcgaagaagttacgaaaactcacggattgcgaaaaacacctcctttcgatttccgtcacattacggaattttcacggatcgccaattcgaatctaggcccttccggaacattttggaaattgggttgcttaaggaggaagcaactgggcggcaagctcctccacattgttgaaaaatggtttccagggcttccgtggcttccgtaa

SEQ ID NO: 29259 - DNA, 466 bp, Glycine max
  Peptide Sequence Number=SeqID_120944
atgcacacaattgaatttcagaaaaaaggacttcctcatgtgcatttattgctattcttacatccagataataaatattcatctttagatgacattgaccacataatatcagcagaaattccttcgcatgaaaatgaccctgaactctatacattagtccaaaatcatatggtacatggaccatgtggaattctccaacctaagtctccatgttatgacataatcactgctgttgttattcatgatgataatggtacacttgagaatgctatcagtcaaaatgatgagattaaagaatatgtggattgcagatatatttctccatgtgaagctacttggagaatttttggttttccaatacatgctagaaagcctgctgtggagagattacattttcatttgccaggacaacacattgttttttatgaagatgatgatgatatagatgatatcctgtcaaagccaa

SEQ ID NO: 29260 - DNA, 261 bp, Glycine max
  Peptide Sequence Number=SeqID_120945
atgcatatgacacagatgcaatttatgaatatgggagcccgagaaactgtctccttcttagatacaacgtctaggggtagcaaagtgctccaacgagggcgacgcgagactcgcgggatgcgtgttccacgaaaggaatacgcgcggagtcgccaccaacgtttatttgaggaaaacatcggaaaaaccggaaaagacgcgatctacgaacttttaagtgaaaggttcgggagttgtatttacgcacggggaaggtattag

SEQ ID NO: 29261 - DNA, 291 bp, Glycine max
  Peptide Sequence Number=SeqID_120946
atgaaagataagagggatgaggaagaaaaactagaaaaacaaaagaaaaagaaggatagtaaggccttgtcttcaaaggccaaggggaaggaaatggaggaaaaggattcctccaagaagattgttaagaaggaaaatcattttgcgacaaaaagggaaacatcccttagcaccaccatacctcttgagcttgaggttattcctcaagtaaaggagttgttggatgagggtttggttcgcaagagcttaaatccttgtgctttgttggtgcccaaaatagggactcattag

SEQ ID NO: 29262 - DNA, 464 bp, Glycine max
  Peptide Sequence Number=SeqID_120947
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatccccatggttatcgaatgcagacagtgctgaaattggttatgcatttggctaaaggccattcaactttgcaagttgtttttggtctgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 29263 - DNA, 489 bp, Glycine max
  Peptide Sequence Number=SeqID_120948
atggctgaatcatccaagaagcgcaagggtttatccacctccgctgcggcaactagaacatctcgtcccgaagccaccggagcacccccggctccaattccaccctccttgtcatcctctacactattttcatctgatgaacagtgtatctgcacattactttctgaggtgtatggcatctcaatggttattgatgaatatgttttcttttcattgacacatctacccaatcaaggtgcaccttttgagggtaccattgttgacgactggaagtttgattactctagtcttgatgcctgccgtatggtctgcaatgatcaggcgaatatgaccggcagactgtttgccggttcattaacattcgattgtcacatcatgcactatatcattgttcgcattctattacccagatcatcaaacttagctcaagcctctgaagaggatttaatattgatgtgggcttttctcaccgttcatccgattgactag

SEQ ID NO: 29264 - DNA, 168 bp, Glycine max
  Peptide Sequence Number=SeqID_120949
atgtgggtgcaagccattggtctgtttgctcaagcgagttgtgctcctgagtttggacttccaagaccgttcaatcagagattactcatcttgcatgttgttgggggtgccgtaaaacaacgactgctggtaatcgattaccagagagcaaatctcaatttgaaatga

SEQ ID NO: 29265 - DNA, 360 bp, Glycine max
  Peptide Sequence Number=SeqID_120950
atgattctcttagcgggtgtcgcaacctacccttcggcgggagggcgacgcgagactcatgggtgcgtcttccaagaaaggaaaatgcatggaatcgccaccaatgtttattcgaggaaaacgtcgaaaaaccggaaaaggtgtggtctatgtactttaagtgtgaaaggttcgggagttgtatttacacacggggaaggtattagcaccccgcgcgtccgtcccaaaggacgacagcctttaatcaagagagaaacgttaaggcgttggaccattaacgatctcttggtgtggtcgacaaaagcagggcttttgctcctacgtatcctcaattgcgatgaggaaatcagacctacgtag

SEQ ID NO: 29266 - DNA, 198 bp, Glycine max
  Peptide Sequence Number=SeqID_120951
ggaggggggagctgtttcaaaatgttcagcccctttggcacttctctctctttcgaatttgcttggaaaaatcgtttccgtgaagaaaatctacgccgaggcgcttccgaaacgcttccgtaagcgattctgtggatattcttcatcgttcttcaccgttcttcatccgttcttcgttcgttcttcgttcttcaacag

SEQ ID NO: 29267 - DNA, 450 bp, Glycine max
  Peptide Sequence Number=SeqID_120952
atggcccacaaattttgttttgaagcacttgatcaaagtttaagagacattatcacaaataaatcaaactcgaatcaaatctttggaggcaaagttatagtattcggtggagatttttgccaaatactaccagtcatcccaagaggaagtcgctcagacattataaatgcaacaatcaattcatcctatctatggaattcgtgtgaaatattaaccctgacaaaaaacatgcgcttacacagcaatctagcatcagttgatgaacaagaaaatgccacatttgctaaatggattctggacattggagatggaattataggtcatgaaaatgatggttatgctacaattgaaattcctgcccacctactcattactgaatatgatgatccaatcagtgctatagtcaaatcaacattcccagacttagatcagcaccacaataatccttaa

SEQ ID NO: 29268 - DNA, 352 bp, Glycine max
  Peptide Sequence Number=SeqID_120953
atgactagaggcaatccatctgacttacaaccctttgatcctgagatagataggacatttcatagattagttaggcatcattttataccttttgatcattctgagcattccattactggtgaatatgtgcattctgttattggtgattttgaacatcctgatcttgaacattataattttgagcattctgagaacatggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcag

SEQ ID NO: 29269 - DNA, 258 bp, Glycine max
  Peptide Sequence Number=SeqID_120954
atgccacctaattacacgtggggccagtcatgcacagtgatgctcatgctcctcccccatcctgaagggaagagcctcctcgacagcccgacgaggtccacgaagatcaggtctgaaagaggagttatgcctcaaggggatgtccagattgttctacccccgatcctcgtcgagaggccgagcacccaacactgttgccctcaacccaacctcacagacaaccaatattcttgtccacagaaggaccacccgacataa

SEQ ID NO: 29270 - DNA, 210 bp, Glycine max
  Peptide Sequence Number=SeqID_120955
atggctcaagcaccacaaccagcggcacgcatagagccaccagtccaacaggtcgaaccaaaccctggagcaattcctgacactgttggcagattaagagttcgaccgcttcgacgcagttatgaatcagacgggggtaacttctcctatgaccaacatgacgttggcaagttcgaccacgtcagcgtctgcttttgccccatggaataa

SEQ ID NO: 29271 - DNA, 288 bp, Glycine max
  Peptide Sequence Number=SeqID_120956
atgggcatcttatctggtagtaattgggagtggaagatacaatggaggaggcatttctttgaccacgaaattgataccttggcagcattcacggctgacattgagggtatccaaattcaacctttaactcgggatttcctcagttggggggctgatcctgctggttattactccacaaagtcagcttacaacctccttaaggctgaggccagctctaattctgaagacagcaactataagaccatttggaaattgcaaattcccccaagagcatctgctttctcttag

SEQ ID NO: 29272 - DNA, 225 bp, Glycine max
  Peptide Sequence Number=SeqID_120957
atgaatgtatatatacatgattttgatgatgccaaagaagaatcaaacaaggctgcttcaaaggacaagcattgcttcaagattaatacaagattgcttcaacaaacaaagccttgcttcaagatttctttaagatcaagccttgcctccaaacaaagtgtttccaagacatgcaaggctctggtaatcgattaccagatgtttgtaatcgattatcagcaatga

SEQ ID NO: 29273 - DNA, 630 bp, Glycine max
  Peptide Sequence Number=SeqID_120958
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccgcttccttttacatacaaagagttcaatgtaacattgagtgagaatgatgatgttacttgtggtaccagggaaagggagtttaaggtggtaatcaagggtaccgagctcgaattcgtaatcatggtcatagctgtttcctgtgtgaaattgttatccgctcacaattccacacaacatacgagccggaagcataaagtgtaa

SEQ ID NO: 29274 - DNA, 498 bp, Glycine max
  Peptide Sequence Number=SeqID_120959
atgcttctatgttttcttctgtgcttcctccttataattctcatatttattggaggtctcactagaaggatcagcaccaatccgtgcctgttcctcctctatcagctcaatatctttcctttcacgtttgcttttgtaaactacactgtaatttacaaaacaaaagttgaaaggaaagatattgacctagtagacgaggaagaagcacagattggtgctgatcgttctagtgcaacctcgaataaagctaagatttataaccaggaggcatctgaagcactagaacatacgaagaaaagagatactggccatcaaggtgtgtcattggagaataagacaggagattcaactatgctgaagatgggagattcagttaaagttgtgataaaacaagacatgaagaaaattacattagacgatgttaatcaattctccttcatcatgatcatttcgattagcatgaacgtcatcagcttcttcttctccgacacgttatga

SEQ ID NO: 29275 - DNA, 404 bp, Glycine max
  Peptide Sequence Number=SeqID_120960
atgggggataagcttcatcgtcgagagggaaacagcccggatcaccagctaaggcccctaaatgaccgctcagtgataaaggagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaaggggcctaagatcagccgaaagggcgtagtcgatggacaacaggtgaatattcctgtactaccctttgttggtcccgagggacggagagctaggttagccgaaagatggttatcggttcaggacgcaagtgcccctgctttttcagg

SEQ ID NO: 29276 - DNA, 225 bp, Glycine max
  Peptide Sequence Number=SeqID_120961
atgaagatgttgagctggactagctcgctgaacccatgtgtaggagtattttggagtaacccatggaagcaatcaagggcttcgctcagcgattcaagagggtattggtggaaggatgagatttacacctttccctcaacagtcttggactccgggaagtacttcttcaggaacttctccaccacctcttcccatgtccacatgctattcctcttaaatgagtga

SEQ ID NO: 29277 - DNA, 213 bp, Glycine max
  Peptide Sequence Number=SeqID_120962
atgggtaggaaatggaatgacataccttttgaatctgagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 29278 - DNA, 466 bp, Glycine max
  Peptide Sequence Number=SeqID_120963
atgggtcaacttcaacggcaagccttccacaaagcctatggtaagatttgggacctagctagggacttccagctagtgccgactgtgaaagagtttgaagaaatcctggatgcccactgggaggaaggaagccatatcttttctctgggttctatccctccacgacaagagttgccaaggaaagggcaaaggccttggcaaaatcaaggcaaatggacttcttttattgacatcttggcgcttttgatctttggaggtgtcctctttccaaatatggaagggttagtggacctagcagtgattgacgctttcctcgcctttcatcatggcaaggaaagcccggtcgtcgccattttggccatgcatgacacgttcgatcagagatgtgaaaagagcggcgcaagaattgtttgttgtacaccggctctctatgtgtggctggtttcgcacctttttctccaagaag

SEQ ID NO: 29279 - DNA, 319 bp, Glycine max
  Peptide Sequence Number=SeqID_120964
atgatcgaaagttttcaacaacaacaacaaatgtcagttctagaattgtacgtagaaaaggatgttgctggtggttctatgtatcattctgcaaattctgttacgtcatgtggacataatctatctcatcatgagtcggaactgccacgaaatataaacaatttacatgatgatgaagatgatgatgatgattatcttgcatctaactcatacgttgaagactctttggatgaagatgatagtgttgatggaatatctaatacagacgatgaagtcactaacatcattgaaccaatttcaattgttcacccaacagaag

SEQ ID NO: 29280 - DNA, 648 bp, Glycine max
  Peptide Sequence Number=SeqID_120965
atgggtaccgcctggcgcgccgggcgcgatctgaaacgtcgtgagatcggcggcaaaaccggtaccaccaacagttccaaggacgcctggttctccggctatggcccggataccgtgacctcggtgtggatcggtttcgacgatcaccgccgcgatctgggccggtcgacggtatccggcgccatcccggatcaaatttccggcggtgaaggcggtgccaagagcgcccagccggcgtgggacgacttcatgaagaccgcgctggaaggcatcccggagcagaaagtcacgccgccgccgggcatcatcagcgtcaccatcgacaagagcagcggcaagctctctggcggtggcggcggcagccgttccgagtacttcatcgaaggaacgcagccgacggactacccatcgcgcgataccggcaccacgttgaccgatccgggcgggccagagaaatctggccctttttttgttcggcgcgaagcgtatcagcgcgatgcgcgcaaaaacgcctcggagaggaacagcgcgctgacgttgcgcgcctcacggaaatccggttccgccagcagcgccatcatgttggcgatcggccagagcacctgcggcaggggctctggttcatccccttccaggctctgcggatag

SEQ ID NO: 29281 - DNA, 387 bp, Glycine max
  Peptide Sequence Number=SeqID_120966
atggaagggttagtggacctagcagcgattgacgctttcctcgcctttcatcatggcaaggaaagcccggtcgtcgccattttggccatgtatgacacgttcgaccggggatggaaaagagcgctgcaagaattgtttttcaccaactctgctagcatggaggggcgtctgttaagtatgtgcctttcacatagcatcagcgtgggtttctctttcatcccctcactttcaggcacaacgacggagggatccggagttcgccttcttaaaaaaggcatacgctggggatgctggccattgaagaaggaaacaatttccgagagctccctatttggggaattgcatgtaatgggatttcttcatcggcttggctcattccacccatga

SEQ ID NO: 29282 - DNA, 484 bp, Glycine max
  Peptide Sequence Number=SeqID_120967
gtgcacgggtctaccgtctagccgttggtactccgcatcttcacggagaattcaatttcaccggttactgccgccgtttaccggggcttccattcaaagcttataacacttctccttccgaccttccagcaccgggcaggagagcaccccttctcccgaagttacggggtcattttgccgagttccttcgacatggttctctcaagcgccctagtatactctacttgttcacctgtgtcggtttggggtacggtcagttcaccgggaggatcgccctcccaattcgaagttttttcctggaagtttcaaccttgttgactatgacaacagtcgcgactataaacagactcgcgactatggcagggcggccgagtcagaaaggctttgatgactcaagcaaggttcatcttagggaaaggagagtgaggggaagagggggcagccctcggcccgatcatccaattcactccaacagacaggcatg

SEQ ID NO: 29283 - DNA, 178 bp, Glycine max
  Peptide Sequence Number=SeqID_120968
acttatcaaggtaatccttgtggcgtctaccctaacttatcttccttcaccggaagtggcgtctaacctgacttatcttccttcactagaagtggcgtctatcctgacttatcttccttcaccggaagtggcgtcatccaaaagctctacagcctgtatcaagcgatccgccccgtaa

SEQ ID NO: 29284 - DNA, 283 bp, Glycine max
  Peptide Sequence Number=SeqID_120969
acacttgctaacattgccacacctcttgggcttgagtttattcctcaagtaaagaagttgttggatgagggggttcccatgaaccctaagagaataaaggtcattcctgagtggcccactccaccaacaccactcattgtgttggtgaggaaccatgttccttcatgggaagatgcccaggaaattggtgtcgagggaaggagcccagagtatgaagaacctcgggatttgaggtcaaatcctttccaaggtggagggaatgatgcaatcctacccagcaagg

SEQ ID NO: 29285 - DNA, 274 bp, Glycine max
  Peptide Sequence Number=SeqID_120970
cagccgtggagtggatactacctacacctactccatatcgactagtggagcggttcaagtgatagaggtgtcatcctttgaagcggatattgaagaggaccaaaagaagttacctcttgagcctgttgtggatgctcttgacttcccagaggatgatgaggacccactccttgatgttgatttcccagaggatgttatgtcaacatctgaggcagactctacagagaagagtggccctggagggacagcgaatagtgacgactcttcatcgtag

SEQ ID NO: 29286 - DNA, 1195 bp, Glycine max
  Peptide Sequence Number=SeqID_120971
atgcaagctttccgcaagacttacggaaagatcttagagttgaccttagcagaggtatccatagaagccattgcatcactcacccaatactacgaccagcctttgagatgcttcacattcggagacttccaattagtaccaaccattgaagaatttgaggaaattctaggatgtcctctcgggggaagaaaaccatatctttcatccgggtgtctcccctctttgagcagaattgcaactgtggtcaaggattcagcaagaggtttggaccacataaaacagactcggaatggcatagcgggcctaccacaggggtacctagaagacaaggcgaggggtatggccaatcaaggagattgggtcccgtttatggatgtgttagctttactaatttttggggtcgtcctctttccaaacgtggatggtttggtggacctagcagcaatcgacgctttccttgcctaccaccatagcaaggaaagtccggtgacacaagacatccatgtccgctccttgagccatcgctcgtgtactgaaaaggggagaatagattgggaccagcttttggccgggataggaggtagaacaatcagttggttcccccgatggaaggaaggaaaagaaggagtccttttctcatgtggaagatacccaaacattccgctggtaggaacgaggggttgtattaactacaatcccgcgctcgctataagacaactagggtaccccatgaggggagcaccgacggaagaaagcatgtctcctttccttgtgagggatctcggcgcacaaaattccaagactatacaaagaatccataaggcatgggaaaccccgttaaggaaagatcaagagcttagaggcattcgtaatggcatcattggtgggtaccacgaatggctgaaagttcatatacgaggtttagattggctcgccaagttaaaagtcgtcagcgaagagaattttgaagcaccggaagaggacgaagaagtccaagctctcaaaagtgagttaggaaaggcaaaacttgccaaggagaagttcaagttggccgctacacacatccggaaggagtgtgccgggttacgggaagagaatgcaattaccgcaagagcccttgaacaagagaccaagagggctcgcaaggaagagtatggccggaacaaatttcgtggagctttatggggtagcaata

SEQ ID NO: 29287 - DNA, 234 bp, Glycine max
  Peptide Sequence Number=SeqID_120972
atgccaatctctccctgcagatgtatcggttggaatcgcacccacaaagacacccagtggacccggagaagtccaacaggtccctggggtttccagctctggttacgggcctctgtagtcctacagggtgcccgttcccccccggcaaggtcacgtcatcatagggatcgcgcctgcaaaacatccagtggacccgaagaagtccaacagggtcttggaattgtcaagctctaa

SEQ ID NO: 29288 - DNA, 354 bp, Glycine max
  Peptide Sequence Number=SeqID_120973
atggagagaagtatgatagatgctgccggtggtggagcccttggagacatgactcctactgaagccagaaacttgattgagaagatggcttccaactcccagcatgaggtagctacaaactcatctgcctcatctgaaacaaagaagcttgaaggcaaactagatgcattggttaacttggtaacccagctggccttgaatcagaaatttgtagctgtcacaagagtctatggtttatgctcctctgctgaccaccatacagacctctgcccttccatgcagcaacctggagcaattgagcaacctgaagcttatgctgcaaacatttacaatagacctcctcaacctcagtag

SEQ ID NO: 29289 - DNA, 138 bp, Glycine max
  Peptide Sequence Number=SeqID_120974
atgcggggttaccttatcgttacccacaccgttcgtcaaccatgggaacacgagcccattgacgcacagagactaacatcgtcttctgcaccttttgtcgtcctaacccgtgaagtcagggggacacgagcccgttga

SEQ ID NO: 29290 - DNA, 159 bp, Glycine max
  Peptide Sequence Number=SeqID_120975
atggaaaaagatctcaagaagactctcaaattcttagatgctacaaatgcaaccaacttggcttacattgcatgggatgacaatgacttatccgatggttcagaaaagaagatcaaccttctaaccaaagactgtgagagcgatgagaacatctcttaa

SEQ ID NO: 29291 - DNA, 304 bp, Glycine max
  Peptide Sequence Number=SeqID_120976
atggatggcaccttcctgagcgacgcgaaaacctacaatcgcgaacgttttcttgcgcagtatgcgcgcatgaaggagcaaggtattcgctttgtggtggccagcggtaaccagtattaccagctgatctccttcttcccggagattgcgcatgagattgcgtttgtcgccgaaaacggcggctgggtggtcagcgccggggaagatgtttttaacggtgaactgtcgaaaacgcacttcgatactgttgctgccgtgctaaacgacgttcccggcattgagattatcgcctgcggcaaaggca

SEQ ID NO: 29292 - DNA, 375 bp, Glycine max
  Peptide Sequence Number=SeqID_120977
atggcagaagaccacccacagaggatgacgctagaggactactctagctttgctacacctcagtacttcaccagcatagccagactagatgtgcaagcggccaacctttcatatccacattccctcatccagctaattcaaggaaatatatttcatggagtaccagaagacgccattcacctcaacctattttctttctctatggcaagtgaagtgaaaagatggcttcactcattcaaggggaatagcctgtggacgtgggaagagatggttgagaagttcctgaagaaatacttcccgaagtccaagaccgctgaggggaaggtggaaatctcatttaatcatgtagaagaaaatacaacggggatcctctag

SEQ ID NO: 29293 - DNA, 457 bp, Glycine max
  Peptide Sequence Number=SeqID_120978
gggagcgaatgggattagataccccagtagtcctagccgtaaacgatggatactaggcgctgtgcgtatcgacccgtgcaatgctgtagctaacgcgttaagtatcccgcctggggagtaccgaagaaccttaccagggcttgacatgccgcgaatcctcttgaaagagaggggtgccttcgggaacgcggacacaggtggtgcatggctgtcgtcagctcgtgccgtaaggtgtgggttaagtcccgcaacgagcgcaaccctcgtgttagttgccaacattagttggaaccctgagcagactgccggtgataagccggaggaaggtgaggatgacgtcaagtcatcatgccccttatgccctgggcgacacacgtgctacaatggacgggacaaaggatcgcgatcccgcgagggtgagctaactccaaaaacccgtcctcagttcggattgtag

SEQ ID NO: 29294 - DNA, 267 bp, Glycine max
  Peptide Sequence Number=SeqID_120979
atggacattttcaggaattctggacaacccagtgaacaatgctggaacccacatgcatcctttccacaattcaacaagtatatataccaaggtttttacaagcatatttgcaccttctacaatggcttaatttcttctcaatcatcatcagtctgcaataatctcatgtacaactaccatgcctatctctctcatacgggtgccacatcattcaatgcatcgttgcttcgggttcgaggtttaggtttaacagcatcttcatcatag

SEQ ID NO: 29295 - DNA, 2501 bp, Glycine max
  Peptide Sequence Number=SeqID_120980
tttatgagtttaatggctatatcaatagatcagaaatcacccttaatttgacttttaaggtttggagaatgagttctgtgcaaggaccagttgtgtgcccttctgtccgtgccaaacaagtagggttctgcagcattccaatgattggggcagtgaaaatgaacgttagacgcatccgaagtgaattttggggtctcaatggcgccaaggctaaacccggttttctttcttgccatataaacacgcgaaagtgcaagactgtgcattgtacttttaactcaccctccaatgacagtggaagtaccgctgacaatttcaatgaaaaagatgaagattatgttatttctagtgtaattgaagctgttgaggtgaagagtggagcagatggtttcataatcaaaatgagggacggaagacacttaagatgcgtccataacaatccccagggaggacatcttccagattatgcaccacatcctgctattgtattgaagatggaagatggcactggtcctatacaagtcaacaagtacttggcatacagtgatggtatgagagtaattgaatcaggcaaattgtcaacacagttccctggtatggatggccgactattcactgaaatggaccggccaagtggtcaaccttgtgccgagaccacggagtttaatcttttacacaatatgttgaaagctgttgttgaagaacgctataaagatgctgggttctctggtcatgatgaaaggagggagaggaaatcagattttgagaactcggaagacgataggcgaacaaggattggtagcttgaaaaagagagcaatcaatgcttcaagcaagttcaggcattctcttaggaagaagagcagcaggagaaagactgcaagccgaagcaattcggtttccattgaggatgttcgagatgttaaggagcttcaagcagtggatgaatttcgacaggcgcttatattggataacttgttgccaccgagacatgatgactatcacacgttactgagattcttgaaagcaaggaaatttgatattgagaaagcaaagcacatgtgggccaacatgatccactggaggaaagaatatggtactgatacaattatggaggattttgaattcggtgagttgaatgaagtcctgcagtactatccacatggttatcatggtgtggataaggaaggaagacctgtttatattgagaggttaggaaaagttgatcccaataagcttatgcaagtaactaccatggaaaggtatttgagataccatgtgcagggttttgagaaaacgtttgctgttaagtttcctgcatgttctattgccgcaaagagacatatagattcaagtacaaccattttggatgttcatggtgtgggtttcaaaaatctaaccaaatctgcacgggaactcatcatgcggctgcagaaaattgatggtgattactatccagaaacattatgtcgaatgtttataatcaatgctggtcccggttttaagctgctttggaacacggtgaaatcatttcttgatcccaaaactacttcaaagataaatgttcttggaaacaagttccataacagattacttgaaattattgatgcaagcgagctgcctgaatttctaggtggtaattgcacttgtatggatcgaggtggttgtatgagatctgataaagggccatggcaggatccaaacattttaaagatggttcttagtggtgaagtacaatgttctagacaaatagtaacagtttctaatgatgaggggaccgtgatcgaatgtgataaggcatgttatccaatgccaataagaagtagtgatacatcaacagcagaatcaggatctgaagtcgaagatattacttctcccaaagcaagtgggaattatacaaacccaaggttaactcctgtccacgaagaagcaagattgattggtagggctagtggtttctctgagtatgatgagtatgttcccatggttgacaaggctgttgacctcgggtggaaggagaaacaagtaacaactcaaaactcatatggctcaacagaaaatttcctactgagggctggaaaatctggtggaaactgtgcatatatcttggctgttatcgtgggcttctttgttgccatttttacttttgttcgttcattagcacttcgtgtgactaagagaatacaagacacaaaatctgattctgccaaaaatatgcccaagacgactgttgattcaataaccaaggaagaatctcgtcccccgtcaccggttcccagattaacaaagacagaattcatctcatctgctatgaaacgccttggtgagcttgaagaaaaggttgacatgctacagtcaaaaccaaatgtgatgccatatgagaaagaggagctgctgaatgctgctgtttatcgtgtggacgcattggaagcggaactgatcgctacaaagaaggctaaacagacagcaattcctgctgttttaccaagtctcaaattctaa

SEQ ID NO: 29296 - DNA, 129 bp, Glycine max
  Peptide Sequence Number=SeqID_120981
atgatgcaaaccattctcgacgctggttgtgcttcctccggtggctacttgcgagaatgcagagaagcgacgcggcaagaagcgacgcaaccagagcaacacgacaagaacatgttgggagcacgatga

SEQ ID NO: 29297 - DNA, 1926 bp, Glycine max
  Peptide Sequence Number=SeqID_120982
atggcctcatccagtggaacatcgagcatgtccaatattcttcttcagagctctagctctgaggaggatttgcagcttctaatggaacaaagaaaaaagaagagaaagcaatcgaatcgcgaatccgcgagaagatcaaggatgcgaaagcagaagcacttggatgatctcattgcacaagtggaccacctcaagaaacaaaagagcctaaccctcatgaaagtggacatcaccacaaaacactatctcgaggttaaggctgaaaattccattctctgggcccagaagactgaactcacccaaagccttcaatcactcaatgatatcatcgatctcatcaacaccaccaacggggtctaccacacggattgctatgatatcaataatcataataatcataacaattattacaataataacaataatttcatgaatcccatgcacatggcatatcttaaccaaccaattgtggccactgcagacaacatttgcgtcacggtggaatcattcatgagtgatggtaaggacaggtcaggtcaccaaagtggcatggtacttgccactgtccaatgttttggaaaaatggatgtcggtgtaagcgtaactgtgcaagaggaagtaagttattgtttcttgctggaaattgaggtggcttttgagttttctattgtgattttcggattgactgttatgtttggtgcagctatcatgggatcagcttgttgtgttgctgcaaaggatcctaatcttcctaacagaactggaggtgaaagtttgcatagagatgttgtgtgttcaccatcggggagctttcaatgggatagccgggggcgttttgctggtgaaattgagaatccttcttatcacacctcccatgtggacagtagaaatgtcagcatggagctaaaaggttcgttaagttctgaaagaggtaatttatcagatggtggaagcattgttgagaattctgtaacacctatttttctgaagtcccctgttgatgaggcattggttgcaaatctgatgacccccacttctgtcttctcaacgcctacagcagatcctttgcctaatcacaattatcaccatcttcccagctctaccccaacaagatgggcacatcgatctccagcacaccctctgttgagacagatttctgatagtcgaatcatggatctgaaattgccagacaactcaatttctgaaggtaggccatcatttgtactctcaacttgcagcaatgaaatgacagctggatccatatgcggatcatctgatggctggtcaatgcgcaccttctctgagctggtggcatcatcacaaagggaaaggtggtcttttgatagtgagtgtttcggatctggtcgtcacaagataagtggatccagtagcaggttctcgtattctccctccatggaactacaatcttgtggggcttgctcaaagctattgactgagagatcaacatggagcaaccagaagtttatttccaacagtgacctgtcagttgttgctgtactggtctgtggccattcatatcatgcagaatgtttagaggctatgacatcggaggcagataggtatgatccagcatgtccaatttgtatggttggagataagcacttgtcaaagttgttgtccagaaaaggtcttcgggctgaatcagacataaaggccaagaaccacaagatatccagaaaccgtgtagttgatagctaccttgatggtggttttgatgtttttgatcgtcaaaaaggcattgatttgagaggaaaagtgtcaaaaatggaacctagctccagtgcaaggagctcatttggaaagccattcttgaggcggcacttttcacttggatccaagtggagccgttccctgtccgagaatgattctgccaggaagaaaggcttttgggcaagatatcgttaa

SEQ ID NO: 29298 - DNA, 678 bp, Glycine max
  Peptide Sequence Number=SeqID_120983
atgacggtcatcaagtacctaagcggacaatacctcagatatagggaccttaactatgcttatttcaatagccacaaagtcctacattgcttagaggtcgtttataaacactgtcttctttcccttttacaaggacaaaaccataatggtcatcgaacacctaagtggacaatatctcgaatatgggcaacctcaatgattataatgatgaaggaaattaggagcaggcaggataatagaaaacacattgcacaacaccctaaaggcacacatggccgcccaggcattcagatgcaattgggaactcgacaacagacttataagatagaaataggggtagggccttattccagcgactgtgccactcaaagagacgacgacatcaacatcagaagggatcgtgacaccctcaacgatgacatcaccgatgtgaacgtcagaaacatggtcgttagcagcgtcagaaccaccatgaaggtgggtgggattgttgttgaaactctcccctataggacaaaaggacattgtagaggtttaacgacaacatacctgggagaagaaatagatgaaagggacgtcagagaaaagaaagttgatcgaaacaaagcgatcagaggaagggaagatggccagaaagagaacaatgaaaatgtggagaaatttttcatccttttatag

SEQ ID NO: 29299 - DNA, 753 bp, Glycine max
  Peptide Sequence Number=SeqID_120984
atgacgacactcattcgtattgacattcaccaaatggaaaaaatgtgcgatgaaagttgctgcatacgtgtcgaggttcagagaagattgtcactttatttattttttaataattttggctactcattttgcagcaatgctataaatgaaaacgatgtcaacaacatcattctgtcataccttatacataattgctacaaagagtcgtcagagtcattcatttcttgcactgggatgaagcagcctgcagatcatttggagaacatggaaaaaagaaaaagaatctttcaccatgcattggagggaaatgtacttaaggctattgagctcacggggcagctggcacaggatattctggagaacaataacgatttgctgtttgatcttctaagccttcattttgtagaccttgtctgctctaagaaatggacagaagctttagagtttgctcagaccaagttgagtccttatagtgtgaaggagcagaaatatatggacaaaatagaaggttttatgtcccttcttgcttatgagaatccagtggaatgcccaatgtttcatctgatcggcttagactatcggcaacaagttgtggatagtttaaatcaaactattctcgcacactttaaccttcccatccacactgccatggagcggcttatacaacagacctcagtagttagacaatgcttaagccaggaggatggggggcctccaccattttccttgaaggattttcttaaaagtcgatga

SEQ ID NO: 29300 - DNA, 675 bp, Glycine max
  Peptide Sequence Number=SeqID_120985
atggccgccaaatctgaaggcatccaagaagaaatgccaagtatggaagagggtgtttcttcccctagcccttccagaacctgtaacgtatcacataactgttgttcaaaccatgttgtagccctcgcacagaaggtcagtgaccatgatcacttgcatgttttgatcacttgcatgtttggttttcaggttttcgcagaagttattggtacatattttgtggtatttgccggttgtggctctgtggcagtgaataagatctatggctcagtcacatttccaggggtttgtgtcacatgggggctgattgtaatggtcatgatttactctcttcgtcatatctctggagctcacttcaatcctgcagtcaccattactttggccatctttcgccgcttctcatataaacaggtgccactctacatttttgctcagttgctggggtcgatccttgctagtggcacattagccctaatgttggatgtaacgcctaaagcttattttggaacggtaccagttggatccaatggccagtctttagttgctgaagtcatcatcacttttcttttgatgtttgttatatctgctgtttctacagatgacaaagcggtgggtgactttgcaggagttgcagttgggatgactataatgttgaatgtcttcattgccgggtaa

SEQ ID NO: 29301 - DNA, 627 bp, Glycine max
  Peptide Sequence Number=SeqID_120986
atggggaacaccatgggaaggagtaaaaagaccaaggtgatgaaggtggatggagaaacgttcaagctgaagactccagcgagagcaaacgacgtcgtaaaggactaccccggtcacgttttgctggactccgaagcggtgaaacatttcgggcttcgggccaaacccttggagccataccaggaattgaagcccaaaaagatttactttctcgttgagttaccgaagattcagcccgaagaggaaaaaacggcgctaccgaggagggtgcgatccagtgggatacgcggcatgaacgcctcggataggctcgagcttctcatgctctccaaacgctccgtttcggacctccctctcgccaggcagggcccgaagatgggctccgatgggcccatgagggtcaagatgaggctccccaaggcccatttggacaagttgatggaggagagcaccgacgggtccgaggtggcggagaaaatcatgagtttgtatgtgggaaccaatgccggcgagggtggtggcgttgcggcggtggcggaggaaggtggcgcaaagacggtgtacaatcacaaaccacgtggggattcaacatcagataccgaggatctagttaattcgttgagctga

SEQ ID NO: 29302 - DNA, 387 bp, Glycine max
  Peptide Sequence Number=SeqID_120987
atgtatattttaaccatattgttatattatcagagcatcttttggtggtcactaattgctggaaggttgcctgggaggacagacaatgaggtgaagaactattggaattctcacatccgaagaaaactaataaagatgggaattgatccaaataaccataagccacaccaaagcttccctcgttctcatgcttcaactgagggtgcatcaacatctgagtccatgaacaaagtccctttcttcaaatccagtggtgtagctgccagtgatcataggatttcgttcacaaaagaagaaacagcaattatttcatcttcatcaccccctttgaatcttgatcttacaattgctttaccttcgcctatgcttcgtgctgcggaagaataa

SEQ ID NO: 29303 - DNA, 3417 bp, Glycine max
  Peptide Sequence Number=SeqID_120988
atgatgttcccgcaattcggagcaacggcggaatccctgagcaaggcgtcgacggcggtgttccggatcggcaccgacgcgcacctctacgacgatcccgaagacgtcaacatcgcccctctcctcgacagcaagttcgattccgagaagtgcgaagctctcaagcgccttctcgctctcatcgctcagggcttcgacgtctccaacttcttccctcaggttgttaaaaatgttgcgtctcagtccttggaagtgaagaagctggtctacttgtaccttctgcattacgctgaaaagcgtccgaatgaggcgttgttgtcgattaattacttccagaaggacctcggggacacaaatccgttggtgagggcatgggcgctccgtgccatggctgggatccgccttcatgtaattgcgcctcttgttattgttgctgtgcaaaaatgtgcgagagatccttctgtctatgttagaaagtgtgcagctaatgctcttcccaagcttcatgatttgcggatggaggaacatgcttctgcaatcgaagagattgtgggactacttttaaatgaccattccccaggagttgttggagctgctgcatctgcatttacttcagtttgccctaacaatttttcattgattggaagaaattacagacggttgtgtgagattcttcctgatgtggaagagtggggtcaaataattctaattgggatccttctgcggtatgtaatagcgaggcacgggcttgtcaaagaatccatcatgttttctttgtacaataaagacattgacaatttagaggaagacgagtcctacattacttcaaaagaagatgctggctattccattgataagactgtatctgaattagccactatggtcttccagtgttacattgaagggccagatgagtacttatcacgctcaagttctacaaatagggttgctcctaaattagatgtatcacaatatacatcttgcagtaatgatgttgtgaagatcctgctgcactgtacatcaccgttgctatggagtaataacagtgcagttgttcttgcagctgctggtgtacactggataatggcttctaaggagcacatcaaaagaattgttaaaccactcttgtttgtcctgcgatcatcgtctgcctcaagatatgtgaaattcggaattgatggtttcacttttactcggaaattttattcagttgtgaaaaagattattaggagagatgaggtattgtgcaatatacaagtgtttgcaaaagcaatcccatctctctttgctccacactaccaagattttttcatatgctcttcagattcctatcagataaaggcgctgaagctagatgtactttcttctattgccacggattcatccatttcattcatttataaagagtttcaggattatatcagagatccaaataggagatttgctgctgacacagttgctgcccttggtctatgtgctcagcgacttccgaaaatggcaacttcatgcgtggaaggattgttgactctggttagacaagaatttttttgtggtgaaattagatccttggatggagaagagggtgtgctaactcaggcaattatatccatcaaatcaattataaaattagaaccatccagttatgagaaggttataattcagttagtctgtagcttggataaaatcaaggttccagctgcccgtgcaatgattatttggatattgggggagtattgttctttgggtgacataattccaaggatgttgagtacagtacttaagtatcttgcccggtgttttacttcagaagcattagaagctaagcttcagtttcttaataccactgcaaaggtcttactgtgcattaagggagaagatattttgaccgtgagaaaagtttggagttatgtaattgaattggccgagcgtgaccttaactatgatattcgtgatcgttcacgtttcttaaagaaacttctctctagtaatttggagtctcaacatggggaagaagaaaatagtgaatcacaaaaaagagaccaatcctatatacttgcagaatgcatatttggtggacagacaaaagccatgacagttccatctgaacccattgattaccggttttaccttcccgggtctctttcacagttagtattccatgcagctccaggctatgagcctctcccaaaaccttgtagcctgccatacactgatcttgatcagtatgatggagctgctaagagtgattcagatgaggaggatgatactggcacatctgggtctttggatgagggaagtgcttctgattatagttctgaacagtctattactgcttcaggcgaagccagtggcagtgatgaatctgtttctggcaatgaaggagaagataatgctgatccattgattcagatttcagacactggcaatgtctgtgaatatcagaacagtggggctccctctggcacagctggttttcgggacttgatgtcaacgaagtctcttgagtcttggttagatgaaccggccaggtcatctaaaggaagtgagatagagcaaagtcaagttcgtagatcatcagcaagaataaccattggaaatattggaaaccgggttaaacctaaatgctacactctcttagatcctgtaaatggaaatgggttaaaggtgaattattcattttcatctgagacttcaagcatatcctctcaccttgtatgtttggaagtattatttgaaaattgttctctggagcccatgttcgatatagtcttaatagaagaagattatagcaaaagctctgattctactgatcgaacatcatcaccaactgaaaataccttaaaatttcatgtcaataaaccagcactggtttccatggaggagattccttctctggagcctggtgagacagcaaaccggactctgcttgttcgtttccatcaccaccttttgccactgcatctggctttattttgcaatgacaagaaattccctgtcaagttaaagcctgacataggatactttataaaaccccttcccctcagtattgaagatttcagagataaggaatctcgccttccagggatgtttgaatatgtgagaagttgcacctttaccgatcacattctagagctgaacaagcgcagcaactctttgacagaggacaaattccttgtgatatgtgaaacgttagcactacagatgctgagcaatgcaaatctttctcttgtatctgtggatatgccggttgctgccaaccttgatgatgcatctggtctgtgtttgcgtttcagcagtgagatcttgagcaattccatgccatgcttaattacagttactgttgaaggtatatcagtagtgaaggagtggttctatttattatgttcaatggacttctctactctcattggtggatag

SEQ ID NO: 29304 - DNA, 3099 bp, Glycine max
  Peptide Sequence Number=SeqID_120989
atggctcactgttctaacaaggataatgacccaagtgcatctcaattaagttggtggtatgtagatatatcttatcaagaactaaaaaagggaagttacaaagtgatgcgctcagatgaaactttcatttgtccgtactgtcccgagagaaaacaggattataagtacagggaactccttaatcatgcttctggggtgggtcggagtagttcagaaaagagatctgcaaaagagaaggctaatcatctggctttagtgaaatatttggaaaaggatcttgcgtatatggatggcccatcaaaacctgtagataaaggtgccaaattattaagcccaggagaaaccgtaatgcctcactgttctaataaggatactgatataagtgcatctcaaataagttggtggtatgttgatacatcttacgaagaactcaaaaagggaagccacagtgtgaaaacctcggacgtgactttcatctgtccatactgccctaggagaaaacaggattatttgtacagggaactcctagaacatgcttatatggtgggtcggagtagttctgaaaagagaagtgcgagagagagggccaatcatcttgctttagtgaaatatttggaaaatgatcttattattattatggatggcccgtcagaacctgtggataaaggtactaaattaagcctaggacaaactgtagtggctcaatgctctaacaaggagactggtatgagtgcatctccaataaattggtgggaacttcttgagcatgcttctggggtgggccagagtagttcagaaaagagacatgtcagagagaaggccactcatctggctttaatgaaatatttgaaaaatgatctcaagtatttgaatgatccatcaaaatctgtgaatgaaggtaacccccccgttaacagggtgcatcagattagttcacaagagagaagtgtcagagaagacgctactcatctgccttcagcgaaatacttcaaaaaggatcttacaaatgtgagtgatccatcatcaaaacctgtaaatgaaggaaccataacaggaagcccaggagaaactgtaattggttgctgctctaacaaagatagtaatataagttcatctcaaattgggcgggaaatccttgaacatgcttcaggggtgggtcagagtaaatctcaaaaaagaagtttcatcgaaaaggccaatcatctggctttagtaaaatatttgaaaaaggatcttatgaatgtgggtgctccgtgtccatcaaaacctatggatcaaggtaccaaaacaataagcccaggagaaactgtaatgggtcactactctcataatgacaataatataagggcatctcaaataagtgggtggtatgtacataaatcctatgaagcactcaaaaagggaagccacaatgtgaaaacctcagaaatgactttctcttgtccatactgccccaataagaagagaaaacgggattatgtgtacagggaaatccttgaacatgcttctggggtgggtcagagtagctcagaaaagagaagtgccattgaaaaggctaatcatcttgctttaatgaaatatttggaaaaggatcttatgattgtggatggtccaccaaaaactgcagatgaaggcagtcctcctttcaattttgagaagcagtttgtgtggccatggactgggatcgtggttaatattcctactagactgacagaagagggatgttgtgttggggaaagtggttccaagctgagggatgaataccgaagtaggggatttaatccacaaagagtccgcattctttcaaatttctgtggtcattctggaactgcagttgtggaattcaataaaaattggacaggcttagataatgctttagcatttgaaagagcatatgaattagatcatcatgggaaaaaagactggtttgctaatacagagcataagtctggtatttatgcatggattgctcgagctgacgactacaaggtaaacaatatcattggggaacaactgcagaagatgggggatatcaaaacaatatctgaacttatggaagaagaagctcgaatgcaggataaacttttgtccagcttgaataatactcttcaggtcaagaagaagcgattaaaggagatggaagtaaaatattatgagacttcacatcgtatggacattgtaatgggggaaatagataagctcactcaaggtcacaatcaagagatgaagaaaatacagtcaagtgcaactcaacacttccagaatatttttaatggtcatgaaaggcttaagttgcaacttgaatctcagaaaagggagcttgagttgaggagaattgaattggaaaaacgtgaggcacgtaacgaaagtgaaagaaaaaagttggaagaagagattatggagaatgcattgaaaaatagctctcttgacatggctgttctggagcaacaaaaagctggtgaaaatgttttgaaactggctgcagatcaaaagcggcaaaaagaacaatttcatgctaaaatcatcctgcttgaaagacaactggaagtgaaacaaaaactagaattggagattcaacaactgaaaggaaaattaaatgtcatggcgtacatagaagatgatggggacacagaagttctgaataaggtggatgctttacataaggatttaagagaaaaggaacagtcactgcgagacttggattccctgaaccaaacactgattattaaagagcgtcagagcaatgatgagctacaggaagctcgaaaagaattgattaatggcattaaagagatatcttgtcgtgctaatgttggtgtaaagagaatgggggagcttgatattagaccattccttgaagctatgaagaaaaaatataatgatgaggatgcagaagatagagcttcagaactgtgttcgttgtgggaagagtatataaaggacccagactggcatccatttaaaattaccatgattgaagggaaacatcaggaaatcatagatgatgatgatgaaaagttgaagggactgaaaaatgagatgggtgaaggagtctacaaagctgtgagggaaagagagctaccttgcaagagggagtaa

SEQ ID NO: 29305 - DNA, 384 bp, Glycine max
  Peptide Sequence Number=SeqID_120990
atgttcaaaattcagcaatttggttattcttgtcccctaaaggccaacatcgaatcttccatcttgcacacaacgctcctgcacgatcctgtcactaaggtaagcaggcctcacaattcttctcttgtttgttgtttgtcacaacagagaagagaagagggaggagaggggtgtgattctggaagggtgagggtggcgtggttgcgacacggtggagcagagaggaagaaggagaagggtgcaattctgggaggtgagggtggcgcagtcgcgatgtggcagaggagaaaggaaggaggaaaatggtgcaacactgggagggtgagggtggcacggaaatgcattgatgtagaacttaaaagaacaacactttccttccgctag

SEQ ID NO: 29306 - DNA, 2181 bp, Glycine max
  Peptide Sequence Number=SeqID_120991
atggccatagctcggttagttcggcaagcaaagcgccctcatgggttgtgggtgaagatgacagccgtgaccatattgggtctctgcttcatctttgtgtggggggtgttttcgtcttcttcaacctctgtcaccacccaaagggagagctttgaggacattgcagaacccgtgtcctcttcctcttctcacaaacctcagaagttgaagaaagatgaatccaaaaagggtggtggtggtggaaagagtgagaaaaaaagtaacgggaatgggtcttcccaccctgaacaacacaagggaaaagacaaccaaaagaaagagaagaaacgcgtgcataaggaggataataaggagaaagggaatcatcgaggggatgaagatcctcaaccacaacatgaccaggaagagaaagagaagcgtgaagaggaggtggaggtggagggtgaggaggagagagtggatcgagagagtgagggggatgtggatgctgatggtggcggtgatttggctgaatctgtggatcagggtgattctgaggcggtggaagatgtggaggaggtgagaaaagcaagcaagggaaaagtgaaaggacccttgttcaatccaaatgctacctatagctggaaactgtgtagcactagaagcaagcataattacattccctgcattgatattgaagttggtggtgggaaggtaccaagctaccggcacacggagaggagttgcccgaggacgcccttcatgtgtatggttcctcttcctcatgaagggtatggatttccactaccctggcctgaaagcaaattgaaggtgattatggagaagttagataaggtagcttatggaaaagttaagatattgtataagaatgttgcacacccgaaactagctgcatacataaaaaggcataattggttgatggagtctggagagtatcttacttttccccaaaaccaatctgagttgaagggagggattcatcactatcttgagtccattgaagagatggtaccagacattgaatggggtaaaaatattcgtgttgttctggacattggatgtacagattcgagctttgcagctgctctccttgacaaggaggttttaacattatcactaggcttgaagaatgacctagtggacttagctcaggtggcgcttgagcggggcatcccagcagtgattagcccttttagtagaaggaggcttccttttccaagtcaaagttttgatgctatacattgtgggggctgcggcataccttggcattccaatggtggtaagcttctattagagatgaatcggattctacgacctggtggatactttattatgtcaactaaacatgacagcattgaagaagaagaagccatgaccacattgaccgcatctatttgttggaatgttctggcgcataaaagtgatgatgttggtgaagttggagttaaaatatatcaaaagcctgaaggaaatgacatttacgaattgagaaggaagaaggttccaccactttgcaaagaaaatgaaaatcctgatgcagcctggtatgtttccatgaagacttgtttgcacaccattccaattggaattgaacaacacggagcagagtggcctgaggaatggcccaagaggctcgaatcttatcctgactgggtgaacaacaaagagaaagtggttgcagacaccaaccactggaatgctgttgctaataagtcatatctcaatggattgggcatcaactggacaagtatccggaatgtaatggacatgaaatctgtctacggaggattggctgttgctctctctcaacaaaaggtctgggtgatgaatgtagtacctgttcatgcaccggatacacttcccatcatttttgaacgtgggcttattggtatataccatgattggtgtgaatcatttggcacttatccaagaacatatgaccttttgcatgctgatcatttgttctcacggctcaaaaacaggtgcaagcagcctgtgaccattgttgttgaggtggaccgtatattacggccaggaggttggataatcatacgtgacaaagttgaaattctaaatccgttggaggaaatattgaaaagtatgcagtgggagattagaatgacttttgctcaggacaaggagggtatcttgtgtgcacagaaaactatgtggaggccttga

SEQ ID NO: 29307 - DNA, 1039 bp, Glycine max
  Peptide Sequence Number=SeqID_120992
atggtcctcgacacaggcagcgaactctcctggctccactgcaaaaaactcccaaacctaaactcaaccttcaacccactcctctcttcttcctacaccccaaccccatgcaactcttccgtctgcatgactcgaacccgagacctcactatccccgcttcatgcgaccccaacaacaaactctgccacgtcatcgtctcctacgccgacgcctcctccgccgagggcaccctcgccgccgaaaccttctccctcgccggcgccgcgcaaccaggaacgttattcgggtgcatggactccgctggctacacctccgacatcaacgaggatgctaaaacgacaggtttaatgggcatgaaccgaggctccctctcgctggtaacacaaatggtgcttccgaaattctcgtactgcatctcgggggaggacgctttcggcgtcctcctccttggcgacgggccttccgcgccgtcgccactgcagtacacccctctagtgacggcgacaacctcgtcgccgtacttcgaccgtgtcgcgtacacggtccagctcgaggggattaaggtttcggagaaactcctgcagcttccgaagtcggtgttcgtgcccgaccacaccggagcgggtcagacaatggtggattcgggtacccagtttacttttctcctcgggccggtttacaattccctaaaggatgagtttttggagcagacgaaaggggtgctgacccgaatagaggatccgaatttcgtgtttgagggggcgatggacctgtgctaccacgcgccggcgagcttggcggcggtgccggcggtgacgctggtgttctcgggggcggagatgagggtgtcaggggagaggctgctgtatagggtgagtaaagggagggattgggtgtattgcttcacttttgggaactctgatttgttgggaattgaagcttatgtgattggacatcatcatcagcagaacgtgtggatggagtttgatttggtcaagtctagggtagggttcactgagaccacgtgtgaccttgcca

SEQ ID NO: 29308 - DNA, 1851 bp, Glycine max
  Peptide Sequence Number=SeqID_120993
atggatctcaggcattttagaagtgaattcttgcccacaacacttaatccatcttcaacctacctccaattttctccccttagacctttgcacaaaaccctaaacctaaaattccaatcacagaaacgctttgcagttgtttcattctcccaaaggcctaaaacaattagtgaattctcaattttggggcagaattcatggtgcacaagggacctcagatcttatgctggccgtagcaagaagtctggtggtgctggctcctctggcggtcgaattgaaggcaatgccgagttccggagacggttgaagcgcaatgccagggcaagaagcaagaagtacgccgagtctctattctaccggctgaaaaacccgaaggggggtgggaactatcccgataacttcaccgaggatgagctccaacaaattggcctcggctatgatcgaatggtccggttcatggagaaggatgacccaaatttacgtcatccgtatgattggtacaaatatggtcaatatggaccctattcttggcgtggagttgttgttggcgagccagttcggggtcggttctccgatgagtgtgtgacaataatcagtgaagtgaaggaccatgaggagtgggagcagattgaacaaggtgaaatggctgaagagtatggggaaaaattgaagcagctggatcaaagtaaattaaagtatttttgggtatttgtaaggcacccaagatggagaatttcagagcttccttggcaacaatggacgttagttagcgaagtagtgcttgaagctggtaagcagagattagataagtggaatttgatgggtagacttgggaacaaggctaggtcatcgatagggcaatgtgctgcatggatgagacctgatattgtatatgtgaagaagccagttttccagtgtaggtttgagccacaggatgactttttcaagccaataattccatttctgaatcctaaaacagaacaggattttctttttgagttagagaatgatgatggtagtgttgagttgtgtacttattttggtggattgtgtaagattgtgaaggtaaatcaaaaggcatttgtcgatgatgtggtgaatgcatatcagaaattgagtgatgagaaaaagtcaaaatgtttggagtttctgttgaaaaatcatccagtggaattgttgcatccatatactaaagagtggaaggctaagttggaagagatggagctgggttgtgatgctcctgatgaagaagatgatgctattgttgatgatcccgatgaaactgaagttctagattggattgaggatgaaggtagtgatgatgatactaacattaccgatgacgatgaggatgaagaggagctgattgatgatgatgatgatgatggcgatgaagaccaagatctagtcatggacatggaagaaagtgaagatggaaaatttcatgccatggaagaggatacacttgatgaggatgagaaggactttaactggaatgaggagttccaaaaggcattaagtagtggagaagcaatggagaatctggcaaagaaggctcttgagttcaataagaagttgaataagaatcaatttatgatgaacaaagtagaggaagaaacagcgctctcagtagatggagacgaaactgccttgagaggcaagcgagcaaaggtcagtcaagaagagtggaagtatattggagttggtccatggagaaaaaagattaagaagagcaaaattcctccagagctatttttgcgagcggttgttagaccattcacttacagaaatcttgttaaagagattgttttaactaggcatgcaattttggatggtgaaattggtgcctaa

SEQ ID NO: 29309 - DNA, 1551 bp, Glycine max
  Peptide Sequence Number=SeqID_120994
atggcggaggaatctagcgggcagcacgacgccacgtggaagagcaaccacgtgggcatccgacgtggcaccctccttccgctgaaaatgattctgggaatggccatcaataatggtgggggaagcgaggaaggggcattgcagacagtgctttacatgtggggctaccttcccggagctctgccgcagaggacgcccctcttgacgccggttgccgttagggttccgccgtgtgattactcttggaatgatgtttgcggcggtggctgtggattcgctattgctatatctgaatcggggaagctcatcacatggggctcaacagatgatctaggccaaagctatgtgacttctggcaagcatggggaaactccagagcctttccctcttccaacggaagcctctattgtaaaagctgcagcaggatgggctcattgtgttgctgtaacagaacatggagcagtttatacatggggatggaaagaatgtattccctctgggagggtatttggtgaaccatcaacaggggtaagtcttgagaaagatgtgccaggaaggcatagtcaagtgtccacagagcaagtgagccctcgttctcaaggctcaagatctactggaggtactgcctccagtaacagtggagaagaaagtacaaagcgaaggagagtgtcttcagcaaagcaaacagctgaaagctcgtcatccagtgatgatagtctgacagcattcccgtgtctagtcacactaaatccagggataaggatagctagtgttgctgctggtggacgtcatacgctagcgttatcagatacaggactggtgtgggcttggggctatggaggtgaagggcagcttggtttgggttccagaatacgcatggtttccactcctcatcttgttccttgtattgattcctcttattatagtaaagatagatctgctacactggctcgaggaaacatggattcagagggacaaacttttagagttcctggaagttatataaagagaattgcttgcggaggtcgacatagtgcagtaattacagatgctggagccttgcttacttttggttggggactctatggacagtgtgggcaaggaattaccgatgatgaactaagcccaacttgtgtatcttccatattgggtatccacatagagagagttgctgcaggactgtggcatacagtctgtacatctgctgatggtgatgtgtatgcatttggtgagaatcagtttgggcagttgggaactggtgctgatcaagctgagggtggaaaagttttctgctggggatggaacaaatatggacagttaggagtagtgttgggtattagtaacattgtcgtggaatcatctcttctaagttgtgatttctgggcgttgcagctgggcctcggtgacgttgtgtacccaaaaatgttgcttgtggttggtggcatactcttcttctggccgagtcccccacttgatgtcatggtttatcagaggctcttgacccaattgttagatagtggttcggcaatgtatatgaacatacgggcagtg

SEQ ID NO: 29310 - DNA, 1338 bp, Glycine max
  Peptide Sequence Number=SeqID_120995
atgaaggtcaaagttatatcacgctccgtggatgagttcacccgagaacgaagtcaagaccttcagagggtgttccggaattacgatcccagccttcgtcctcaagagaaagcggtggagtatgtgcgtgctgttaatgcagtgaagttggacaagatttttgcaagaccatttattggagcattggatgggcatatagacgctgtttcgtgtatgacgagaaaccctagccagttgaaagggatattctccagttcgatggatggagatggagaaggttggaagagaagaggaggaaatttgttttgctatgttgtggatttccaaaatatgtttcctggtcaccgtggtgctgtacgaggcttgacagcatcaacagatggacacattcttgtgtcatgtggaactgattgcactatcagactctggagtgttcctttactactcttatggagtcagatgactcaactaagagcactgttgaggggtgctgatcaccagtgggatggcgagcattttgccacagctggtgctcaagtagatatatggaatcacaataggtctcagccaataaacagttttgaatgggggacagatacagtaatttctgtccggtttaatcccggagaaccaaatctcttggccacctcagctaggtatgtgagattgccttggccacttgccgcaacgatgacctctgctgtggggtggattgaaggagcggctgttgcgttcgttatagcactggtgtggtatggcgctattgcggcaaatgaagatggtaactgctatagctatgatgctaggaagttagatgaagctaaatgtgttcacaaagatcatgtttctgcagtgatggatgttgactactcaccaactggacgagagtttgtcactggttcttatgatagaacagtcagaattttccagtacaatggtggtcacagcaaggagatttatcatactaagagaatgcaaagggtattttgtgtcaagttcagtggtgatggaagttatgtgatttcaggaagcgatgacactaaccttaggctctggaaggcaaaagcatcagagcaacttggagtaattctcccaagggaacggaagaagcatgagtatcatgaagccataaagaaacgctataagcacctccctgaagttaaccgtattgcaagacataggcacttgccaaggccaatattcaaggcttctgctttaatgtgcgttatggcggatgctaagagaaggaaggaagagaagaggaaagcacacagtgctccagggagtattacaacacagccattacggagacgaagaattatcaaagaagttgagtga

SEQ ID NO: 29311 - DNA, 2385 bp, Glycine max
  Peptide Sequence Number=SeqID_120996
atggcgttgttggcggccagtggcggcgacaccgtcaaactcttcgacgcctccgcggtcaagcccggcgtatacactcctgccggcgatccctgcgccctcagcttcaccccttctcccggttcccaagtcaattcagtcaagtggaaccacaccaatttggttgtggccagtgctggagatgataagaagatctcgctttggcggaagaacgggaacagcatggggaccattcctgtcgccggcactgatagtggagacaacattgaggaatctatattggccatcagctttagcaacaaggcatccagatatgtatgttcaggaggaactggtcaagttgtaaggatatgggatttgcaaaggaaacgctgtattaaatggctaaagggtcatactaatactgtcacaggtgtaatgtacaattgtaaggatgaacatttggcatctatcagccttagtggagacctaatgcttcataaccttgcttctgggcaaaaggctgcggagctcaaagatcccaatcaacagatgttgagagttcttgattattctcgagttagtcgtcaccttcttgtgactgctggtgatgatgggactgtacatttgtgggatacaactggtcgcagccctaaggtttcatggataaagccgcattccgcaccaactgctggtattagcttctctccatccaatgacaagatcattgctagtgttggccttgataaaaaaatgtacatttatgattctggatctagaagaccatcatcttacatttcttatgaagcacctttctcttcgttggcatttagagatgatggttggatgctggctgctggaactagtaatggccgtgtggcattctatgatgttcgtggaaaaccacaacctgttgctgttcttcacgcttatggtagttctgaggctgttacaagcttatgctggcaaaggtctaaaccagttgttgtcgatgaaagaaattgctctgcagagactgctcttgtgggagatacagttgaagattcaatactaatgccagatcctttaccttctgcaacttcatcaaacaattctctttctacatcagtggcaagtactaggaactctggttggctgggtgcctcctttgatggttcttcacttatggcatccggcagtggttttacatccagcatactaaatgcatctactgccgaagaaactcctcaacgaaaccatttatggccaggtggaaccctgtctaggttgcatgctccccgtgctagttataacttcaaggatgacatggaggtcttctcccctcttgtggatgttcaaccattaacaccctcactatgggatgaaaatgggataaagaaggataatttattttccgacaggaaacctttgttgtttccgtcatctagtcgaagattttcaaattctgaggatggaaccagtgatcatccaatatctgattggaaatctggctcaacaaccaagcaggatattacacagtcttcctttccacttgtggggtcaactcctccccctccatcttcaaagaatgaagattcttctatcactcctccagaagcttggggtggtgagcggttaagtgataaatatgcttatacacgtcagcctgtcaatgcaccatctcgttttggggtgttggcttctgctggtcagacagcaggatcaatgttatctggattgcaggatacatcctcatccgtgggtgttagttcctataccagttcaagcctaagttttgcaaatttacgggccaaggatgcttcttcaagccaggaaacttccttggggtttactgatcacatgttctctgctcctatgtccatcaatacaaaaaccagccttggacaagcaattgattccccaaaaatccttgattccccaagaatgtcatcttttaatcgaagattttctacttatgcagaaagaataagcactacatctaccttaagcgatggagtgtccctttcagttggttcacctaagattaagaaatcaggagcagaaaccagagaagaacttctaaatagcttgctgttgaagtctgatatatctgctccaatagaatctggctcattaccactgacaagtggaataatctcacagccgaaagcatctcagccagatgcacaaggatcttcatttacacttcagctttttcaacggaccctggaagaaactctggattcctttcagaaatccatacacgaagatatgagaaaccttcatattgaaattttgagacagtttcatatgcaagagacggaaatgtcagctgtaatgaactctattcttgaaaaccaagctgagttgatgaaagaagttaagtctcttcgtcaggaaaaccagcagctcagacaaatgctttga

SEQ ID NO: 29312 - DNA, 291 bp, Glycine max
  Peptide Sequence Number=SeqID_120997
atgaatcgcacatctacaccaagacaggaaaagaaggaagatttgtctaaggatgaagatattgtgagtcaagtacccttatgtgattgctcatggctcattggtgtaaatctccctggtgtttactcccctcgaattccccaacaactggtatcagagtcgatggttcgacttggtgatcgactcagacgagtaagatggcgacaatggatcttggccttggagatcccttgtatcgaatgtctttctagcggtgggtccaggcagcgtgtggaagagactcacacttga

SEQ ID NO: 29313 - DNA, 2040 bp, Glycine max
  Peptide Sequence Number=SeqID_120998
atggatagtgtggtctctgttataccagacagaatccataagccacaaacaacaaggtcttgggactttcttggcttccccgaaaatgttcaaagaaacattatagcagagagcaacacaatcgttggagtgatcgatagcggaatttggcctgaatctgatagctttaatgatgctggatttggtccaccaccaaagaaatggaagggcatttgccagaacttcacttgcaataacaaaataattggagcacaatattttcgcactaagggtttttttgagaaagatgacatcaagtctccaattgatacaactggtcatgggagtcattgtgcttccactgctgcgggaaacccagttaggtccgcgagtctattagggtttggctcagggacagccagaggaggagttccatcagcacgtattgctgtgtataaagtgtgttgggcaacgggttgtgacactacagacatccttaaagcctatgatgcagccattgcagatggtgttgacatcctttccgtctcagtgggagctacacagcttacacacaacaagtattttaaagacgtacacgcaataggagctttccatgcaatgaagaaaggcatattaacatcaacatctgcggacaatttgggtcaattaggtccttactcaacctcaaagtttgcaccttggttgcttagtgtagctgcctccaccatagataaaaagtttttcactaagatccagttgggaaatggcaagatctatgagggagtttcagtaaatgcatttgatctccacaatatacagcatccattaatttatgctggagatgcatccatcatcaagggtaacagttccaatgctaggtattgccaagaaaacgctttggataaagctttggtgaagggaaaaatccttttgtgtgataacattccttatccatcatttgtgggatttgctcaaggggctgttggtgttataattagaagtaatgtttctttagctgtgtcagatgtatttcccctgccagcggctcacattactcacaatgacggggcacaaatatattcttatttaaagtcaacaagtaatccaacagcgactatatttaagagttatgaaggcaaagatccattagccccatatattgattcattctcaggtagaggtccaaacaaaatcactccaaatattctaaagcctgatttagctgctccaggggttaacattctagctgcatggtctccaattgctcctatctccggagttaaaggagataagagaatttcaaaatacaatatactatatggaacttcaatggcatgtcctcatgttactgcagcagctgtttacatcaaatcatttcatcccaactggtctcctgcagtgattaaatccgcattaatgacaactgctactccaatgcgtgatatacttaatcatggaaatgctgaatttggttatggtgctgggcaaatcaatcctatgaaggcagtaaaacctggattagtttacgatgctactgaaattgattatgtcaagtttctgtgtggagatggttatagtggatttatggacaaaattacaggagataataaaaccacttgtacaccagcaaatacaggaagtgttttggaccttaatctcccatcttttgctctatccacaactcgctcaaagtatattagtgccacttttagtagaactgttactaatgttggatcagctaaatccatatataaagccacagtaactacacctccatcatcttcttccttaaacatcaaagtagtgccagatgttttggtcttctcgtctttggaggagaagatgtcgttcacccttaagattgaaggaagcattaacaatgcaaatatagtttcttcgtctttggtttgggatgatggcacttttcaagtaaggagccccgtcgttgtttatgttcctccatgcacatattgctactacttgctccatgcagctaaacagatgaatcctgtgaataaccgtgatgctgaattcgcatatgcatgctgcaggccaaattga

SEQ ID NO: 29314 - DNA, 1149 bp, Glycine max
  Peptide Sequence Number=SeqID_120999
atggaagctagggttggtatggcggtggatggtggtggtgtacggaagttggtgcagccgccgccgaagcagattggaactgtttctcagcttctcgccggaggagtcgccggcgcgttcagcaaaacctgtacggcgcctcttgcgagacttaccatcctctttcagggaatgcattccaatgttgcagctttgagaaaagtcagtatatggaatgaggcttcacgaattatccatgaagaggggtttagggctttctggaaagggaatctggttaccattgctcaccgcttaccttattcgtcagttaacttttattcgtacgagcactacaagaagttgctaaagatggttccacgacttcaaagccatagggataatgttagtgcagatctttgcgtacattttgttggtggtggcatggcaggaatcactgctgctacatctacttatccattggatcttgtaagaacacggctggctgcacagccctttcccctttggccctacgcattttacctccatctctgccctagctttgatgagtattatcaatcaatgatatgtgcccaagttgtcatccagacaaattttacctactacagaggtatctggcatgctttacacacaattagcaaggaagagggaatatttggcctttacaagggacttggaactacactcttgactgtagggccaagtatagctatcagcttctctgtgtatgaaaccttgagatcttattggcagtcaaatagatccgatgattcacctgtcgtgattagtctggcttgcggcagtctttcaggcattgcatcatcaactgactactggtctgatgtaaaaattgaatttctgttgagtagaatgggtgtagttcaattcaattcatctgttatactatatgcagcaacatttccgttggatcttgtaaggcggaggaagcaacttgagggggctggtgggcgagctcgtgtgtatacaacaggcctctatggtgtgtttaggcacataatccggacagaaggctttcgtggtctttacagaggaattttgcctgaatattacaaggtggtgccaggtgtaggtatttgttttatgacttatgagacgttgaagatgcttttagcagatattgctactggataa

SEQ ID NO: 29315 - DNA, 1704 bp, Glycine max
  Peptide Sequence Number=SeqID_121000
atgtcgtcgtttcgttcggctgatttcagcgaggatttgtggagaacggtgtgggaggtgagcaatttggtgctggaggacatggacaaggagataaaaaaagagaaaatgaagggcttcttgcagtgtgaagaagtcaaggagatgtgcagattcgccggagaagtcggcattcgcggcgatttgctcagggaacttaggtttaagtgggcgcgtgagaagttggaggagcatgaattctatgagggtttggagagattgaggaaagagacacaaagtgagggcaatgcaattgatgttcctaaggaggagaaggagaaggttgttgttggacttcccaagaggagagggaagataaggtacaagatttacgggctcgatctctcggatcccaagtgggcacaagttgctgataggatccatgaggcagagcaggtgttttggccgcaggagccaaaaccgatcactgggaaagcgaaaattgttaccacgaagattctgttgtcgaaggaggaggaggaggaggaggaggaggaggatggtttgcaaagcctgttggctgagtgggtggagcttgtgcaacctagcagggtggaatggatggatttgctcgacaaattaaaagagcataatcctggtttgtactttaaggtggctgaaatggtattgactgaagattctttccaaacacatgtatctgactactctaggcttattgatatctatgctaaagagaatcgctttgatgatgttgagagaatgttaaagaagctgaatgaaaatggtctacaagtagatgcttcaatagccagtactttggtcctcatgtactgcaagagaggtgatcttgcccatgcaaaagaagcatttgaagtcttgacgagcctgggcttccaaccagacgcacatgtctacaactcaatgatcacagccttggtgaataatggccagcctaagttgggtgagaaattgatgagggacatggatgatagacatattccaatcacaaaggacatatacatggcattgctccgttctttttctcaacttggtgatgctgtaggagctgaacgaatttcaaacactatgcaatttgcaggaatccagcagggtatggatatggagacatccaccctgcttattgaggcaagtgcacttgctgttccttgtaaccctgatcaggcaagaagccattttgactacatgataaaattggggcataagcctgatgataggtgcaccgctagcatgatttcagcttatgagaagaaaaactacttggacaatgctttaaatcttctattggaattagagaaggatgggtttgagcctggggttgccacttattctgttcttgtggactggttgggtaagttgcagcttgttgacgaggcagagcagcttttaggcaaaatagctctgctgggcgaggctcctccctttaagcttcaagtgagtctttgtgatatgtatgcaagggctggaaatgagaaaaaggcccttcaaagcctaggtgttctggaagctaggaaggatgaattaggtcaagctgagtttgagagaattttaagtggccttattgatggtgggtttcagaaggatgcacaaagaataagtcagatcatggaggcacagggttttgatgcatcaagggttaagtttaaactttcaaaacctgtctcaagagcaccgagttttagatga

SEQ ID NO: 29316 - DNA, 345 bp, Glycine max
  Peptide Sequence Number=SeqID_121001
atgaagaaggtgaagcatttggtggaactgccaggtgcaaagagcaaattgtctctgtggaaggctgatcttgctcaagagagaagctttgatgaagccattgaaggctgtaccggagttttccacgtggcaacccccatggattttgagtgcaatgaccctgagaaattaaatttgattggaaatgcagaacaaagtgataaatcctacaataaacggattgctagacatcatgaaagcatgcgtgaaggccaaaatctgaaagcttgtattcacatcattagctggaactgtggacgttacggagcacccaaaccctgtcatggaagagaattgttggagtga

SEQ ID NO: 29317 - DNA, 1290 bp, Glycine max
  Peptide Sequence Number=SeqID_121002
atgaagcttggtttctttatggtctttctagttctctatatgatactggaacgagggatcttgttattaccccaagtagaagctgctgctgctgatggatttgtgaaagtaagaggggtgcagcttatgttgaatgggagaccctactatgctaacggttacaatgcatattggctgatgtatatggcctctgatccatctcagagaaacaaagtatcatctgtgtttcaaaagggtacaaaccatggacttaacatagccagaacatgggctttcagtgatggtggttacaagcccctacaatactctcctggatcctacaatgaagacatgttccgggggctggactttgtgatatcagaagccagaagatatgggaccaagcttgtgttgagtttggtgaataactatgataactttggaggaaagaaacaatatgtggactgggcaagaagtgagggtcaggccatagattctgaagatgatttcttcactaaccctctagtgaaggaatactacaaaaaccacgtcaagagtgtactcacaagacgtaataacttcacgggggtcgtttacaaagatgatccaactataatggcttgggaactcatgaatgaaattagatgcccttcagatcaatcaggaaacacggttcagggttggattactgagatggcatcttatttgaaatccatagatggaaaccatttgctagaagctggtctggagggtttctatgggctgtccaagcaagagtctaatccgagcttccacgtaggaacagatttcattacaaacaaccaaatccctggcattgattttgccacagttcattcataccctgatcaatggcttccaggttcaagtaatgaagaccaaatcttatttttggttcgttggctcaatgatcacatacaagattcacagaacattcagaagccagttctgtttgcggagtttggagtagcaacaaaaaatatcagtactgactcaacattaagggaccaatttttcaacttggtctattctgcaatctattcatcagcaagtgatagcggggcagctgttggcggcttattttggcaacttctagctgaaggaatggattcttttcgagatggttatgaagtgccattagatgagagctgctcaactgctactttgattgctcaagagtctgaaaagctaaacagaatccggatgaagatatttcccagagtgaaaaattctaagaagtggaacaaagcaagggaagttagaatcccacgatggcagggtggtgctaattaa

SEQ ID NO: 29318 - DNA, 966 bp, Glycine max
  Peptide Sequence Number=SeqID_121003
atgggcattgcagacttgggttgttcctctggacccaatgtcttaagggtcatctcggagatattagatactgtgtattccactacatgcctcttggatcgtccagcacctgaattggtggtgtatttgaacgaccttttcaccaatgacttcaacaacatctttggctcattgccatctttctacagaaaacagaagcaggaaaagggaagtgggtttggaccatgttttgtttcagctgtccctggtactttctatggtaggcttttcccaagcaagagcctccactttgtgcactcttcttctagcctccattggctttctcaggttcctggtggattagaagatggtagtgggagagcattgaacaagcaaaagatatacttatcaaagagcagtcctaagtgcgttctagatgcttattctcgacaattcaaaaacgatttttcagtgtttcttgcttcacgttcccaagaaatagtagctgggggacgcatggtcttgtctctaatgggcagagaaacaatggacccaaccactgaccatagttgctatcagtgggaactcttagcacgctccctcatgaccatggtttccgagggtcttttagaagaggaaaaggtggattcttttgacgctccatactatgcaccatgcttggaggaaatgaaaatggagattcaaaaggaagggtcattcattgtggatgagcatgaagcttatgaaatcgattgggatgctggaatgaaattgcaaagtgattcccccacagttacgccattaacgagtggagaacgagttgcaaggaccataagggctgtggttgagtccatgttggaacctcatttcgggtgtcacataatggatgagctgtttcgaaggtacgcagaagttgtagaggaccatttatccaagactaggaccacatacattaatttggtcatttctctcgtcaagcaaggttga

SEQ ID NO: 29319 - DNA, 585 bp, Glycine max
  Peptide Sequence Number=SeqID_121004
atgtcgttaagcacttacgacatcagttttaaaataaccgatgttaatatcacactaaatcgagcagttaacatcggttatttcaaaactgatgttgcacaaacatacaactccataattgggttccctgaccccaattatggtatcaaaactataatcaaccagaaactctcctcacctatctatattctcccgttagctcctcgcaacgttgttttgagatctcttaggttcatgtctgttactctgagcgtagagctcttgtcataccctaatttcgtctggggactattgtttgatggcatgcaacctttggttgaccgcttcgagggaaagaagaaagagagacgggagtcatcatggactaatcacggagagggcgaagacagacgaagtcaatgttttatctttactttcctcttatctatgataaaagggatgcaaatagcaaccagacccacttgggccttccaggatgttcctccagaaggcggttgcatctggaggaagcaacctggctcgcctgggcgggctgagctcgcctgggcgaactgggtggcaagctcctcccctattttgctataa

SEQ ID NO: 29320 - DNA, 348 bp, Glycine max
  Peptide Sequence Number=SeqID_121005
atgatcgtcattgtcaatgcggaagcttgtggttacgtgagcatgaactactaccaatatatagatgttgtttatacaaacgagcacatcttaaaagcttactccgcacaatggtggcctcttgggaatgaagcggctattcctccttctgatgacgcatggacacttatccctgacccaactacaattcgtgcgaaaggtcggccaaaatcaacaaggataagaaatgagatggattgggtcgaaccatctgagcaccgaacaaaatgtagtagatgtggagccgaagggcataacaggcgtcggtgtccaatgcaatctgagcgtgggagttgttcaaatcgttga

SEQ ID NO: 29321 - DNA, 252 bp, Glycine max
  Peptide Sequence Number=SeqID_121006
atggcaaaacgacaattgaaagtgatatcgctattgatatcgatcagcgtaatcagtggatgcaccgtgtttcctggaacccatttatcgaccagcggaaaagaagtcgtaaaacaagaagatgctgacttcgatatcgataagatggttaacatttaccccgatgacaccgaagttgttggactcgatgcgtccgacaaaggtggttgctcagccgaatgcgcagttggacgcatcgctacgcacgtatga

SEQ ID NO: 29322 - DNA, 543 bp, Glycine max
  Peptide Sequence Number=SeqID_121007
atgacattgctacttagcaatattctgcccagcgaccgcaatgccaatctccccctgcaaaagtatcagttggtctgtgtcgtcccgacatggggatcgcacccacaaagacacctagtggacttgaagaagtccaacagggccctggggtttccagctctggttacgggcctctatcggccctatagggcgctcgtccccccagcaagctcatgccatcatgacataggtaaggattgtgcccgcaagacacctagtggacccgaagaaggccaacagtgtcttggagttgccagctctaaatacgggtctctatcagttcaagggagtgcctgttgcccccagcagggtcatcaggccccctaccaatcgagttttcatctagaagtgctgcgtctccaggcaggcgcagggcgaaacaccacagcagcctggggatggccggcagcgggcaacagacgcaccgccatcacctctagagttcacctcagctcatccacaaaaaggttagagcgttgcttacgacccatggccgaccaataa

SEQ ID NO: 29323 - DNA, 268 bp, Glycine max
  Peptide Sequence Number=SeqID_121008
atggaagccaatgcggttatagttgccgctactagcgctgtcgctaaggtgaacccgatgctcccatctggcctcaagcaaatgaatcatccaacctcaaatatggatgtcaataactccactcccatactcattaagagccaacaacctcaatctgatcatgcacatgtctctcgacccatggaggagacacatggaatgccccaccacaatctagccgacttcgagccttgcctcggatatgccactgaacggcaagcagttggtg

SEQ ID NO: 29324 - DNA, 279 bp, Glycine max
  Peptide Sequence Number=SeqID_121009
atggaagaaaacagggaaaaattggttgtgttatctacaaggatattgtcgcaacatgcccttttgcgggcgtgcgaggcgaggctcacgggagcgctttccaaaggagtaaagatgcgcggagtcgccaccaacgtttatttgtggaaaaaccgaaggaaaccggtcaaaacgaaaattctaagttcgggagttgtatttacgttcgaggaaggtcgacaaaagcggggcttttggtcctacgtaccctccatcgaagaggaaatcagacctacgtag

SEQ ID NO: 29325 - DNA, 195 bp, Glycine max
  Peptide Sequence Number=SeqID_121010
atgcggggttaccatatggctacccgcacctttcgtcaactaggggaaaacgagcccgttgacgtgcagagactaacatcgtcttctccgcctcttgccatccagggacagcgagtcaggttttacactcgttgtccggaaacattcaagcctgacgacgcgcgagattcttctctgctgggcgggggcaattga

SEQ ID NO: 29326 - DNA, 237 bp, Glycine max
  Peptide Sequence Number=SeqID_121011
atggggacaaggggttgcatcagttactatcccgttcttgctataaggcaacttggctacccgatgagcaccgctagaggaagagctcgcgcctcccacgtgcgaggtttggattggctcccaagtttgagaaccgccaaaagggaggaggttgaggcatcggaggaagacaaagaggtgcaggcccttaggacagaactcgagcagccaaagaaaggttcaaatcagcagctctga

SEQ ID NO: 29327 - DNA, 72 bp, Glycine max
  Peptide Sequence Number=SeqID_121012
atgactgtgcaaaagaggctaagtcatgaagtgctaaaagtgaaagttgagcttagctcatcagtgggctaa

SEQ ID NO: 29328 - DNA, 560 bp, Glycine max
  Peptide Sequence Number=SeqID_121013
aggatccccatcagcagctctgaagatccgaaaggagaatgccgaactgagagatataaatatagctaccaccaaggccttggaacaagagaccaagagggctcgtagggaagagcacggccggaacaagttccgaggggctctgtggggcagcaatagcgagcttaagctccggagagaggaaagggaccgatcacgagtagacagtttgatcttgaaagatgagttgaaggtttgctcaaggtccaaaagaaacttgtctcagcggttatgcgagatagagaccaatatgctagccatcgtcagcaagtaccaagaagaactaaatctagccacggcccacgagcataaagtggcgaacgagtatacccaagtgtacgcggaaaaggaggctagaggaagggtgatcgacgcgttacatcaagaggcaacaatgtggatggaccggtttgctcttaccttgaatgggagtcaagagcttccccgattgctagccaaggccaaagcaatggcggacacctactccgtccccggggagatccacggacttctcaactatt

SEQ ID NO: 29329 - DNA, 273 bp, Glycine max
  Peptide Sequence Number=SeqID_121014
atgaactactttagcgactgggggggccggttccctaaaccaagcctttccttctcttcttatagcatagcccttgcttgggcaaggaaaggctctaagaagagcggatcacgtggctcgatggaggtctcgtcttgtaagcccggaagggaagatgaaagtgctccttcttcttcttactcccgcccgatcagggagaatgactcttttaaatataggatccgaccactatttggtacactggactatgttggtttccaagagatcactgat

SEQ ID NO: 29330 - DNA, 198 bp, Glycine max
  Peptide Sequence Number=SeqID_121015
atgacaaacttggtctctgcgtgccatcggacacgactgtgtctgaatggcaaaggggtgcggataaccgtaagaatgaccaaacttggtctctgcgtgccaacggacacgactgtgtctgaatggcaaaggggtgcggataaccgtaagaatgaccaaacttggtctctgcgtgccatcggacacgactgtgtctga

SEQ ID NO: 29331 - DNA, 279 bp, Glycine max
  Peptide Sequence Number=SeqID_121016
atggagagaagccataacttcaacaatgggaagagatcccaagaagtttctcctacacttaaatgctataagtgtaatcaacccggtcacataaaggcaaactgcccctcaaatgagtcatggcccgagaagaatgagaagaaaagctataaagaaagaagatccaagaaggcatatattgcttgggatgacaatgactcatctgatggctcagagaaggagatcaaccttctatccaaggactatgaaagtgatgagaacatctctcaagaagtttaa

SEQ ID NO: 29332 - DNA, 255 bp, Glycine max
  Peptide Sequence Number=SeqID_121017
atgggagaaaaagaaggaataacagcttctttggataaaatggcgaactcttttaaccgaatggtggaaagaatggatggtaaagttgatgatgaagatattcaagaagtattacgtgaggcagctttgataccagatcttagtagacaacaatgggctaaagctattaaatggttcgaccttttacacttgatgatgaatgaagattatggaatgaagaacgttgtttttttttttaaaatttggaccttgtaa

SEQ ID NO: 29333 - DNA, 870 bp, Glycine max
  Peptide Sequence Number=SeqID_121018
atggattgcaaggagatcgtggatctcatcaaggctgctggactgctgaagactgtcagcaagttgggagagtgctatgaaggcttagtcagggaattcattgtcaacattccctctgacatatcaaacagaaaaagtgatgattatcaaagagtgtttgtcagaggaaagtgtattagattctcccctgctgtgatcaacaaatatctgggcagacccactgatggagtaatagatattgatgtttctgagcatcaaattgccaaggaaatcactgcaaaacgagtccagcactggccgaagaaagggaagctttcagcagggaagctaagtgtgaagtatgcaattctgcacaggattggagctgcaaactgggttcccaccaatcatacttccactgttgccacagcattcagaatcttttgctgtcaaattaccattgccttcccaactgtattgtgtggcattatgttgagtcaacatcccaatattttaaactacactgactctgtgatgaagagagaatctcctctatccctgcattacaaactgtttgaggggacacatgtcccagacattgtctcgacatcagggaaagctgctgcttcaggtgctgtgtccaaggatgctttgattgctgaactcaaggacacatgcaaggtgctggaagcaaccatcaaagccaccacagagaagaagatggagctggaacgcctgatcaaaagactctcagacagtggcattgatgatggtgaagcagctgaggaagatggtgaagcagctgaggaagaagaagaagcagctgaggaagaggaagatgcagcagaggatactgaatcagatgatgatgattctgaagccaccccatga

SEQ ID NO: 29334 - DNA, 375 bp, Glycine max
  Peptide Sequence Number=SeqID_121019
atggatatctgtgaagatactgacattcctataatattgggaaggccattcatgttaactacaagctgcatagttgatatgggtagaaagaagcatgattttgaggatccgaaaattgattttgatttgtttgttgaagataagcctgctccagaacaaaatgtttgcttacaggtgatgaaagtaggtcaagaggttctgaagcacaaacctcgcgctaagcacatctttggtcatgtgctaagccgcaagtctcaagcgcttagcgctcaacccttgcatcttaggctgatttggtccactaagctggccaaggctgagctaagccaatttcaattcgatctgaattcggctaagcgacggcctgatcgctaa

SEQ ID NO: 29335 - DNA, 501 bp, Glycine max
  Peptide Sequence Number=SeqID_121020
gaacatgagatggaactccaacgtcttaatcagaatgaagaaactgacaaaaagaaaagaagtatagcacttaaagcctcttcatcaatgcaagaagaaaatgaagaagatgaatcaaaagatgaagaagacttctcactctttgtgaagaagtttcaaaaatttatcaagaagagaagaatcgagaggcgtaagaacttcaacaatggaagaagatcacaagaagactctcaagttcttagatgtaacaaatgcaaccaacttggtcacatcaaagctaattgtccttcaaatgaagaatggcctaagaaaagtgataagaaaaggtatcatgaaagaaggaccaagaaggcctacattgcatggtgtcgcaacctacccttttgcaggcaagcaaggcgaggctcacgggtgcgtcttccaaaggaggaaaatgcacggagtcaccaccaacgtttatttgtggaaaacgtcagaaaaaccaaaggaaactggtcatga

SEQ ID NO: 29336 - DNA, 378 bp, Glycine max
  Peptide Sequence Number=SeqID_121021
atggaggccgacgtggaggccatgaaagagcaaatgtctgcaatgatggaggccatgatgagcatgaagaagataatggaggccaatgcagttgcaattgccgctaccagcgttgttgctaaggtgaacctgatgtccccatccgacatcaatcaaatgaatcatccaacctcagatatggtaggcaaagacttgggaagtacgggcggcccccatgatgtgcaaattcaaaacgagcacgccttcccaccatatggcttgcctctcaactatacgccacccaatgtggcgtacactcccaataagaatgtcaataactcctctcctatacccattaagagccaacaacctcaaactgatcatgcacctgtctcttaa

SEQ ID NO: 29337 - DNA, 336 bp, Glycine max
  Peptide Sequence Number=SeqID_121022
atgcaattgaggattctgggatcaatttcaattcaaatcctggattttcaattgagcatggatttccattttgagaaatcaagaattctcggctatttcttgaaaattcatggcctcaatttcatattcggtggaatttttcaagtctctattttagttgggggaagtccgcgaatcgagagttttatggaacaacatgtcttgagagatcccgaatttggagtttgttcagacaatgtcacagggttggtaaacaaggcatcggttatatttcacgcaaggtcggaatgtagtcatcaaatattcaatatgattccacgagatctatcgtattaa

SEQ ID NO: 29338 - DNA, 766 bp, Glycine max
  Peptide Sequence Number=SeqID_121023
catatgctcgtgtcagcacaaaggagagttgtgttgatcccttaggaaatgatccagacaagggtgactcggaaaaatatgggttatacgtcgaagaaaatcctccccgcctggttgccctaggaagactttatgaggggtccacaactgttcacaacattcctttgctccatgatcatgtcaaggttggtgttgaggaggttaaagatgcagacactctcattcatgtacccactgaagagttaaccgtgttggataaacagggagttgtgggaccggcgaaacctgcagataggctggatcatgatcccctatatctaatgacattgaccatcccacagctttttctgaagtcgttgcaggttatgtgggatgctaccgtgtttggggtgtttaatgacaacttccccttatacataaagcatgaagatttgtctaaaatagcacacggtggtcaatgtctcaatatctctgttatacagttgtggattttgcatatgactgagacaagtatgcgagcagggaatgccgatgtgtatggattccttgagccacagtccatacagagatttgggcaatcccaatttgaatcagaaagttatattaagaattggatgcagaaatcaaagagggatgtgtacctcgcagcctacttgaatggtgcacattggcaaatggtcatcatattggctaaggaaaatgttgtcatctggtttttttcgttgcataataagccagacaactacctcaaaggaataattaacag

SEQ ID NO: 29339 - DNA, 240 bp, Glycine max
  Peptide Sequence Number=SeqID_121024
gtcatcaggccccctactaaccgagctttcatcaagaaagtattgcgccccaggcaggcgcagggtgagacaccacagcagcctagggatggccggcagcggccaacagacgcaccgccgccacctctagagcccctcagctcatctacaaaggttggagctttgtctacgacccgtgaccgacaagtcatcacgcgtccagctcaagacgttaaagaagcgctactaggaggcaaccta

SEQ ID NO: 29340 - DNA, 907 bp, Glycine max
  Peptide Sequence Number=SeqID_121025
gtcgactctagaggatccccacgaattacagcagctgactcagcagatcagggaccagctagaggagtccatcacagagaaagtgacgaggcaggtcatggcatccttcagccaccttcagtcgcagatgcaatctcagggagttgcagtgcctcctgagcctgtggttggtcttggtccctccggtcctcgagtaagcagaaaggggagttgtgttgatccctcaggaaacgatcctgagaccggtgactctgacaggtgcggcttgtacatagaagcagatcctgcacgcctggttgccatcgggagagtttatgagggatccactgttgttcataacactcctttgttgcctggccaagtaaaggtgagtgtggaggaggttagagatgcagatgctccagttcctgtacccactgatgaggttttcttagtggggcaggcactttacaccttccttgcttggccgacacatctggtagctgtgtctccgccaaaaccacctctgaagcccgatccggaggtcgatgatccactttatctaatgacattgaccatcccagagcttttcttgagccttatcaatttccccctgtacataaagcacgaagacctctccgaaatcgcacacggtggtcaatgtctcagtatatcagtgttacagttgtggattctgcatctcactgaaacatgtatgcgagcggggaattctgatatctatggattcctcgagcctcagtccattcagaggtctgggcaatcgcagtttgaatctgaaagttacataaagagtttgatgcagagttcacaacgcgatgtgtatcttggagcctacctaaatgggccagacaactaccttaaggagattattaatagtgctatcaagggtcttgatgatgctccatag

SEQ ID NO: 29341 - DNA, 207 bp, Glycine max
  Peptide Sequence Number=SeqID_121026
atgtggtggatagcagttacaaatacaatctggaagttcagaaatgagttgatttttcataatcaacccttcgatatctctaagctggctgattcaactctttttctcatgtggacttggctgtggggttgggaaagggacttcaaggttcctttccagtggtggtcttcagcaatgcgtctagatcccttactttttatgttgtag

SEQ ID NO: 29342 - DNA, 808 bp, Glycine max
  Peptide Sequence Number=SeqID_121027
tgctggagctgctgatgaatcttggataggctactcaggctctgtgactagtgtagctggttgggtctccttaggaataggtgcaggagatgaatcaggggtgagcacatcctccccttctgctgttgctgctgttggctccttagcaacaggcttctgggctgcaaaggccccaccccctccagaaggagaaaactgggctcctggccaggccacctacagaacagatgtagatgcagatggggcagatggaattggtgctggagctgaggaagggggagcctcagacttcttccccttggccttgcgcggccctctaaagcgtttaactcgaatccccttccagggatgcataatcgagctaccagttcctgtggttctagcttcaaatgacagaacctggagtatactagaaagttctccccctcctcaagttcgcataaaactccttgtgccagtttctatgctcaagttcttcagtaaattcatcgaactcaatgtgatggagaatgacattccttccaggcaaaatcttcctaggtaccacagttccgtgtatctctcccaagcctcttgggatgtgaacctggatctatcaaatatggccttgggtacatctacttgtgttgttgtgactgagaacaagagagggtacatctcttgtggatcagttctagtggagggtacatccactaggttgttcaaagagaacaagggagggtacatcccttgtggatcttttcttgtaaatgaattttacaaggttgaaaagaaatctcaaggaccgcaggttgcttggggactggat

SEQ ID NO: 29343 - DNA, 180 bp, Glycine max
  Peptide Sequence Number=SeqID_121028
atggctctcctccatcttaggagtatgtgtgcttggttgagaaggcacctgctaaagctcttcatgattgagctcatgctgaaagagaggctcaaagtttcctctaatgactttggcgatgagttcttttgcgaaattaaagagaaagaagttgccaaacaaaagggggagaagaagtaa

SEQ ID NO: 29344 - DNA, 471 bp, Glycine max
  Peptide Sequence Number=SeqID_121029
atgtggagtcaacaaaaaagaccttctgtaggtgatttgatccccattgatttggagattaacgccacttgtagaaggcgtaatcaagagagaattagaaaaaatttgcaagacttagaggtagtagcaattccagaggaagaacctcaatcttccgaggcatcttctagttttcctattgtagaacattctcatttagatcctagtgaagactacatcatggctgaagagccaagaagagttactctggaagattattcaagttctaatgtgccacaattttttaccagcattgcacaaccagaagttcaagcacaaaccattacttatccaccatcattgattcagttgattcaaaataatttgtttcatggattaccaaatgaagacccatatgcacacttagccacttacatagaaatatgcaatactattaagtggctggagtgcctgaagatgcaatccgattga

SEQ ID NO: 29345 - DNA, 210 bp, Glycine max
  Peptide Sequence Number=SeqID_121030
atggtgagggtaactagtacccatggtgaggggcgtgtagccctctcaagggcgaggacgtgtagtcctctcaaggtgaggacgtgtagccctctcaaggcgaggacatgtagtcctctagaggtgagggcatgcaaccctctgatggtgagggtatgtagtcctctcaaggcgaggacgtgtagtcctctcaacggtgagggtaactag

SEQ ID NO: 29346 - DNA, 291 bp, Glycine max
  Peptide Sequence Number=SeqID_121031
atggccaagtttgaccctgagatagtcctagagttctatgctaatgcctggcccacagaggagggagttcgggacatgcgttcgtggataaggggtcagtggattcccttcgacacagatgccttcagccagttcctgggcgaccctctagttttggaggaaggcaagcagtgtatggcgcctactaggcaccctctagagccagataagtccaacagggccctggggtttctggctctgatcacgggcctctgccaatcctacggagttcccgtcaccccagtagggtaa

SEQ ID NO: 29347 - DNA, 336 bp, Glycine max
  Peptide Sequence Number=SeqID_121032
atgcgaaatagagaccacatgctagccatcgtcagcacgtaccaagaagaactaaatctagccacgacccacgagcatagagtggcggacgagtatgcccaagtgtacgcgaaaaaagaggctagaggaagggtgatcgactcgttacaccaagaggcaacaatatggatggaccgatttgctcttactttgaacgggagtcaagaacttccccgattgctagccaaggccaaagtaatggcggacacctactccgcccccgaggagatccacggacttctcagctattgtcagcatatgatagacttaatcgtccatataattagaaaccgctag

SEQ ID NO: 29348 - DNA, 393 bp, Glycine max
  Peptide Sequence Number=SeqID_121033
atggcttgcctcccaaactatacaccacccaatgtggcgtacattcccaatgaggatgtcaaaaactccactcccatactcattaagagccaacaacctcaatctgatcatgcacatgtctctcgacccatggaggagacacatgaaattccccaccacgatctagccgacttcgagccttgcctcggatatgccactgaagggcaagcagttggtggaatgggaaagttggatcatctagaggaaaggctcagggccattgaaggaggtgaagattatgcctttgctaacctagaagagttgttcctagtacccaatatcatcacccctcccaagttcaaggtgctggactttgacaagtacaagggactacttgtcccaagaaccatctaa

SEQ ID NO: 29349 - DNA, 174 bp, Glycine max
  Peptide Sequence Number=SeqID_121034
atggatggcgaagagctaccttcacccgtgaattctgaggggcaggatcatcttgagctaccttctggggtagagacaaaacatgaacagcagaaaccaatcaaggtacatagggacggatgcaagtggggatggggtcacgaccgaccgatcgttgccccttctctgcgctaa

SEQ ID NO: 29350 - DNA, 654 bp, Glycine max
  Peptide Sequence Number=SeqID_121035
cgctggaggcaatttaaatctgacttgactaggaaatgggcacttgcagtcgacaaggacggtgcggacgacattgtctgtgaaaaatatggcattagcaaggagaaatggactcagttttgtcagacccgtagagacccctcatgggaggatgtacgaaaaaaggcacaggcctcccagaagcaaaacactgccccccacgtattgtctcgtgggggttatgaatatttagaagaaaagctcatggctgagaaggcaaagaaaagactggaagaagctgcccagtctggaagcactgagggcatcattgaccctccatctcccttcagacgccacgtgaaatggaagatggcccgcacgaagaaaactggacagatgacgtctgaggcagcaaaagaaatagctgacaggattgtaattatctttgtgtattttgtgaattccttggacaaatatgtgttcggtacaggattctttggacgagcaggcgtcacagggatcgtttgtcccccatggacgtcagatatcctgactgctgccattgggcgaccagagcaccctggccgtgttcgtgctgttggagccggtgtcaccataaagcaatactttggatcagcttcacgaacatcccgcagttcttcctccatgctctga

SEQ ID NO: 29351 - DNA, 551 bp, Glycine max
  Peptide Sequence Number=SeqID_121036
gtagaggcgaatgggccccgttcatagacatcctcgcactttcgatcttcggaggagtcctctttccaaatgtggatgggttggtggacctagcggcgatcgacgcttttctcgactttcatgaccgcaaggaaagcccagttgtcgttatcctagccgatctatatgacaccttcaaccgaagatgtgaaaagagcagtacaaggattgtttgttgtactccgaccctctatgtatggttggtttcgcaccttttccgccaagaggtgaggcatgcttgcccgctagaaagccaccgttcatgcacagagaaaagagagggaagttgggaccgactcttagcaagcaaagaaggagcgtctgtcaactggttcccccgatggaaagaaggaagaaccggggttcttatttcgtgcggaggatttccaaatgttcccgtgatggggacaaggggttgcatcagttacaatcccgttcttgctataagacagcttggctaccctatgagaggggcaccactagaggaagagctcgcacctattattgcatga

SEQ ID NO: 29352 - DNA, 228 bp, Glycine max
  Peptide Sequence Number=SeqID_121037
atggcagtagaatggagaaggaagagagagaggagacgccacttcaaggagaagatgagtctagaagaagctcaccaccataggaggccatggataagagcttggaggaaggagatgaatgaagggagagggagagaagagcacgaaattttgtgctctaagagagctctaaaatctgaacccactaatccaagatcaagtccaagattctccactaagtgtgcttag

SEQ ID NO: 29353 - DNA, 314 bp, Glycine max
  Peptide Sequence Number=SeqID_121038
gagatggattagttcctgcccttgctggggcgttggccacggtggttaatgcttttgagcatggagggcaagttggcatggtgtttgaaatgtacagaacctgtggtggattttttcgggtattggaggagacaattgaagccgcaattgaagagaaagacttggacaaaagagaaaatgaagagctaattgaaatgaatatggctttgcaattcggaagaagtgtgtcacaattgagagaacttgccacaaaatctgcttcatgtcgtattgaagggagagagatacatgaattcgccagcaaactcttctaa

SEQ ID NO: 29354 - DNA, 418 bp, Glycine max
  Peptide Sequence Number=SeqID_121039
acaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccaagtgctgatgataggtcccctattgcctcataaaatgctgctcggagatgaagcatctgcaagtcaggtttga

SEQ ID NO: 29355 - DNA, 375 bp, Glycine max
  Peptide Sequence Number=SeqID_121040
atgagggttcactgtaatcaagcaagtcagagacctagtatgaccacagattcacctccactccttatgttcccatggacccggcatactaaaggcaccacaagagtttatatatacaagaacataaagaaaaaaggcaaagagaaagaacaaaagggaagtcatagtaaggaaaacacactgattgattggcctaactctctaacaatagtccccaatggagttgccaactgtcgcaacctacccttcggcgggagggcgacacgagactcacgagtgcatcttccaaggaaggaaaacgcgcggagtagccaccaacgtttattcgaggaaaacgtcggaaaaatcggaaaaggcgtggtctacgaactttaa

SEQ ID NO: 29356 - DNA, 363 bp, Glycine max
  Peptide Sequence Number=SeqID_121041
atggaagcctctggtaatcgattaccagcctgtgtaatcgattacacagaggaatgggtcactgatgaacctgcacggacgcttcagcgcactgtggaatggatactacccacgcctacaccatatcgtctagtggagcccgttcaagtgatcgaggtaacgtcatccgaggaagaccctgaggaggacctggaggagctacctcctgagcctgctgtggatgcccttgactttctagagggtgatgaggatccacttcttgaggtggattctcccgaggaagtcatgtcggcatctgaggcagactctacggaggatagtggcccgagggagatggcgatcagcggaggctcttcatcctag

SEQ ID NO: 29357 - DNA, 216 bp, Glycine max
  Peptide Sequence Number=SeqID_121042
atggaactcgcttttgaagaagtgggagtaggcttgatgaatgagatcctccaaagaggcatagtggtgcaactctacaatgtcttggatctatccattgagaccatgcaaaaaccttgccatggtggcctcttgagacttctcaatttgatccctaatcaaggaaatttccatctctttgtaatactcatccacactcctatttccttgaaatag

SEQ ID NO: 29358 - DNA, 362 bp, Glycine max
  Peptide Sequence Number=SeqID_121043
atggtggcacgtgttatgctcaggaacggatttgagcccggaatgggtctaggcaaagactgccttgggaatgccgacgtggtcgatatcaagggaaatccatacaagtatggattagggtatgagcccgggatgccggggaggaggaacgtaccgtcaagatttcgggcggatagagtatggcccgaccgtattagccagtgtttcaccaacgctggaatggtgtctgaggaggaggtggccgcaatagaagaggagttccctcaagacccaccaagttttgtgcaaccatgccaccctgattcccaagtggggaactggcgtgtgataagccagtcagaagtctataccgctgattcatt

SEQ ID NO: 29359 - DNA, 472 bp, Glycine max
  Peptide Sequence Number=SeqID_121044
ctggacgccttatgacttgttggtcacggacctagtacttcgcttacctttggctttggacttggtcgcctactggtcggccatgtggtggcggtgtgtctattgcccgctaccggccatcccaatgctgctgtggtgtttcgccctgcgcctgcctggggacgcagtacttcttgatgaaagctcgatcagtagggggcctgatgcccttgctggaggttacaggtactccgtagaactgacagagacccgactgatagaggcccgtaaccagagctggaaaccccagggccctgttggacttttcgggtccattgggtgtcttgtgggtgcgatccctgcaacaatagatggtatcagaaatcagttgaactatatgcatacttacccatgtcgggacgacacagaccaaccgatacttttgcagggggagattggcattgcggtcgctgggcagaatgttgctaagtag

SEQ ID NO: 29360 - DNA, 150 bp, Glycine max
  Peptide Sequence Number=SeqID_121045
atgtgcacgtgtgcaatttttggtagccaagatgctttgagtatgcatgtatgtaaatttagccaaggaagtgcatgtgatgtaggaaatggccccgaggaagcttgcctcaaagaggtccaggaaggatacggcggccgaaggaactag

SEQ ID NO: 29361 - DNA, 120 bp, Glycine max
  Peptide Sequence Number=SeqID_121046
atgacgtctgaggcagcaaaggaaattgctgagaagattgatttgttggaggagcaggcgtcacaaggtttgtttgtcccccatggaggtcaagatgtcctaactgctgccattggatga

SEQ ID NO: 29362 - DNA, 543 bp, Glycine max
  Peptide Sequence Number=SeqID_121047
cgccaggtcgcccaggcggcggccctcgtagccgcggatctcgtgcagggtgttttcgccgatgcggatcaggtcggcgatggaaccggccagctcctccttgagcgcatcggcgatgccggtgatctgctcggacacgtactgcacctggttggccaccaccgcgaacccgcgccccgcctcgcccgagcgcgcggcctcgatgcgcgcgttcagcgacagatatttggcctgctggttgatatcgacgatgctctcgatcttctcgttcgaaatgcgctcgacgcggcgcgacagttcgacgattctttccggttgatgggccatgttcagcactccttttgttggacgttgttgcgtgaggagacggtgacatggggacacaagcaggaagcgtgccaagtcgtgcatgggttaatgaccagccccttccatgggcggggcgggggtgacgacggcgcatcgcgcctcgaagcgggccttgcggcgcgcaccaatacggtgcaagcgactgatacatccggtgccttccgggccaggtaa

SEQ ID NO: 29363 - DNA, 279 bp, Glycine max
  Peptide Sequence Number=SeqID_121048
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggcatcacacccctaggacgatcatgccatgcaatcatctcctagatgccactttgtggtcatctgttgttctaaggactgactcctcagtgacacaccctgatgtgccatcattttcttctattttctaa

SEQ ID NO: 29364 - DNA, 252 bp, Glycine max
  Peptide Sequence Number=SeqID_121049
atggctaaagagccaagaagagtaaccctggaggattattcaagttctaatgtgccacaatttttcaccagcattgctcaaccggaagttcaagcacaaaccattacatatccaccatcattgattcagctaattcagaataatctgtttcatggtttaccaaatgaagatccatatgcacacctagccacttgcattgaaatatgcaatactattgagctagttttcattctcactatctggagaagctaa

SEQ ID NO: 29365 - DNA, 864 bp, Glycine max
  Peptide Sequence Number=SeqID_121050
atggatcaactttattttgatggtatggtcatatgtagccatgtgggcttcccaaatctgtttattactttaacctgcaatccaaactggcctaaaatccatagattgctgaatccgttgaatctgaaagcagcagataggctagacataatatccagagtcttcaaactaaagtatgaacaaatgcttatggacctgacaaagaatcacatgctaggcaaagttattgtatatatgtatataatagaatttcaaaaacgagggctgcctcatgtccatttgttgctttttttacatcctgataacaaatacccatccttagatgaaattgatcaaattatatcagcagagataccttcacagcaagatgatccagaactgtattcattagtaaaaaaccatatggttcatggtccatgtggaagtctgaatcctggatctccatgcatgaaagaaggcaagtgtagtcatttctatcctaaaatgttccatctgcatattgttttagatgctgatggttttccagtctatcgtagaagaaacaatggtaatgcaattgagaaaaatggtgttataattgataacagagtgactgctgttttgattgatgaagataatggtcaaactgagaatggtggcactcataatgatgagatcaaagaatatctagattgcagatacatatgtccctgtgaatctacttggagaatctttggatttccaatacatggaagaaaacctgttgttgaaagattacacttccatcttccaggccaacatagtgttctctacgaagaccatgatgatattgatgatgtattgtctaagccaagcatctctgattcaagtttatttcatggatga

SEQ ID NO: 29366 - DNA, 231 bp, Glycine max
  Peptide Sequence Number=SeqID_121051
atgatgcaatcctaccctgcaaaggcattggataaaagaatccaagtagattgggctagagatccaagggaaggccctagggttctcatgagccttaagggggtggaggtgagcttagcgattagagagcttctcaaggaagttttctcaaagaagcttctcaaggaagttttctcaaagaagcttctcaaggaagttttctcaagaaagcttctcaaggaagctacctag

SEQ ID NO: 29367 - DNA, 289 bp, Glycine max
  Peptide Sequence Number=SeqID_121052
gtcgactctagaggatccccctagaaccgatgacatcccttcatcatccatcccagctcctcagtcagcatccataggaccagatgtccaacactcacaaaccttagtccctatgctacaaagcttattcagaggacaacttattatcatgcacagcctgcgagagttggctcacaacaggctaatcatacctatggagcattttcttgagcaagtagcctggcctgaagctcaacttccattggtgagacccaatgaggctgctactcttgagcccgcaccggcatga

SEQ ID NO: 29368 - DNA, 727 bp, Glycine max
  Peptide Sequence Number=SeqID_121053
gatccccgtaatcaacaaatacctgggcagaccaactgaaggagtggtggatattgctgtgtctgagcatcgaattgccaaggaaatcactgccaaacaagtccagcattggccaaagaaagggaagctttctgcagggaagctaagtgtgaagtatgcaatcctgcataggattggcgctgcaaactgggtacccaccaatcatacttccactgttgccacagaatcctttgctgtcaaattacccattgccttcccaactgtattgtgtggcattatgtcgagtcaacatcccaatattttaaactacactgactctgtgatgaagagagaatctcctctatccctgcattacaaactgtttgaggggacacatgtcccagacattgtctcgacatcagggaaagctgctgcttcaggtgctgtgtccaaggatgccttgattgctgaactcaaggacacatgcaaggtgctggaagcaaccatcaaagccaccacagagaagaaaatggagctggaacgcctgatcaaaaggctctcagacagtggcattgatgatggagaagcagctgagaagaagaagcagctgaggaagaagaaaaagctgaggaagaagaagaagcagctgaggaagaggaagatgcagcagaagatacagaatcagatgatgatgattctgaagccaccccatgaccatcagacctttatttttgctcttactagctaa

SEQ ID NO: 29369 - DNA, 210 bp, Glycine max
  Peptide Sequence Number=SeqID_121054
gattcgtttgaggagcacgccacacaaggatcgttcgtcccccatggacgtcaggatgttttggccgctgctattggacgtccagagcaccctggacgtgtccgtgctgctggagctggtgtcaccatcaagcaatactttggatcggctccacgaatgtcccgcaacatttcctccctacctcctgacgaattacagcagctgacctag

SEQ ID NO: 29370 - DNA, 156 bp, Glycine max
  Peptide Sequence Number=SeqID_121055
atgaagaagaagaaggttgaagcagctggtgtcttgatcagcgaggcatatgcgcttagcgaagacgtgacagagtcgaaaaatagagcaagagagaagagcttggacgaaaagcctcagcctttgagagattctgagtttaggagtgattattag

SEQ ID NO: 29371 - DNA, 207 bp, Glycine max
  Peptide Sequence Number=SeqID_121056
atgaaggaaaccattaggtctttccaagaatggactcgggaaggttccaagttagtgtaccaggtattttgcctgctgtggaatgcaagggttgtggttgggggcggaatggagggccctccaaagtgttttgcaggggtataccaccactgcttgcccttcagatgcatatccgaggcaaggctcgaagtcgctagattgtggtag

SEQ ID NO: 29372 - DNA, 492 bp, Glycine max
  Peptide Sequence Number=SeqID_121057
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggatattcgaaagaaggcgcaggccattcagaaacaaaacaaagcccctcacatattgtctcgtgggggttatgattatctagaagaaaagttgatggaggacaagaaaaagaaagggtaccgagctcgaattcgtaatcatgtcgggaaacctgtcgtgccagctgcattaatgaatcggccaacgcgcggggagaggcggtttgcgtattgggcgctcttccgcttcctcgctcactga

SEQ ID NO: 29373 - DNA, 384 bp, Glycine max
  Peptide Sequence Number=SeqID_121058
atggaattccttcagccagatgcagtcccagtttcagtctcagatctgggcaatcacaatttgaatccgaaagttgcactacctcagagttggatacagagttccaaaacgaggccagacaactaccttaagggaataattaacagtgctttgaaaggacttgatgatactccacaaccgaaatccaaggctgctgctagacaaaaaggaatcactgaatgtggctactacgtgatgcactggatgtccacgataatcttaggatctttcaggaataattgggagacgtattttaatgaagttagaccattggaagcagaaagattcaatgcacttcgcatacagtgggcacaatattatctaaaagttagaaatcaaacatag

SEQ ID NO: 29374 - DNA, 330 bp, Glycine max
  Peptide Sequence Number=SeqID_121059
gatccccacttaatcgagatattcaggaggaacagactgttccagcccgataccgtcaagaatttcttacgattgcatgggaacagggacaaattttagcggatggtgctgctacagttgacggcgaactcgctttgggaaaaaacgtcttagtagcttatatgccatgggaaggttacaattctgaagatgctgtactcattaatgagcgtctggatatgccttatttgcaagatggaagacccgttgatatggtcttcaatccactaggggtaccttcacgaatgaatgtaggacaaatatttgaatgctcgctcgggttagcaggag

SEQ ID NO: 29375 - DNA, 261 bp, Glycine max
  Peptide Sequence Number=SeqID_121060
atgcctcacaatgggcaagtcaggtcactctcactaagtgaaatcaaagggagaccagtcagggtcacgctgttttgcgagaatgctccaaccatgtgggatcggcacaggcttacaggagcactcaaaccggatgacccccaaggcctacactctgaagatgcgcctcaagtgattaactcgtcgggttcccacagtggatcccatcacaactcatcgcgcattaactcgtcgcccttaaagggtattacagttgtgtga

SEQ ID NO: 29376 - DNA, 201 bp, Glycine max
  Peptide Sequence Number=SeqID_121061
atgactgagaagcttcttagggcagagatgaaggttgctcgttttaatttctcccatggcaactacaactttcatcaggaaaccctcaacaatctccactacattcctatttttttatttactctaaaaataaaaaatctaaaggatgatataagaattgtgatttttgatggtattggtggaaatggattttccctttaa

SEQ ID NO: 29377 - DNA, 375 bp, Glycine max
  Peptide Sequence Number=SeqID_121062
atgagaatgaaagagggtagattgaaagagatagggtatcttcaagatctggtgtacaagctaagcgcagttggtcaagcacttgaaaagaatgatctatctgctgctggttctgtccttggaggaagcaccgatgcagattgggtccaaagagctaatatagcattcaataaagaaatgacaaactatgtaccaatcactctattaatcagtcaattgataaactttggagcatatactgacacgtcctgttttaagcatgcagtttctaagaaagatgttgagtcctccaaaattgcctttgtctcttcggccactgcatttgagaagtggacttctatgacaggccttgctgctcagcttaagggcctttga

SEQ ID NO: 29378 - DNA, 123 bp, Glycine max
  Peptide Sequence Number=SeqID_121063
atgtcgcaaaggtttcgaccgttcttcgacgttcttcatttgttcttcatcgttcttcgatcttcaacgggtgaaactaaggctaaaatcaactcgcctagtcaagctcgtccacaaaaatag

SEQ ID NO: 29379 - DNA, 657 bp, Glycine max
  Peptide Sequence Number=SeqID_121064
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccttgccaactttctgcaacatcgtggagctcaaagtgccaagtccatcaagtcaccgactacaaacacggcccttgagctcaaacgaacagtgagtgacataaaaagtggggttcataaccaactggaacacacaattaaaacacaaagacgtatgcaaggtatagcgaagcgaatcaacaaaatgcacaccgaggggcttaacaatgcgatcaactccaacactgtagttgctgtccttattgcaacagttgcttttgctgccatatttaatgtcccgggccagtatcctgagaaacaaaatgaactctctcctggaatgtctcctggggaagcatatattgctccggatatcggattcaagatattcataatctttgattctactgctctcttcatatcattggctgttgtgattgtccaaacatcagtggttgttattgagagggtaccgagctcgaattcgtaa

SEQ ID NO: 29380 - DNA, 567 bp, Glycine max
  Peptide Sequence Number=SeqID_121065
atgtgctgtcgctgctcatttcgcgccagccttttccagcagggccacaatgggggcatagccacggctgcgggcatgttggagaggcgtcacgccgtcattgtcggcgagattgacgttggcaccggcctcgatgagaagcttcacgatctcgacatggcgctgaccgccatcgccgagcatgatggcttcaaggagcgccgtccagccgagattgttgacgtgatcgaccttcacgccagcctcgatcagcgtgcgcaccgtttcgacatgcccccgttcggaagcgggaatgagggccgttccgccatagcggttggtgcttttgaggtccgctccatgcgcaagcgtcatcttgagaatttcgaggtgtccgcgcgcgcccgcataaagataggggctgtccttgatggcatccctcgcgttgacgtccgcccctgcatcaatgagcgcacgggcgacatcgatttggtttgcgtgggttgctgcaagaagcgccgtctcgccatttctgccgcgtgcttcgagatccgctccggccttgatggccgaattgaccgaggccag

SEQ ID NO: 29381 - DNA, 265 bp, Glycine max
  Peptide Sequence Number=SeqID_121066
gccacttgggcctccagaatttccgccagaaggctgtgcttctggaggaagcaacctggctcgcctgggcgagctgagctcgcctgggcgagctgggcggcaccacctcccctattttgctataaataggggaggaagtgaagaagaaaaggccgaggcgcttccgaaacgtttccgtaacgttttccgtgaagaatttcgcaaaggtttcaaccgttcttcgacgttcttcattcgttcttcatcgttcttcgatcttcaacgg

SEQ ID NO: 29382 - DNA, 291 bp, Glycine max
  Peptide Sequence Number=SeqID_121067
atgtccaatcaaaagagcaccgagtcaaccatcaagaatctagaagtccaggtgggacaattggcaaaacaactggcagacttaccgtcaagaagctttggagccaacacagagaagaatcctaaggaggagtgcaaggctgttatgactagaagtaaaatgcgtgcatccaccgctaagcacagcttcaacgcacttagcgtgacaaaggaatctggaagagcacaagaatcaaggccgcatgctaagcgcaagatcagctcgctaagcgagacgtttgtctcttgctag

SEQ ID NO: 29383 - DNA, 416 bp, Glycine max
  Peptide Sequence Number=SeqID_121068
atgatcaacatctacggtacaactctcaattttcttctaggatcatcttagaccctaagtacctagacacagatttgtttaatgatgagacatttgactgttatcaagtgtttcaaaactctggattggttgattttatgtccttaaaattgccttactatcctgaacttgttaaagtcttttacaataatttaaaaattcaggatggtattatttcttctgaggtgcatggtgctggtgcaataacttcatttggttatcgtaaggatcgtgattggcaatggctgaagaaggacactctacctccacaagatgagcgtactccttctcctcctcctcaacaagatgattcctcagcccttatgaatgaagttctttcagaattacggggcctccacacctatgttggtgaatga

SEQ ID NO: 29384 - DNA, 633 bp, Glycine max
  Peptide Sequence Number=SeqID_121069
atgatgttccgttttctcaaaatattaagcgtatgcactactctattttttgcccatgccgccttggctgagaccacatccaaaccggtgattctggtgtttggagacagtttatccgccgcctatggcattcccaaagaaaaaggctgggtcaatttgttagcgcaacgagtgaaagacaaccaattgccctacgaagttgccaacgctagtgtcagcggtgaaacaaccgctggcggcctgagtcgtttgcctgccgcacttcagcagtttaaacccagtattgtggtgatagaactaggcgcaaatgatggcctgcgaggcttaccaacagatgcaatgaagaataacctcgaaaaaatgatcgcagcctgtaagcaaatgaatgcgcgcgtggttttgttggggatgttgattccaccgaactatggccctcaatacaccaacggctttaagcaggtgtatctggatttatcgcaaacctacaaaacaccatttgtgccattttttctggatggtgtgagcgggcacagtgatctggtgattgaggatgggttacatccaaatgtgattgcgcagcctaagatattggagaatgtttggccgactttgaaacctttgcttaaacaataa

SEQ ID NO: 29385 - DNA, 72 bp, Glycine max
  Peptide Sequence Number=SeqID_121070
ggaattggaaaggaggattggtgccatgccttgaagaatttgagtccagaagcatggggccaaccaccttaa

SEQ ID NO: 29386 - DNA, 168 bp, Glycine max
  Peptide Sequence Number=SeqID_121071
atggcaaggagcagaatcgtctcaggccacggtcagaagtcaagacaagtcaatggcagaaatcaaccaaggcaaatggaggataggatcgtgaccgaccaatcgtcaccccttcccggcgctgggccagcggagaatgtcgcagcaaggcagcccagtatcctttga

SEQ ID NO: 29387 - DNA, 178 bp, Glycine max
  Peptide Sequence Number=SeqID_121072
gtcgactctagaggatccctcaccttgggtactagttaccctcaccgttgagaggactacacgtcctcgccttgagaggactacacgtcctcaccatcagagggttgcacgccctcacctccagaggactacatgtcctcgccttgagagggctacacgtcctcaccttgggtactag

SEQ ID NO: 29388 - DNA, 198 bp, Glycine max
  Peptide Sequence Number=SeqID_121073
atgaaggaagtcaatgaagattctcaagttaatggagatagagcaaataatgaacttcctagagaatggaaagcctcaagagatcatcccctcgacaacattattggtgatatatcaaaaggggtagaaaaacctgaaaattatcctgtcataggaacaaaatgggtttttagaaataaattagagaacatggcataa

SEQ ID NO: 29389 - DNA, 159 bp, Glycine max
  Peptide Sequence Number=SeqID_121074
atgctgcgcttagcgccaccctcacgcttagcgcgaattctcctttgcgctaagcgcgctaaagctgcgcttagcggtggatctttgcttagcccagctgctgagcttagcccaactgctacattttgcaattcaaaacttagcctctttttgacctga

SEQ ID NO: 29390 - DNA, 931 bp, Glycine max
  misc_feature (398)..(398): n is a, c, g, or t
  Peptide Sequence Number=SeqID_121075
atggggtttgttacctggtgggagaaatattattcgacccgttcagttggagatactacgatcatgatctccagacttgaaagtggttttacacaaccaacggtcgagaatatccgctcaaaccttcaagctcgaggcaaaacaatcatgacgaagaaaagcgctgaaacgtctcgagctgatgtgagacccaaaaaacccactggagtgaagatccaagaaaggaaacaagaagagaaggaagaggaggaaagaccactcataagaaaaagaaaatttccttcgacttcgaccaagtctactgaacaaacagaggcagggaattcccaagctcaaatacctaagaagaaaaagaaggtaaagcaggacgagcctgaacctcctgtggctgttgaggntggtgagccaatcaagaagaaaaagaaaaagaccaagtcctcaaaagaacaaggtgacaatcaacttgttgacgtccaaccaccttcgaccgacgttgacggcactgaagtagaggctactccttctattgccgagatgggcaaccctgtcgagcaacctaactcaccacaagaacaacccgccgtcgaggtacaacaaaatgtttctgtagaagaaataccctcgcatgctcgaacatctcctgctcctgagacggatgcactgaatgttgaggaacagggtgaaggtcaaggcattggacccagcagtcctcatggatcgagtcagaaaagttcatccgaagaaaactttttcgatgaagagggcatagaagaggctgaagctggtggttcggacatttacccggcgtcttcgacatctaagctttccgctagcatagggatcgcagaagatacattcattcaaatgcaagacaaagaccctgctgcagcccttcgactcctgctgaacaccagtcaagccaacacctcaa

SEQ ID NO: 29391 - DNA, 393 bp, Glycine max
  Peptide Sequence Number=SeqID_121076
atggcgtatcggaggttatcatggatggctaagaatcatacgcggggcttagattggctctccaaattgaaagttatcgatgaggagaacttcgaagctccagaggaagatgaagaagaaaacgcggccactgcaagagcccttgaacaagaaaccaaaaaggcccgcaaggaggaatatggccgagagaaattccgaggagcattgtggggtagcaacaatgagctcaagctccgaagagaggagagagatcggtcacgggtgcatggcatgatcttaaaagaagagttagttgcttgcgcaaggtccaaaaagagtttggctcaaaacttggaagccacggagcaaagcatgctagctatcatagggcaatacaaggaagaattgaactag

SEQ ID NO: 29392 - DNA, 627 bp, Glycine max
  Peptide Sequence Number=SeqID_121077
atgtgcagcgccaccgattacaaagttaaatcaatcggaggtatgtgcatcttaatccaaatgtgggcatgggaacgatgcatgactttagctccaaaggggacgcctcccgtcatagaaaataaaccactcggacacaggtggctgcgacgtggaaatcaacatattggcaatgatgatcttagacttttccgtcacaaattggatctgatgaaacgacatgagtttgtctgggagccatacacagcaactgtgatggcagcgttgcctccaatttgtgtggttggaagtgtagcctggtttgcggtgctgagtttagggtcgacgtttatcctcgacaggaggcctactgggtttaactcggactacatggtgtggtataggcgtaaagcaaagatgtttgtcgacccaaacgatgcaaacacaactacattgggtgaaattgtggagactttacagtatatggtgtcaccacaagggaggaacacatggacagttgatgatctcgtgccttacgtggaaaaattagcgattatatccaaagagcaagagagaatcactgagccagtgtcacatggtccagcattagagctagaattcccagcacaagagtttcacattctttag

SEQ ID NO: 29393 - DNA, 435 bp, Glycine max
  Peptide Sequence Number=SeqID_121078
atggcatcttcatcatcatcttcatcacatattaacattaagtctggccccatcgatgctgatgtattatggatgcaacctaagcatgtttcagaacatgtttggaatgggaaagaagatcggaaattacatataagacgagctgtccccacgtatcaaggggaagaacaaattccagagcaaatttttccttttcttcaacaatctagtttcggctggattatcaagatgggatacttaaaaataaatgcctcattaagtagtgctctgatagaaagatggaggccgaaaacacatacgtttcacatgagatgcggagagtgtataagtgtggatggtttaccattaatcggtccaacaaatcttgattgggctgatttatgtgaggaattattgggagccagaccacaagaaggtgaaattaaaggtagcgtg

SEQ ID NO: 29394 - DNA, 879 bp, Glycine max
  Peptide Sequence Number=SeqID_121079
atgattgagttgcgaaaacttctggataggtatcctacatctgaactgaattctttctggttaaagaatctctttctagttgctctggaacaattaggagattctctagaagaaatacggagttttgcttttggtggcaacatgctatggggtggtggtcccacttatggggtcaaatcaatacgttctaagaagaaatatttgaatctcatcgatctcataagtattataccaaatcccatcaatcgaatcgctttttcgagaaatacgagacatctaagtcatccaaaaagacgtatattccttgctaattatcagacaattacttattcacaaaccttgcggggggctaatagttttcatttcccatctcatggaaaacccttttcgctccgcttagccctacctccccctagtaggggtattttagtgataggttctataggaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgtgaatgagtcgaattacttatccctcggtcttttagtgaactatctctccagggattgtgaaagatgttctactagaaatattcttgttattgcttcgactcatattccccaaaaa

SEQ ID NO: 29395 - DNA, 396 bp, Glycine max
  Peptide Sequence Number=SeqID_121080
atgattgatgctgccagtgctggagctcttggcgatatgactcctattgaggctaggaatctgattgagaatatggcttccaactcccaacaatttagtgcaagaaatgatgctattgtccttagaggagtccatgatatggccacggattcatcttcatctgctgaaaataagaagcttgagggaaaacttgatgccttggtcaacctacaatctggagtcaatgacaaaagatacagtccaggttggaggaatcatccaaatctgagatgggcaaatcctccacaacaacaacaacagcaacaacaacagcctgtccctcccttccaaaatgctgttggtccaagcaggccatatgttcctcctccaatgcagcagcaacagcaacaacaatga

SEQ ID NO: 29396 - DNA, 219 bp, Glycine max
  Peptide Sequence Number=SeqID_121081
atggcttcagattcaatgggcagaattgaaagtgtaggtcctcaagaagtaaacacaacacaaggaattaaaacgcaaatcatcaatccaatgtttattaatgtagtgatcatggtttacaaaggattggaagactttggagaccccaatgagtcttcggagaacaaacatgttttgaaccctttagctgccccaagtactaagcataatatcgtttga

SEQ ID NO: 29397 - DNA, 387 bp, Glycine max
  Peptide Sequence Number=SeqID_121082
ggcgcagaagatgacgttagtctctgcgtgctatcaggcttttcgtcttacagacaacaaaaagtttatacggataaccactcgggtatttccgcccgtcagcgtgactcaaaagcttttcgtcttacagcacagcaaaaagtttatacggataaccactcgggtatttccgcccgtcagcgtgacttaaaagtcagtatgacagatcttgtgagcgcggaagatgaccaaaaagtttatacggataaccactcgggtatttccgcccgacagcgtgactcaaaagtcagtatgacagatcttgtgagcacggaagatgacggaaatctctgcgtgtcaacgggcttgtcggccgcgattgacgaatggcgcagaagacgacattag

SEQ ID NO: 29398 - DNA, 153 bp, Glycine max
  Peptide Sequence Number=SeqID_121083
atgactaacttttgtgaaaaatgggcaagattggtgaagtgcagaatttatgaactcgctaagccagaccatgcgctaggcgagtcatccgctaagcacaccatcctccggctgagtgcgcagaagaatctggaagaaggattagttgtgtag

SEQ ID NO: 29399 - DNA, 159 bp, Glycine max
  Peptide Sequence Number=SeqID_121084
atggtccattacatctttgtcaaggtgaaactggaagtaacaaggacatcaacagtcctaaatgtgtttggcaatagacaaagcagcgataaatgggtttatgatcccaacatggttggctcatggtacctaacacatgcaactaagaatgtagtgtga

SEQ ID NO: 29400 - DNA, 270 bp, Glycine max
  Peptide Sequence Number=SeqID_121085
gccccatctacttcagctccccctatctcagctctttctacctctcctctccctccagtaccagaaactccaattcttatagagcttgcattagggccagctcctgatcatgcagagcttgcagaatgtggtccaccagtggccggagttcagcattctccttcagatgggagtgaggcctccgcacccaggagcctcagtgatgtaagctctattggagcttgtaggcctaggatcttcttcatcaatggattcctttgcttcttgtaa

SEQ ID NO: 29401 - DNA, 434 bp, Glycine max
  Peptide Sequence Number=SeqID_121086
tgagaaaagctgtgacttggttggtgttttggcagagttttctgcctttgctctgttttgcttggctgtgatagcttgtgctgttgaatgttgttttgcttggatgttgtggaagcttgggaggattgatggggacctggtgttgagagaaacgaggatatgggctacgtgggagtacgtgagctcagatggaggtgggcaacaggggatgagtggtacctggagatatgtcgcgggggtcaggagaccttggggacgtcaggcgagctcctggcagtcaacagataaaaggaaaacaagaccacaaagcaaggaggcttgtggtggctggccagctgaggctaagatggtctctgggaactgggagttgatggaagcctctggtaatcgattaccagcctgtgtaatcgattacacagaggaatgggtcactg

SEQ ID NO: 29402 - DNA, 202 bp, Glycine max
  Peptide Sequence Number=SeqID_121087
atgggtcaacttcaacgtcaagccttccgcaaagcctatggtaatatttgggacctagctagggtagaagtctccatggaaccgattgcatccctttcccagtattatgaccaggccctaagaaatcctgggatgcctactgggaggaaggaagccatatcttttctttgggttctatccctccacgacaagagttgccaag

SEQ ID NO: 29403 - DNA, 1012 bp, Glycine max
  Peptide Sequence Number=SeqID_121088
atggccccaaggaagcttgcctcaaagagatccaggaaggataaagcggctgaaggaaccagttccgctcccgaatatgatagccaccgttttaggagcgctaagcaccagcagcgcttcgaggccatcaagggatggtcatttctccgggagcgacgcgtccagcttagggacgacgagtatatcgacttccaggaggagatagtttgccggcgaggagggcgtgcgagatatgcgatcctgggtgaggggtcagtggatcccgttcgatgtggatgctctcagccagttcctggataccctttagtgctggaggagggccaggaatgcgagtatggccagaggaggaaccggtccgatgggttcgatgaggagaccatcgcccagttgctatgtataccaggcaacatccatcccagcgatcataattccgacctccccctgccgaagtgtcagctggtgtatgccatcctgacacggatgagcattcacgtggctcagttaattgctgatgtcatctatctatttgctggtatggcgcctaccaggcaccctctagacctggataagtccaacagggccctgggatttcccgccttgatcacaggactctgccagtcgttcggagtccccgtcgcacctagcaaggtgatttggctgcccatcacccgagcttttattgagaagtattgcacgcagagacaggcccagggggatgctccccaggccgcagacgcgccgccacctcatcaggctggcccagctggatcatttgatacggagcagtatttgcggcatttggttcgccagcaggcggccaaccaccgggcgcatgtacagacccatgattgtctttaccagttgagcctcagcctgcagagccagggttttacttcttctccgtgccctactccggatcagttcagggcagaggtcgcatggcccggagattggcctgaggcccaggcaggagaggcaccagtagaggctcccgacgaggcagatgaggccc

SEQ ID NO: 29404 - DNA, 387 bp, Glycine max
  Peptide Sequence Number=SeqID_121089
atgtcaatccttaccctcggaagcaaaaagaaaagaagggaaaatttccaatcaaagagaaagcaaaaaaaaggaaaagaaaggaaattcccaatcaaagagtgggagaaagcaaaaagaaaagaaagaaaattcccaatcaaagaatgggagaaagaaaaaaagaaagaaaagaaggaaagaaagctcctgatcaaggatcgaaaggaaaacagaagaaatgtgcagagaggtctttggaccggacaatatctgaacaatacagaattgtcaccaaatgaacaaaaaagaaggaaagggaaccacgacctaaaatggtcttctccctttgattaccaaccaaaatcccgtgcgctagcgacttttttttttctcgccccgcactaa

SEQ ID NO: 29405 - DNA, 525 bp, Glycine max
  Peptide Sequence Number=SeqID_121090
atggaatttggtgatattgttgttcattttaacattcttgatgccatgaaacatctatttgaggatcattctgtttttcgtactgagataattgatcagattgttgatgattatatgtttgattttgattatgttctttatggtaggaaacatccatttctatctgatctgcatacttgtcattccttatgcattgaatctgactctgagtttgaatttgatcttgtatctgatttttatgctgagagtgaatttgaatttgagtctggtattgtacctcttgatgttgattttttagagtcagaatgcactaaccatgttgcaggaagtacatatacttctgacttgctttatgaggtacaggttgaggaaccttcttcttcttctcctaccctggttcctcccacttttcagccaccacccacaccagaattgaagcccttaccaacaaccctcaaatatgcttacttggaggacaaggaaaaatttccagtgatcatctttgcctcccttgctgctgagtaa

SEQ ID NO: 29406 - DNA, 153 bp, Glycine max
  Peptide Sequence Number=SeqID_121091
atgtctcattctctagggtttttcaaaggaagtgtaaaaacaccctattacagtacccaacacataagagacattaagaggaactcaaaccaactaggagaagcaacgatggctagcggcggccaccggtggccttgggtggtggaaaaatga

SEQ ID NO: 29407 - DNA, 357 bp, Glycine max
  Peptide Sequence Number=SeqID_121092
atgcatcaccaaaagaggaaaactctagatgaggcttcactgttatcatgcgagtcggagacccagcatgaccacagatcgacctccactccttatggctcactaattagggtacaatgcccagggcacagaattccacaacacaccatagtgcctatttcgggaaaagagctctggaggcagcaagaggagcaacttttgcagagatacctaggatttaacttgaatgaagcagaattgaaacttagtcttacaagagggatctgcggattaagttttggttttaagtatgttgttacaataatgctatttggtctaagtctagtccaacaagagggatctaaggacaaagcttag

SEQ ID NO: 29408 - DNA, 464 bp, Glycine max
  Peptide Sequence Number=SeqID_121093
ttccacaagaagatgaaacaaatagacgtcatgttgggcgtgagtctacacactgttggactgttgaggcaatagactctgaagaaacgatcaagaagattaaggtgaaagttaggggagtcaatagcttacctagggagttacgcatcattgtgaattttgatgaccaaggccaagcaattggtgaagcacaagccttgcttgcaggatttcttggaacactagtagctgattgcaaattatttcctatggattatgatagatggtctggaccttcaggcgtacctaaagcttattttgatgattgctttgaaacaattttaaagcctcgattttattttaagattaatgaagctggtgcaaaacggtattgcaaattgagtatgggaagaaaatgggctgcaaataggcaaagcttatggaatgaattcaacgatccaaccaaaacaagagatgaatcataa

SEQ ID NO: 29409 - DNA, 318 bp, Glycine max
  Peptide Sequence Number=SeqID_121094
atgacccctattcatgatgccctgctatattacaatgggaggtggaacatgtcacgccaaaatgagtttgttggttactcgttcataggaaaaaatcccaaaaagattgacattccttccggatgtaccatggatgaattgaaggatttgatcaagcaagttgcgccttatgggattcccccttatggtattcatgaaatacaaacagtgttaattgagtctaactactggaaaaagattgggccaatagaaattttagctgttttcaataaacctgtaatggaaatggaagacaagttgtccttgtcgcaaaattag

SEQ ID NO: 29410 - DNA, 309 bp, Glycine max
  Peptide Sequence Number=SeqID_121095
atgtcgctgcatgttctctatctttatgcgttttctagatttctcccccccagggatttccggtccgttgtatcccttgttacgatctttcaaagaaatgaacacggatttgaggcttttagtcctcacgggcaggatcaccttgggctaccttctggagtgaagacaaaacatgaacggcagaaaccaatcaagatacttaaggatgaacgcgagcggggatggggtcacgaccgaccaatcgtcacctttctccgtgcgaaacaagcagggaatgtcgctggcaaggcagccccggggatcctctag

SEQ ID NO: 29411 - DNA, 337 bp, Glycine max
  Peptide Sequence Number=SeqID_121096
atgggggcatacgcaaaagatgaagaattgttgatacattccttccaagaaagtcttactgggacacattaccaattctactatggaaaatggtgggctatgcaccttcaaagctttgcggatttggtctttgccagtgaaaggatcgatgtgggtctgaaaagaggcaaatttagtcatcctgcttggacaaatgagaaaactggggcaaatgaagagggtgaggatgaaggagaagcccgtgctgtgactgccattcctatacaaccaagtttcccaccaacccaacaatgtcattacttagccaataacaaaccttctccttacccaccgcccg

SEQ ID NO: 29412 - DNA, 207 bp, Glycine max
  Peptide Sequence Number=SeqID_121097
atggcacatcagaatgctaagcatatggctacaccaatgagtactgcttgctatttggataaagatgaaaccggtcaatcaatagatattaagaaatatagagaaagagcacaagtgaaacttgttatttcattggatctgctttatccactgctgaggcagaatatatttctgctggcaattgttgtgctcaaatactttggatga

SEQ ID NO: 29413 - DNA, 256 bp, Glycine max
  Peptide Sequence Number=SeqID_121098
atggcatggagcgtgtttgctctttgcccctatttgggaacatataggacaatatctaggggaggaaaatgcgcggagtcgccaccaacgtttatttgtggaaaacgtcggaaaaaccgaaggaaaccggtcataaagaatattccaagttcaggagttgtatttacgtttgaggaaggtattagcacctctcacgtcgacaaaagcggggctcttgctcctacgtacccttcatcgaagaggaaatcagacctac

SEQ ID NO: 29414 - DNA, 492 bp, Glycine max
  Peptide Sequence Number=SeqID_121099
atgtggaggcgatggtggtgcatctgctgccagctgctgctgttggtcctgccctggctattgtgtctgccttggcacgcagtacttcttaatgaaggccctgttaatgggaggtcagatgagctttgtgggcatgaccggtgcaatacctacaaactggtagatggcatccgagataagctgtgctacatgaacactgatctgggtcagggtagtgtagaccaactagcatttaggcagcgggagatcagaattatggtcactaagaaggatgttattgagcagaagcatgatccaaatctgggtcaaagtggtcatgctagtgcgcatgatctgcactacctccctgtcacgctccgtgcaaaatcttgtcccggggagcacagtagctggcctatggcctcttcatcaaaacctgatacttggcttcttcttttggcgtattcacaaagttatccctcttccaagatcaacagatgccccaggaattga

SEQ ID NO: 29415 - DNA, 572 bp, Glycine max
  Peptide Sequence Number=SeqID_121100
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatcccctctccaacgaactcatctcgcgagatgaggggcttcactgcgacttcgcgtgtctcttgtactcgcttctcaggaagaagcttagtgaggagcgcgtgagggagattgtgcgtgacgcggtggagattgagagggagtttgtgtgcgacgcgcttccgtgtgcgttggtggggatgaacggggagttgatgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 29416 - DNA, 243 bp, Glycine max
  Peptide Sequence Number=SeqID_121101
atgccccaaccatatgggatcaacataggcttaaaggagctctcaaaccgggtaacccccaaggcttacactccgaagagtccgtcaaggcctctccctcctaattcaggtccaacccagaaaatatttttgcacacagactctatttatgaactgtacaaaacacacgactcctcaattgttctcaaaatagttttaactcgttgccctctaagggtcttagcattaactcgtcgcccttga

SEQ ID NO: 29417 - DNA, 300 bp, Glycine max
  Peptide Sequence Number=SeqID_121102
atggaaaaacgccagcaacgcggcctttttacggttctggccttttgctggccttttgctcacatgttctttctgcgttatcccctgattctgtggataaccgtattaccgcctttgagtgagctgataccgctcgccgcagccgaacgaccgagcgcagcgagtcacttcacccgaaacttctgcactccgctcttcgtgtctccctcggcgtccaccttcggcatcgctttaacaaccttgctcgtcgccgtcgcagggggaggagcaccaccaccaccaccgatggccctcccgtaa

SEQ ID NO: 29418 - DNA, 234 bp, Glycine max
  Peptide Sequence Number=SeqID_121103
atgtcccggtttgccacaattgtagcagaggaatggctcaccgggattattcttggcaggtggatgttgtctagcatgttagacccttggggggttcttgttgcggttggaggtattgctcacattgcggttctgattcttaaagtttttgcctataggcttcagaactgcacctgtgttcttccttttagagttgttgtgagacacaaccaacactttctttctaatacttaa

SEQ ID NO: 29419 - DNA, 404 bp, Glycine max
  Peptide Sequence Number=SeqID_121104
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcgactctagaggatccccattgacaatgattggaaaaggcgcatttggggagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 29420 - DNA, 234 bp, Glycine max
  Peptide Sequence Number=SeqID_121105
atggacaaggcaaaagaaacaattatcaagtcttttaacagcaatgaaagcaagtacaaagatgtatttgcaatcattgataaaagatggaattgtcagcttcataggccattgcatgcagctgcccacttcttaaatccagagttcttttatgacaacactgacttggagtttgattttgaggtcacaaatgaaaattctaaccgagttgcatctttacaagattggtgttga

SEQ ID NO: 29421 - DNA, 120 bp, Glycine max
  Peptide Sequence Number=SeqID_121106
atgaagaaacaacaatggaagagaagcggaaggcaaaggagaagaggagaggggaggcaccatccactagggaataagccaaggaagaaggagcttcaccaccatgatttccctggataa

SEQ ID NO: 29422 - DNA, 225 bp, Glycine max
  Peptide Sequence Number=SeqID_121107
atggagtcgccaactgtcgcaacctaccattcggcgggagggcgacgcgagggctcacaggtgcgtcttccaagaaaggaaaatgcgcggagtcgccaccaacatttattcgaggaaaacgtcggaaaaatcggaaaagagtgtttcccttgctcctacgtattcctcaattgtggtaaggaaatcagacctacgcaattctttcaaaaggggcgaatcaagtga

SEQ ID NO: 29423 - DNA, 140 bp, Glycine max
  Peptide Sequence Number=SeqID_121108
atgactgaatcacgtcaaaagggggtacgaaaaggaaaagaaggagaagcttaccacccagctcgcccaggcgagctaggttgcttcctccagaaggcaccgccttctggagaacttcctagaaggcccaagtgggcctg

SEQ ID NO: 29424 - DNA, 216 bp, Glycine max
  Peptide Sequence Number=SeqID_121109
atggcttctagtgatcatgctattttgcgtgatcgggctcatgtgcctacaaagagaagtttgctggagctttcctcacaagatgcactgttggcacagaataagctgctagctaagcagctagaatcattgacggagacacttagtaagttgacaaaccaattgcaagtgactcaaccctacacattcaacaactctgtaggtaggaggatgtag

SEQ ID NO: 29425 - DNA, 153 bp, Glycine max
  Peptide Sequence Number=SeqID_121110
atgaggaccactaagggaaaaggaaggagaggcttgccacccagctcgccctggcgagctaggttgcttcctccagaagcaaccgccttctggaggaacatccaggaaggctcaactaggcctgattactatttgcacccccatttttactaa

SEQ ID NO: 29426 - DNA, 432 bp, Glycine max
  Peptide Sequence Number=SeqID_121111
gattcaacaagcgattctcctcaaatttcagccagcccgtatcaattagacctggcaccttacgcttcagagccctacaatgctcaatggaacgccccggggcttctccgtgacaagcacacgttgcgttcgagtcgtattctcggagaaatggaggttgatgaaccttggctagggttatggctaccattgaattatcaagtggtcttcgtcattggaagtgcggtagacagctttgtggttgatttagggatggcctttgtggataactgggtggtgggtaaggaggaggtttgttattggctgagtaatgacattgttgggtttggtgggaaacttggccgtataggaatggcagtcacagcatgggtttctccctctttctcaccctcttcatttgccccagttttctcagtcgtcctagtaggatga

SEQ ID NO: 29427 - DNA, 519 bp, Glycine max
  Peptide Sequence Number=SeqID_121112
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaacccccccgttcagcccgaccgctgcgccttatccggttactatcgtcttgagtccaaaccg

SEQ ID NO: 29428 - DNA, 133 bp, Glycine max
  Peptide Sequence Number=SeqID_121113
atggcgattcaagcagaggaaagtagagctgatcaaaaggtggagggatttaaacaacagttggctaatgaattggcgctggaaccggttgatgatttagttgaacttgaagaaattgttgaggaagtagaag

SEQ ID NO: 29429 - DNA, 234 bp, Glycine max
  Peptide Sequence Number=SeqID_121114
atgagaaagcgccacgcttcccgaaggagaaagccgaccaggtatccgggggtcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtga

SEQ ID NO: 29430 - DNA, 303 bp, Glycine max
  Peptide Sequence Number=SeqID_121115
atggctagtacgttctttcttttgaaaaagcaaaatagtttagagattatgagcagtgagaaagaaatgactccgaacagagttgtgaactggccattcaggactctgtatcattattttggggacgccacaataccttcctcaaacgtaaatacaactcccgaatctggaatattcttcatgaccagtttccttcggtttttccgacattttccacaaataaacgttggtggcgactccgcgcattttcctcctttggaagacgcacccgtgagcctcgcctcgcacgcccgcaaagggtag

SEQ ID NO: 29431 - DNA, 400 bp, Glycine max
  Peptide Sequence Number=SeqID_121116
ctcccggagacggtctcagcttgtctgtaatcggtatgccgggagcagacaagcccgtcagggcgcgtcagcgggtgttggcggttgtcgggtctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccccgaatga

SEQ ID NO: 29432 - DNA, 306 bp, Glycine max
  Peptide Sequence Number=SeqID_121117
atgtcaggatttacacgcaattctcctcaaatttcagccagcccgcatcaattagaccttgcaccttacgcttcagagccctaccatgctcaatggaacgccccggggcttctccgtgacaagcacacgttgcgttcgagtcgtattctcggagaaatggagatatgggatcaagtctggcataggacactggaattgggggaattctacaggctttctcgctgcaaaattcacttcttggttgtgtttttggtttgtgctaaaggtggtctttcgtcagttggaagtgcggagataggcttgtag

SEQ ID NO: 29433 - DNA, 505 bp, Glycine max
  Peptide Sequence Number=SeqID_121118
acaagacctcattaaatgcaatgtttctgaaaatcaagattggaatgctcgtttatttgcccaggattggtttcgagaatcacaagaggggttcaacaaatcagacttgcctagtcaatgcacttatagaggactgattccagtgcaccactattggcccataaaggacgatgacaagtgcagatccattaagtttgctgtggattggggaaataatcacaagcaaagggcacaacaaattggcaaggtggcgagtgatttcaattcattcaagaagagatacaaaccctccataagtgctaatgctacagaactatgtgtggagtcaatggtttgtggagcagaaggatcagtaaagaaatttatgatggaatcattggtcaaggttcctgcaaataccgacctttgcaccatgcctgtcccttttgatcctccaactttgtatgcaacattacagagaaaggaaagctcaattcaacaagttgaatcatgggagaaaagttag

SEQ ID NO: 29434 - DNA, 300 bp, Glycine max
  Peptide Sequence Number=SeqID_121119
atggattcaaatgtttgtctaccacacttgctagtgttagcaataacattggtattggttagtcacgcaatgggagattcagctcaagacaaacagagatgtgcagaatccctgacagattgttgcagtggtctcacacaagccatgaagaccaacaagaagtgtgtctgccttattctcaaagacagggatgatcctgatcttggcttgaagactaacatgacaattgctgttggtctcccttctctttgcaaaacacctgataatctctcacagtgttctggtacgttcaatttctaa

SEQ ID NO: 29435 - DNA, 297 bp, Glycine max
  Peptide Sequence Number=SeqID_121120
atggaccctaagagaataaaggtcattcctgagtggcctactccaccaagtgttgaggaaagaattaatgagtttcaagaacctctggatttgaggtcaaatccttttcaagggggagggaacatgatgaagagagagaggagacgccacttcaaggagaagatgagtctagaagaagctcaccaccataggaggccatggataagagcttggaggaagaaggagttgaatgaagggagagagagagaagagcatgaaattttgtgctctaaaagtgttctgaaatctgaagtttaa

SEQ ID NO: 29436 - DNA, 168 bp, Glycine max
  Peptide Sequence Number=SeqID_121121
atggaggccatgaaggaccaaatgaccacaatggtggaagccatgatgagtatgaggaaaatgatggaggtcaatgcggctacagttgttgccacaagtatcgccactgaggtggacccgactcatccatctagcctcgatcaagtaaatccgccagtctccaatatg

SEQ ID NO: 29437 - DNA, 171 bp, Glycine max
  Peptide Sequence Number=SeqID_121122
atgacaagggctagagcaaggaaagccaaggaagctcttcaacaagtgttgtccatactatttgaatacaagcctaagtttcaaggagaaaagtccaaggtggttcttggcataaaatggaataatgagatgggaaaacgtaggttaagtggtggctggacagaaatatag

SEQ ID NO: 29438 - DNA, 505 bp, Glycine max
  Peptide Sequence Number=SeqID_121123
gaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctactcatgaagatgatagctccaggggggatcaagtggactgccattaaaaggcttaatttgaagcataaggtggacctagtgtgtatccaagaaactaagaaggagtctgttgataagttaatttgccaatctatatggggagattcttctgtgtcctgggatttcgttccttctgttcaagcttcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 29439 - DNA, 527 bp, Glycine max
  misc_feature (121)..(121): n is a, c, g, or t
  Peptide Sequence Number=SeqID_121124
ggtcggaacaggagagcgcacgagggagcttccagggggaaacgcctggtatctttatagtcctgtcgggtttcgccacctctgacttgagcgtcgatttttgtgatgctcgtcagggggncggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgcgaaacagctatgaccatgattacgaattcgagctcggtacccactacgtcaaaatcccctttgatctacaattcaagaaacagggggatcctctagagtcgacctgcaggcatgcaagcttggcactggccgtcgtttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 29440 - DNA, 379 bp, Glycine max
  Peptide Sequence Number=SeqID_121125
atggcaggtattaccgaccggccgttcaggacgctgtgctatgagatgggagccggtttaaccgtatccgagatgatgtcgtctaacccgcaggtctgggaaagcgataaatcccgccttcggatggtgcacattgatgagccaggtatccgcaccgtgcaaatcgccggaagcgtgcctgaagagatggcagatgccgcgcgtattaacgtggaaagtggcgcccagattattgatatcaatatgggttgcccggccaagaaagtgaatcgcaagcttgcaggttcagcccttctgcaataccccgatcaggtgaagtctatcctgacggcggttgtcagcgcggtggacgttcctgttacgttgaagattcgcacgg

SEQ ID NO: 29441 - DNA, 483 bp, Glycine max
  Peptide Sequence Number=SeqID_121126
atgtggtatgatgaaagaatctcaaaacgtgtaagtactacaaacccaacattcaacttatgttgtggaggtggcaaagttgaacttccattgttacaaaatccacctaaatatctccaccaacttttgtatgatcatgatacatctgatagtaaaaattaccaacaaaacataaggacatataacattatgtttacctttacttctactagtattaagttcgacaaatcaattaatcattcaagaggacctcctacaataagaattcaaggtcaaccatgtcatagaataggaagcatgttaccaatgcctgggaaagaacctcaatttgcacaattgtatatctttgacacagaaaatgaagtgcagaataggattaatgcagtaagtccacataatcaaattcaagcacacattgtttcacaacttagtgagaagctagatgaatacaacgtgcaagcaaaaagtttcaggatggcataa

SEQ ID NO: 29442 - DNA, 147 bp, Glycine max
  Peptide Sequence Number=SeqID_121127
atgatagttaagaaggacttcatggttgagcaaaaagtgctattgtataattctaggcttggactcatgagtgataagttgtggtctaagtggattggtccttttgttgttactaatgtttttccttatgtttcgtcggatttctag

SEQ ID NO: 29443 - DNA, 426 bp, Glycine max
  Peptide Sequence Number=SeqID_121128
atggaggccggaaacacatatgtttcacatgagatgcggagagctgatttatgtgaggaattattgggagttagactacaagaaggtgaaattaaaggtagtgtggttaaattaagttggctggctcaccattttgcacaaataaataaccacgacgacgaagaacatgtacgaaggtttgcccgagcatggatactaagattcattggaggtgtcttgttcgttgacaaaagcagtaacaaagtttcgctaaggtggctgcgacgtggaaatcaacatatcggcaatgatgatgtgagagtttttcgtcgcaagtttgatattatgaaatgtcataaggagccttacacaacaactgttatatcattgttgcctcccatttgtgtagccggaagtgtcgctgtggtgcacggaggtggccactaa

SEQ ID NO: 29444 - DNA, 469 bp, Glycine max
  Peptide Sequence Number=SeqID_121129
acaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctgcacttcctctgcttctatcgtttctccaacatcccctttgcatcatcatcgaggtgatttacgacgaggtcagaggtggttcttctgcaaccatcgttggtcatgtatttttctctctctga

SEQ ID NO: 29445 - DNA, 327 bp, Glycine max
  Peptide Sequence Number=SeqID_121130
atggataatgaagagggcgtgcaggaacagatgaaggccgatctatcggctttacaagatcaaatggcttccatctcggaggtcatgtatagtctacaagcttatccttatggcttgcctccggacttcaccccccgtgccaccctggaagatttaagccaagcccctactttcgaggggcaactcccaccttatgacgactatcccgagcaagacgatgaggaaggagatacccatcttggccccctgctccacctcaaagatccgtccccacatgaactaccccaaccgaacatagtccgccatatcccagcctcacccacaccc

SEQ ID NO: 29446 - DNA, 522 bp, Glycine max
  Peptide Sequence Number=SeqID_121131
atgacgagattaaagaatatgtggattgcagctacttggagaatttttggttttccaatacatgctagaaagcctgctgtggagagattacattttcatctgccaggacaacacagtgttctttatgaagatgatgatgatatagatgatatcctatcaaagccaagaatttcatattcaaaattcttagcctggatgaatagcaacaaatgtttttcagagggtagaaatctgacatattcacaatttgtttccaaatttgtctacaaccaaaaggctagatcatggaaccttagaaaaaaaggcaatacaattggcaggttaatatgggttccaccaaccactagtgaattgttttatctaagaatgatgcttactgcatgcaaaggagctacttcatttgaagatattagaacagttgaaaatgttctataccctacatatagagaagcatgctttgcaatgagtcttttgcaagatgacagagaatttgtggaagcaatcaaagaagctaaggattga

SEQ ID NO: 29447 - DNA, 222 bp, Glycine max
  Peptide Sequence Number=SeqID_121132
atgcgggggtccggggaattcgtccccttcttagacacaatgtctaggggtagcaaagtgccccaacgtacgtttttaagaaggcgacacggaccctccgttgtccccagcggagtcgccaactgtcgcaacctacccttcggcgggagggcgacgcgtgactcgcgggatgcgtgttccacgaaaggaatacgcgcggagtcgccaccaacgtttatttga

SEQ ID NO: 29448 - DNA, 660 bp, Glycine max
  Peptide Sequence Number=SeqID_121133
atgattatgaagggccaagacatttatagtagccaagatgaggctactacttcaccttcctctagtgaaagtgaaaaagcaaaaggggaagaatctagtgaagaaatctacccccaagaagaaggacaaccattagtggttaaagagaagtgtaaggaggtaagtgtctcctccaagagtttagctaagaaggaaactcattttacaataaagacaaacattaaagaaactttccctcttagacaacctccacattttctcttttgtaaaaaggcacttgctagcattgccacacctcttgggcttgagtttattcctcaagtaaagaagttgttggatgagggtttggttcgcaagagcttaaatccttgtgctttgttggtacccaaaataggtattattaggcaccaagtccctaaaataggtggtatgatgaatgttttgagtggtgcaaccctcttttgtaaaatcactcatacacctaacatcttcatggtgtgtgtacatagggacccattaggtaggaataatcaatatgaaaatacagaaaaaggtgttgaggaaaaaaacccagagtttcaagaacctcgggatttgaggtcgaatccttttcaagggggagggaatgatgcaatcctaccccgcaagggcattggatag

SEQ ID NO: 29449 - DNA, 693 bp, Glycine max
  Peptide Sequence Number=SeqID_121134
ggttccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggttcagtggacttctcacaacgtcgcgggcagcgaaccgctcacgtcgccgcaatccgaacacttcaccggaccattcaatcggtaggagcgacgggcggtgtgtacaaagggcagggacgtagtcaacgcgagctgatgactcgcgcttactag

SEQ ID NO: 29450 - DNA, 366 bp, Glycine max
  Peptide Sequence Number=SeqID_121135
atggtggcgcgtgttatgctcaggaacggatttgagcccggaatgggtctaggcaaggactgcctcaggaatgccgacgtggtcgatatcaaaggaaatccatacaagtatggattagggtatgaacccgggatgccggggaggaggaatgtgtcgtcaagatttcgggcggacagagtgtggcccggccgtattagccagtgtttcaccagcgctggaatggtgtccgaggaggaggtggccgcaatagaagaggagttccctcaagacccaccaagttttgtgcaaccatgccaccccgattcccaagtggggaactggcgcgtgataagccagtcagaagtctataccgccgattcaatgtaa

SEQ ID NO: 29451 - DNA, 111 bp, Glycine max
  Peptide Sequence Number=SeqID_121136
atggcgaagggaagtgtcgtggttgtccaactttgtcattttcaggacactgaaggtgttccaacagaaggcggtgccttctggtggaagcaacctagctcgcctgggctt

SEQ ID NO: 29452 - DNA, 306 bp, Glycine max
  Peptide Sequence Number=SeqID_121137
atgcaaagttcaaaacatgatgtctaccttggagcctacctgaatggcggacactggcagatggtggtcatcgtgcccaaggaacacctagttgtctggttttgttcattgcataacaggccagacaactaccttaaggagataattaatagtgctttaaaaggtcttgatgatgctccacaacctaaatcaaaggctcctgctaggtggattgtcgtcaagatgtccaccatcattttaggaactttcaggaataactgggaagcgtatttaacgatcctagaccattggagccagagagattaa

SEQ ID NO: 29453 - DNA, 469 bp, Glycine max
  Peptide Sequence Number=SeqID_121138
taccctcaccttcaaaggactacacgtcctcgccttcagagggctacacgccctcacctttagaggactgcatgtcctcaccttcggaggactacatgttctcaccttcagaggactacacgtcctcaccttcagagggctgcacgccctcgcctttagagggctacgcgtccttgcctttagagggctgcacgtcctcaccttgggtactcgtaccctcaccttcagaggactacacgtcctcaccatcagaggactacacgtccttaccttcagagggctgcacgtcctcaccttaagagggctacacgccctcgccttcagaggacttcacgtcctccccttcagaggactgcacgtcctcacctttagaggactgcacatcctcacctttagaggattgcacgtcctcaccttcagagggctgcacgccctcgccttcagaggggctacacgtccttgcctttag

SEQ ID NO: 29454 - DNA, 507 bp, Glycine max
  Peptide Sequence Number=SeqID_121139
atgtcgtcgctcatgcattgcattttgtgtcctcattttgtcatgggaagtcggaagcctagaggtagccggtttgcaagggctagggcagtgaatggaattccaaggaagcacttggaagagaaagtgaaggctttggcggatcaaggtgaatggacttcattcattgatgtcttggcgctattggtgttcggagtcttcctctttccaaatgtggatgggctagtggatctagcggtgatcaatgccttccttgcttatcaccacagcaaggaaagcccgatccttgctattttggctgattcctatgacacatttgatcggagatacgagaagagcggcgcaaggattgtctattgcaaacccactctttatgtatggctggtctctcacatctttcgtcatgaaagtagacccgtttgtcccctacaaggtcaccgcatgtgccgagaaagggaaagcaaattgggatcagcttttggctggtatagtagaggcatccgttaa

SEQ ID NO: 29455 - DNA, 300 bp, Glycine max
  Peptide Sequence Number=SeqID_121140
atggtatctaatcgacggggacaaggtgctgggggaaaccgaggaggacaagctggaagaggatgtcaccatcaatgttcttactgtgcttctgatcacattgctgataatagttctttattttcatccctctctcctccaaaaatttctcatttcattactttagccgatggttctagagttgcaacaacaggaatcgaccatgtacgtggtacgggtcggacgattggtctttactacctcaagcctaatctttcttgggtttgcagtgccgccacatcatcaaagctccttcattaa

SEQ ID NO: 29456 - DNA, 433 bp, Glycine max
  Peptide Sequence Number=SeqID_121141
atgtcttctgtaaaattcataatacttcagcgatgtattattcacatgtattcatgcttttttgtatttccactttggttgcattgctcattgcattatttccttgaagtcaaaatcgtaatcattgtaaccaaggagaaagatcgtgctttatggcacccttaccagacacgtgccaaggccagaataatgagtgaaatcgaagaagtacaggaacaaatgaaggtcgatatggaggccatgaaggaacagatgacaacgatgatggaagcaatgatgagcatgaggaagatgatggaggataacactgctacagttgttgttgtgagtactgctactgagatggacctgattcacccagttagtttcaatcaagtgaatcgtccagtcttagatgtagtaggtcaagtaggcaaggcagcgaaaaatgcat

SEQ ID NO: 29457 - DNA, 504 bp, Glycine max
  Peptide Sequence Number=SeqID_121142
atgggtgatcaagaggagacacaggaacagatgaaagccaacgtgtcggctctgaaagaacaaatggcttccatgatggaggccatgttgggaatgaggcaattcatggagaaaaacatggccaccgctgctgccgctagttcagctaccgaagcagacccaactctcctagctaccgcgcaccatcctcccccaaatacggtggcttacccttatggattgccgcctaattacacgccgccggtcatgcaagatgatgcgggtcatgtctcttccctcatccttgaaggggagcctcctcgacagcccgacgaggtctacgaagatcatcaagagtatgcccaaggggatgttgagttctaccccccgatccccgtcgaggggccgacacccaacactttgctcagcccaacctcacagcacaaccaatattcttgtccacagaaggaccacccccggcgaccgaggaaagaaggaaactcgatctcctcgaggagagattga

SEQ ID NO: 29458 - DNA, 1461 bp, Glycine max
  Peptide Sequence Number=SeqID_121143
ccttcacttaaaaagaggttctatccagtcaaggtcaagagcctagggatcaccagtctaagagagttagggcaattgatgggtcagctccagcggcaagcttttcgtaaagcttacggtaaaatctgggacctagccatgatagaagtctctacagaggccatttcctccctcgcccagtattatgaccagccgttgaggtgcttcacctttggggacttccagctatcacccatggtggaagaatttgaagagatcctaggatgccctctaggggggaggaaaccatacctcttcacagggttctatccctcattagctagaatttccaagatagtccaaatctcggcgcaggaattagaccacaggaagcaagtcgaaaatggggtggtcggaataccgagaaaatatttggagatattcggggaggtcctctttccgaacgtggatgggttggtggacctggcagcgatcgatgcttttctcgcctatcataaccacaaggaaagcccggttgtcgctatgctagccgatctatacgacaccttcgaccgaagatgtgagaagagcagtacgaggattgtttgctgtactccagctctttatgtatggttggtttcacacctttttcgccaagaggtgaggcatgcttgcccgctagaagaaggaagaaccggagttcttatttcatgcggaggatttctgaatgttcccatgatggggacgaggggtttcaataagaccaacgtggagatgcttcagaaggtccgcaaggcatggggggtggtacaaaagaaggacaaagagctcagagacaatgggcccattggtggctatcatgagtggttgaaagcccacgtgcaagatgaggcaccagaggaagacgaaggggtgcaggcccttaggacggaactcaagcaagctcaaacagtcaaagaaaggttcaatttagcaactcttaaaatccgaaaggagaatgccaaactgagagatataaatatagctaccaccaaggctttggaacaagagaccaagagggctcgtagggaagagcacggccgaaacaagttccgaggggctctgtggggtagtaacaacgatcttaaactccggagggaggaaagggaccaatcgcgagtagacagtttgatcttgaaagatgaattgaaggcttgcttgaggtccaaaagaagtttgtctcagcggttatgcgagacagagaccaacatgttagctatcatcaccaagtaccaagaggaagtaagtctagccacggtccatgagcatagagtggcggacaagtatgcccaagtgtacgcggaaaaggaggctagaggaagggtgatcgactcgttacatcaagaggcaacaatgtgtgtcgcaacctacccttcggcgggagggcgacccgtgactcgcgggatgcgtgtccacgaaaggaatacgcgcggagtcgcacac

SEQ ID NO: 29459 - DNA, 285 bp, Glycine max
  Peptide Sequence Number=SeqID_121144
atgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaagcgattaa

SEQ ID NO: 29460 - DNA, 534 bp, Glycine max
  Peptide Sequence Number=SeqID_121145
atgttggtgcgcatgatccgcacttgtctctttgcagcggcacgggtgaaatcttgccccggtatgcatagtagctgtgtgatagcctccctctctggttgtgctcgcacagttggccctcctccaatatcagggggtggcccagggaccgtgcggatgtggagcacactgaaaatgaggacacgtagccctctaaaggtgagggcgtgcaaccctctcaaggcgaggatgtatagtcctctggaggtgagggcgtgtagtcctctcaaggtgagggcgtgcagccctctgttggcgaggacgtgtagtcctctaaaggtgaaggcatgtagccctctgttggcgaggacgtgtagtcctctaaaggtgagggcgtgtagccctacgaaggtgaggacatgcagtcctctgatggcgagggcgtgtagccctcttaaggtgaggacgtgtggtcctctaaaggtgagggcgtgtagccctacgaaggcaagggcgagtagccctctcaaggcgaggacgtgtagtcctctggag

SEQ ID NO: 29461 - DNA, 297 bp, Glycine max
  Peptide Sequence Number=SeqID_121146
atgtcgaatgaaactatccatggaatcgtgcgccgtgtgaaacgtagatcatcgccgttcttaaccgagactcaggaaccgtctaccagttggcaagctagacatcaagtaagtggcttgatgaggataactaagctgacacgccggagttggctgctggcacaacagggtggtgccttaccgcaccgcaggcgaacgcgcggtagcgttcgtggtggtgcttcaggattccaatgtactgcgtccaagatcagaacgagcttgccggcggaccactgccgtcccattcttgagtga

SEQ ID NO: 29462 - DNA, 401 bp, Glycine max
  Peptide Sequence Number=SeqID_121147
atgaccggccctctcaatgagtcaatctcttgctttctcaaaagggtggacccttgggtactagtaccctcgccttcggaggactacacgtcctcccctccagaggactacacgccctcgccttcagaggactacacgccctcgccttcagagggttgcacatcgtcaccttcagaggactacacgtccttgccttcagagagttgcacgccctcaccttcagaggactacacgtcctcgtcttcagaggactacacgtcttcaccttcagagggttgcacgcccttgccttcagagggttgcacaccctcaccttcagaggactacacgtcctcgccatcagaaggctgcacgccctcacctttagaggactacacgtcctcgccttcagaggactacac

SEQ ID NO: 29463 - DNA, 1003 bp, Glycine max
  Peptide Sequence Number=SeqID_121148
cgtctcgtacgggccgcggcgattggcgtttgtgcccgtcatgtatgccagcacgtggtcgaccagcgcgctcagtttcgggatgccgggaaagtgccacgctgtcgatctcgatgcgcgggcagtcgcccttgcagtcgggcttgttggacgcccacttgatgcgctcggtggccaggtcgccgatcttctcgggcgtggccgtgccggccgttggcgagtccagggtgatgttggcggggggcgaactgccgcagccggccagggccagcaggacggctcccagacccgcggcggacaaaaacccggccgcgcgcgcgggcgcgaccgtccgactcaaacccgcggcgcctcaggggacgaccgcggtccattcgggcgtggagaacttttcggcggcctgggcctcggcctgggccagcgtggccgcgcccaattggcccggcgtcagccggtgcaggctggcgaaggtgtccaccatgcgctggatgatgacctcgcgcgccagcccggtctgggtgcgcagcgggtcgacccgcttcttggcgctggtggtgcccttgtccgacagtttctcgcgcccgatgcgcaagacttccaccattttatcggcgtcgatgtcgtaggacatggtgacgtggtgcagcactgcccctgcgcggcgcgcctgggccgcgccgccgatcttgccgatgtccgaggcgatgtcgttgagcggctggaaggcatagctttcctggaagctcatgccgtgcaccagcgcctgcggcgcgctgagggaataggtgatgctgttgcccggttcgatgaacatggcgccgccgccgctgacgcggcgcaccacctcgatgccgtggcgccgggcgccttcgggatcgacttcgttcttgagcgattggaagcggccgatcacgaccgcgggcgccgaccattcccagatgcgcagggtgggcgggcgcgtgccggcgccgacctcatcggtgatgacggcgtccagcgccat

SEQ ID NO: 29464 - DNA, 378 bp, Glycine max
  Peptide Sequence Number=SeqID_121149
atgttatcaaagagaaaaactctagatgagggttcactgttatcaagcaagtcggagacccagcatgaccacagattcacctccactccttatgttcccatggacccggcatcaaagagttatatacaagaacgtaagggaagtaaaaggaaaccgaaaaaggaggaagtcatgatattgcacgagattagaaggcataactctctaaaaacagtccccagtggagtcgccaactgtcgcaacctacctttcgacgggagggcaacgcgaggctcacgggtgcgtcttccaagaaaggaaaatacgtggagtcgccaccaacgtttattcgaggaaaacgtcggaaaaaccagaaaaggtgtggtctacgaactttaa

SEQ ID NO: 29465 - DNA, 360 bp, Glycine max
  Peptide Sequence Number=SeqID_121150
atgggtcaggatgacaaaggtgctgaagacgatgtaagtctctgcttgtcaacgggtttgcttgcccctgattgtcaaagggtgcaaaagacgacgttagtctctgcatgctaccggactctaacaatcgtttgtgcggataacagcttgggtatctccgcatgtcacccgacttcacgggtcaggatgacacaaaccgtttgtacggataaccgcttgggtatctccacatgtcacccgacttcatgggtcaggatgacaaaggtgctaaagacgattgtttatacggataacgccttgggtatctccgcatgtcaccgtgacatcactggtcaggttgacgaaggtgcagaagatgac

SEQ ID NO: 29466 - DNA, 313 bp, Glycine max
  Peptide Sequence Number=SeqID_121151
atggctccattgccgtcactccaaaatggtcaagtgactaaatcaaacacaacatacactctgagggagttcccagaaagatttacaaaagataggataagtccacatttaccaaatttcacgacaaaggttgtatggatcttgtcgcaacatgcccttttgcgggcgagcgaggcgagactcacgggtgcgctttccaaaggaggaaagatgtgcggagtcgccaccaacgaaggtattagcacctctcacgtcgacaaaagcggggcttttgctcctacgtaccctccatcgaagaggaaatcagacctac

SEQ ID NO: 29467 - DNA, 108 bp, Glycine max
  Peptide Sequence Number=SeqID_121152
gcgttctatgaagaactcgctaagcacgcttaccacggtaagcgagttcatcctttgaggatgaacactcatcctcttgttgagctacttgtggctaagcaaggctga

SEQ ID NO: 29468 - DNA, 306 bp, Glycine max
  Peptide Sequence Number=SeqID_121153
gggaggagcttgccacccagttcgcccaggcgagctcagctcgcccaggcgagcaagtttgcttcctccagaagcaacagccttctcgaggaagaatctggaaggcccaactttcgaagaagttacagaaactcacggattgcgcaacaacacctccttttggtttccgccacattacggaatttcacggatcgcataaccctgcttccttttgacttccggcgcgtctcgagacttacatattgtgcaacaaagggtgccaagtaccttgaaacggccaatcaaaggttgcatgtcgtcaaataa

SEQ ID NO: 29469 - DNA, 642 bp, Glycine max
  Peptide Sequence Number=SeqID_121154
atggcgatgcgtaaattaatttctgttagcagttttcttgcacttgcctttgcggccatgaacgcacaggctgctgcagtcagtttgattaatgatggctttgaggcaccttgggataccacgagctttgttggccaagataatgatttcttctttaactattctcccactggtagcaatcttggctggacgttcggggtaaacactggtgttgtgaccacaaaaacaagcctggttcctgctcctgaaggcgaccattatgctttcttgcaatttgcgagtggcttgattagccaaacatttaacgtgagccagagtggcaatgctgacctgtctttcttgtatggtttgcgcccgttgtatgaaagtggtcaagcattgaatgtgtatctggatggtaacctggtcaataccttttcaacccagactggttggaatacaggcacactttcattgggtttcttgagtgcaggaaaccacatcatcgggtttgccgggacaggcaacagtaacgcgggggatacaacagtattcttagataaagttgccatcaatgtcagcagcgtaccagaaccttcttctgccttgatgttatctctgggtttaggtggattgttgttggctcgtcgtcgccaggcataa

SEQ ID NO: 29470 - DNA, 249 bp, Glycine max
  Peptide Sequence Number=SeqID_121155
atgccacaactgcctgcacctacagctgttgatgcaaacatgcctcgacatgcagtggttgcttaccaaaagatagtagaaagcttggaatacatgataaatatgaggatggtcactactgaaactgatgcatacactctgactaagcactgtttaagattagccacaagtgtcactgagcaaggaaatgtttatgttcactcaagacgaaggagggatacacaggacaaagatggtggtggacgatga

SEQ ID NO: 29471 - DNA, 705 bp, Glycine max
  misc_feature (626)..(626): n is a, c, g, or t
  Peptide Sequence Number=SeqID_121156
atggtaccaactattgaagagtttgaggaaatattaggatgccctcttagggggagaaagccgtatcttttctccggttttcctccttccttgagcaagattgcggctgtggttggtgattcagcaaaggagttggattgcacgaagcaaactcggaacggcgtagtgggcttgcctcggaaatacttggaaggtaaggcaagggatatggcgagccaagagaagtggggcccgtttgcggatattttagctttgctgatttttggggttgtcctctttccgaacgttgacggtttggtagacttagccgccattgatgctttcctcgcatatcaccatagcaaggaaagtccagtggtggctatcttggcagatttatttgacacctttgaccggaggtatagtccgcaagcttatccttatggcctgcctccggacttcaccccccgtgccaccctggaagatttaagccaagcccctactttcgaggggcaactcctaccatatgaagactatcccgggcaagacgatggggaaggagatacccatcttggccccctgctccacctcaaagatccgtccccacatgaactaccccagccgaacatagtccgccatatcccggnctcacccacacccgtaaaagaatctgttcccttcgtggaagataagggaaagattgaggcgcccttgaagagaggttaa

SEQ ID NO: 29472 - DNA, 777 bp, Glycine max
  misc_feature (724)..(724): n is a, c, g, or t
  Peptide Sequence Number=SeqID_121157
atgcgcgccgattttgaagcccataaggacgatattggactggttatgacaaagctgattgttccgcagtggcttatgccgaaaggcgtggcggcctgtagttctacccgtgtggtcggcgtgagcctgcctccgtatgactcgttgaaccttggcgcccattgcggcgacgatctcctgcatgtcgaagaaaaccgccggcggatgttttccgctggcggattaccctcttatccggtgtggctggagcaggtgcatggcaccacggtactaaaattggatggcggtccgtacgtgtcaaaacgcgccgatgcgtcatactgtaatacgccgggtaccgtttgtgcggtgatgaccgcggactgcctgccggtgctgttctgtaaccgcgccggaaccgaggtggcggcggcgcatgccggatggcgcggcttatgtgaaggcgttctggaagaaacagtcgcctgctttaatgataaaccggaaaatattctggcctggcttggtccggcaattggccctgaggcgtttgaagtcggtgcggaagtgcgagaggctttcatcgccaaagatgcccaggcgcagagcgccttccgtcctgccggtgaaaaatattttgctaatatttatcaattggctcgtcagcgcctggctaacgtcggcgtggagcagattttcggcggcgatcgttgcactctaagtgaaaaagatgatttcttctctnatcgtcgcgacaagaccacaggtcgtatggcaagtttcatttggctgatataa

SEQ ID NO: 29473 - DNA, 516 bp, Glycine max
  Peptide Sequence Number=SeqID_121158
atggcgagggcgtgtagccctctgaaggtgaggacatgcagtcctctgatggcgagggcgtgtagccctctgaaggtgaggacgtgtggtcctctgatggcgagggtgagggcgtgtagccctatgaaggtgagggcgcgtagccctctgaaggtgaggacatgtagtcctcggaaggtgagggcatgtagccctacgaaggcgagggcgcgtagccttctgaaggtgagggcgtgtagccctacgaaggccagggcgcgtagccctctgaaggtgagggtgtgtagccctacaaaggcgagggcgcgtagccctctgaaggtgaggacatggcgtgtagccctaaaagtgagggcgtgtagccctacgaaggtgagggcgcgtagccctctgaagatgaggacatgtagtcctcggaaggtgagggcgtgtagccctacgaaggcgagggcgcgtagccttctgaaggtgagggcgtgtagccctacgaaggcgagggcgcgtagccctctgaag

SEQ ID NO: 29474 - DNA, 366 bp, Glycine max
  Peptide Sequence Number=SeqID_121159
atgcagcttgcagttaacatgagtgaccttcctaatattacaaggaatgtcattatcttcacagatatccattaccacaaagtctgtcaggaagataaaatgttttgctctgggggcccctgcggatcttgcccctgtctcaaaattgggctcatctctggtccatgcaactgtggccccgaactgctcaggggtaggccaagggaaaggactggggtcctggctttgctgagatggacaccagggatggtgtctcctgtagaggcggtagcggtgcatttgcggctggctgctgctagccctcctcctgttgttgtgcctggccctcccgctgtgcttgcctgggcatggaatatttctctatga

SEQ ID NO: 29475 - DNA, 429 bp, Glycine max
  Peptide Sequence Number=SeqID_121160
atggggaggggtgaagccattcttcaccctaattcttccccaaactttcaaaaacccaagtgctcatgggaatcacgaatccagcagcccccaagcccctattgtgcattcatccctacagacaaattatgtgtgaatccatgtgttgtttgcttgaattggggggctgtggacgtggagtttgatggacacaaattccaaagtgaggagcaccaatgccgatttgagacaattaagggctggtcgttcctcaaggagaggcgagtccaattgagggacggagattatgtcgagttccatgaggaaatatccaagaggcaatggactcagcttgtgtcacccatggctaagtatgattcggagatagtcatggagttctatgccaacgcatggcctatagaggagggagccagggacaagcactcctga

SEQ ID NO: 29476 - DNA, 132 bp, Glycine max
  Peptide Sequence Number=SeqID_121161
gtggttgtcatcatcaaaaagggggagaatgtaaatcatgaagattttgatgatgtcaaaaagatcaagccttggataatgagcgtcatcataaaaaacggggagaatgtggatcatgcattgtttttatga

SEQ ID NO: 29477 - DNA, 768 bp, Glycine max
  Peptide Sequence Number=SeqID_121162
atgacattgctacttagcaacattctgcccagcgaccgcattgccaatctccccctgcaaaagtatcagttggtctgtgtcgtcccgacgtggggatcgcacccacaaagacacccagtggacccgaaaaagtcaaacagggccctggggtttccagctctggttacgggcctctatcagtcctacagggtgcccgtacccccccggcaaggtcatgtcatcataggtatggcgcctactaggcaccctttggacccagacaagtccaacagggccctgggattccccgcagtgatcacaggactctgccagtcgttcggagtccccgctgcacctaccaaggtgatttggccgcccatcacccgggcttttattgagaagtactgtacccagagacaggctcagggtgatgctccacaggctgcaggcgcgccaccaccacctcatcaggctggccaggctggggcatttgacatggagcagtatttacggcatttggttcgccagcaggcggccaaccaccgagcacatgtacatacccatgattgtctgtaccagataagccttagcatgcagagccagggcttcgcttctttttcatgccctactccagaccagttcagggcagaggttgcatggcccggagattggcccgaggcccaagcaggagaggcacccccagaagctcccggcgatggagaagaggcccacgaggacgaggagatggccgatttgcttgacttcttgggagggagtggagatacgtga

SEQ ID NO: 29478 - DNA, 282 bp, Glycine max
  Peptide Sequence Number=SeqID_121163
ggatcacgccctgcaagacacccatgtggaccctggagaagtccaaacagggtcttagggcttccggctctgattacgggcctctgtcagttctacggagtgcctatcatccccagcaaggtcatcaggcctcatactaaccgagctttcatcaagaagtattgcgcccccaggcaggcgcagggcaaaacaccccagcaggctggggatggcttgcagcgggcaacagacgcaccgccaccacctctagagttcacctcagctcatccacaaaaaggttag

SEQ ID NO: 29479 - DNA, 405 bp, Glycine max
  Peptide Sequence Number=SeqID_121164
atggaagtatcatttgttctgttccatcttgacataggtaaggatcgcgcccacaagacacctagtggatccggaggagtccaacagggccatggggtttccagctttggttatgggcctctgttagtcctacagggtgcccgtcccccccagcaaggtcatgccatcggatcgcgcctgcaagacacccagtggacccggagaagtccaaacagggtcctggggtttccagctctgattacgagcctctgtcagttttacggagtgcctgtcatccccagcggagtcgccaactgtcgcaacctacccttcagcgggagggcgacgcgagaactacgtaggtctgatttcctcttcgatggaggatacgtaggagcaaaagccccgcttttgtcgacctcgtga

SEQ ID NO: 29480 - DNA, 321 bp, Glycine max
  Peptide Sequence Number=SeqID_121165
atgattctgaaagacgaattgaagacttgtctgaggtctaaaagaagtttgtctcagcaactgagcgagactgaagcaaacatgttagccatcatcggcaagtacaaagaagaactggatttggcaacggcccatgagcataaggtggcggatgagtacgcccaagtgtacgcggaaaaggaggcaaggggaaggtccagatcttccccgattactagcaaaggccaaggcgatggcagacgtgtacttagcccccgaggaaatccatgggctcctcagctattgccaacatatgatagacttgatggcccatataattag

SEQ ID NO: 29481 - DNA, 357 bp, Glycine max
  Peptide Sequence Number=SeqID_121166
gctttcgtcttacagatagcaaaaaagaatgtttatacggataaccactcgggtatttccgcccgtcagcgtgactcaaaagtcagtatgacagatcttgtgagcgcggaagatgacatagcaaaaaagaatgtttatacggataaccactcgggtatttccgcccgtcagcgtgactcaaatatagcaaaaaagaatgtttatacggataaccactcgggtatttccgcccgtcagcgtgactcaaatggcgcagaagacgacgttagtctctgcgtgctatcaggcttttcgtcttacagatcagcaaaaaagaatgtttatacggataaccacccgggtatttccgcccgttag

SEQ ID NO: 29482 - DNA, 489 bp, Glycine max
  Peptide Sequence Number=SeqID_121167
atggctttgtgttcagtttttctcaatcttcatctttggctttttgtttgtttgaccattgaagcgttaggtgtgccgaagccttcagtagctagttaccttagccaggagctactggcagagcaagaagttgatagagtgcatggattactagcgcagcctccagtgaagctcaacaatatgttggttatatcactgtcaatgaaactcaaggaagagatctgttctattggtttttcgaggccacccataaatcggaacaaaaacccgttctcttatggctcaatggagaagcaaaggagacactctcttgtttggttacttccttttctctcactctggtgtcttacagatgaaaatctttgtcacagcttagagggaaatgttggtgcactcacaaattttgaggtccttgatttcttacgagctaaaggagcttcaaaggatccaacaagagttattaccaaagtagcgcaatctgaatacaag

SEQ ID NO: 29483 - DNA, 246 bp, Glycine max
  Peptide Sequence Number=SeqID_121168
atgtgtgcaaaaaagcggttagctcttcggtcctccgatcgtgtcagaagcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactga

SEQ ID NO: 29484 - DNA, 363 bp, Glycine max
  Peptide Sequence Number=SeqID_121169
atggctagaggtttcaaggagaaattgggtggaggaggctatggcattgtattcaagggaaagttgcatagtggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 29485 - DNA, 138 bp, Glycine max
  Peptide Sequence Number=SeqID_121170
atgcatacgcatacgcatgcatattgttgtggtaaagcaggggctggatcatctcgagctaccttttggggtagaaacaaagttaaagcagccaaaaaccaatcaaggtacttaggaatggacgcaaatggaggatag

SEQ ID NO: 29486 - DNA, 324 bp, Glycine max
  Peptide Sequence Number=SeqID_121171
atgccaatctccccctgcagatgtatcagttgggatcgcgcccacaagacgcctagtggacccgaagaagtccaacagggccctggggtttccagctctggttacgggcctttgtcagtcctacagggtgcccatccccccaacgagggatcgcacccacaaagacacccagtggacccggagaagtccaatagggccctggggtttcctgctttggttacgggcctctgtcgtcctacggggtgcccgttccccccggcaaggtcacgtcatcatgacataggtaaggatcgcgcctacaagacacccagtggacttgaagaa

SEQ ID NO: 29487 - DNA, 231 bp, Glycine max
  Peptide Sequence Number=SeqID_121172
atgaagtcaggtgacatgcgggggtaccgtatggttatccgcacctttcgtcaaccaggggcaaacgagcccattgaagctcagagactaacatcgtcttttgcaccttttgtcatccagggacagcgagtcaggtggcaggtggagataccttatggtcatccgcacctttcatcaaccgaggcaaacgaattcgacggtatcaggatgatgttggtcgttcgcttctga

SEQ ID NO: 29488 - DNA, 718 bp, Glycine max
  Peptide Sequence Number=SeqID_121173
aagctacgaaggtgaagacgaaggttatgtcaacagtagcgacgagatgagtgaaggtcaacaaacacaggatgttgtgacaaaatatggactagatcctgaagcgtggaaacaatttgaagaaacccgcctgacacctaactgggagggtattaggaaacgagcacaatcaattcaaaaacacaacgactgccctcacgtactttcacgtgggggatatgatttgcttgagaagaaattgttagaccaaaaacgaaaaaggatacaagaggaagcattgttgagtgaaaatccagcaagtcttgatgaacccccatctccaataaaaagacatgttaagtggaaggttgctcggaccagggctgttggcaatatgacatctgactccgcacaggaaattgcagataaaatagactccttagaagagcaggtaacgcagggttcgtttgtaccccatggtcggcaagacatactgaacactgccattggccgacctgaccatgggggtcgcgttcgggcagcaggctcaggtgtgactattactcagtactacggaagggcatcaaggacatgcagcagctcgtccacatccatcagccaacaacaactagatgaagttgttgcaaggcttagggaagacatgactggccagattagggaagaattgaggactcaaattaaggaacgaattgaggactcagttagaagaggaaaatag

SEQ ID NO: 29489 - DNA, 129 bp, Glycine max
  Peptide Sequence Number=SeqID_121174
atggtgatggaggagcaagaagaaaatgtaggggaagaaggagaagaggctggaaatttctggaggaaagagagagaagaaatttcgggtagaaattccaagatgtcacactcagaaatctggtggtga

SEQ ID NO: 29490 - DNA, 138 bp, Glycine max
  Peptide Sequence Number=SeqID_121175
atgggtgttaaacattttaaggcggtcaaacgaaggtcgcatgctgatagtttatacacctgttcatattcacacttatctttacacaccagacacttattagctgaaatagcttaccaagtaacacaagttccctga

SEQ ID NO: 29491 - DNA, 861 bp, Glycine max
  Peptide Sequence Number=SeqID_121176
atgagcataaactggttagctgtccgaaagcagccagttttccatctgcacctgcgcgacgatggtgtttatttgccggagacgatgatgtttgatcctgaaattgcctatcaggcgctgacggcgcgcgacagccgtttcgacggggtgttttttgtcggcgtgacctccaccggtatttactgccgtccgatctgtccggtgaaagcgccgatgcagaagaactgcctgtttttcaccagtgccgaagcggctgaaaaggcgcactttcgcccctgcctgcgctgtcgtcccgagctggcacctggttcggcgccagtcgatagtcatcatcgcatcgccgaccggctgatacgccgtatcgaagaaggcttactggaagaacaggagacgctggctgagatcgccagcgagtttgacctgagtgaacgccagctaaggcgggtgattcagcaggagctgggcgtgtcgccacttgaactgcggcaaacccggcgtatgctgctggcgaagcagctactgactgaaaccgcattgccggtgaccgagattgcctatgccagcggttttcgcagtctgcgccgttttaacgacgtgttccaggctcgctatcgcatgacgccttcgcgtctgcgtaagcagattcagacggaagccctgaatggtgagcaggagagcgccgaactgcgcctcagctaccggcctccttatgactgggacgccatcctcgatttcctgcaacagcgcgtgatgaagcaagtcgagtgggtcagcgagggcgtttatcatcgtactgtggcgctcggtcagtgtcgtggctgggtgcgcattagccatttgccggaaaagcaggcgctgaag

SEQ ID NO: 29492 - DNA, 521 bp, Glycine max
  Peptide Sequence Number=SeqID_121177
gcaaagatttgggaagcacgggcggcccccattatgcgcaaagtcaaaacaagcatgccttcccaccatatggcttgcctcccaactatacaccacccaatgtagcgtacactcccagtgagaatgtcaacaactccactcccatactcattgagagccgacaaccccaaactgatcatgcgcatgtctctcaacccatgggtgatacatatgaaatgccccaccacaatctagccgacttcgagccttgcctcggatatgccactgaagggcaggcaattggtggtatacccctacaaaaccctttggagggccctcagtatcacccccagctacacctcttgcattccacaacaagtaaaaaccctcatgctatggcagaaatgggaaagttggatcatctagaggaaaggctcagggccattaaaggatgtgaagattatgcctttgctaacctagaagagttgttcctagtacccaatatcatcacccctcccaaagttcaaggttttggactttga

SEQ ID NO: 29493 - DNA, 559 bp, Glycine max
  Peptide Sequence Number=SeqID_121178
gggggcggagcctatggaaaaacgccagcaacgcggcctttttacgggtcctggccttttgctggcttttgctcacatgttctttctgcgttatcccctgattctgtggataaccgtattaccgcctttgagtgagctgataccgctcgccgcagccgaacgaccgagcgcagcgactggcacgacaggtttcccgactggaaagcgggcagtgagcgcaacgcaattaatctatgaccatgattacgaattcgagctcggtaccccatcggacctgccgtctctggatgacaaaggtgcagataacgacatagcaaacgagactttttcgcagtctcggccggaagacactgacatctctgggaaaggtgcggataacaatacgagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 29494 - DNA, 479 bp, Glycine max
  Peptide Sequence Number=SeqID_121179
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgatccccttcttcggtgctgtatcatatctgacagttgctgttactcccttctgcattgtgtttgctgtgctttggggaatttatcgccgtgtatcatttgcttggattggtcaagggctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactga

SEQ ID NO: 29495 - DNA, 797 bp, Glycine max
  Peptide Sequence Number=SeqID_121180
atggtggaagaatttgaagagatcctaggatgtcctctagggggaaggagaccatacctcttctcagggttctatccctcattagctagaatttctaagatagtccaaatctcggcgcaggaattagaccacagaaagcaagtcaaaaatggggtggttggaataccgagaaaatgtttggaggcaaaagcaagaatcttggtaggtagaggcgaatgggccccgttcatagacattctcgcactgttgatcttcggaggagtcctctttccaaatgtggatgggttggtggatctagcagcgatcgacgcttttctcgcctatcatgaccacatggaaaactcaattgtcgctatgctagccgacctatatgacaccttcaaccgaagatgtgagaagagcagattcccaaatgttcccttgatggggacaaggggttgcatcagttacaatcccgttcttgctataaggcaacttggctaccctatgagaggggcaccactagaggaagagctcgcgcctgtcatttcacgaggtttcaataagaccaacgtggagacacttcagaaggtccgcaaggcatgggaggtagtgcaaaagaaggacaaagaactcaggggcagtaacaatgggcccatcgatggctaccgtaagtggttgaaagcccacgtgcaaggtttggattggctcctgagtttgagaaccgctgaaagggaggaagttgaggcaccaaaggaagacgaagaggtgcaggcccttagggcagaactcgagcaagcccaaacagtcaaagaaag

SEQ ID NO: 29496 - DNA, 303 bp, Glycine max
  Peptide Sequence Number=SeqID_121181
atgtgcacgtatgcaatttttgatagccaaagtgctttgagtatgcatgtatgtaaatttagcaaaggaaatgcgtgtgatgtaggaatggccccgaggaagcttgcctcaaagaggtccaggaaggacaaggcgaccgaaggaactagttccgctccggagtatgacagtcaccgctttaagagcgctgtacaccagcagcgcttcgaggccatcaagggatggtcgtttctccgggagcgacgcgtccagctcagggacgaccagtatactgatttccaggaggaaattagagcgccgacg

SEQ ID NO: 29497 - DNA, 201 bp, Glycine max
  Peptide Sequence Number=SeqID_121182
atgctacaatgtacgccgactaatgttaaccctctggagctgtttgtgtcctcattgccggtcgccgtcgtccttcctgagcttctcgctgccttacaccatgcccctcaggttttgcttaacgcgcctacgggcgccgccgcgcaggctggccgcacgcaacgtggcgcagcgcctggggtaccgagctcgaattcgtaa

SEQ ID NO: 29498 - DNA, 312 bp, Glycine max
  Peptide Sequence Number=SeqID_121183
atgggtgccaagtatctcaaagtggtcaaacgagggtcgcatcccaacaacggatggtccccggacgaaattaggacgcagaatgaccataatttgtctctgcgttttgttggaaatgatcgagcctgggcggcgagatacagaatgaccataatttgtctttgcatgccaccggacacgatcgcctctggatggcgaaaagggcgtagacttgtctctgcgcgtttatcacccaacatgcaaaatctgaatgacaaagggcgcaaaatttgtctcttcgcatttatcacccgcctcgcagcttctgaatga

SEQ ID NO: 29499 - DNA, 486 bp, Glycine max
  Peptide Sequence Number=SeqID_121184
aggggaaagtttgattacgtctccccagtaggtgccagcggtaggagtgtcggaacaactggggcaaagaagaaagagggagatgcccataccgtcacttcaacacctgcgtggcccaagccaccacaaacccccgacggtacccaccaatacgcacaacatcacccgagttttttggctcgcgctgggggctctcccgacacagcactcgcccagccaagggcgcccacgcccctagaagggggagctcctcaggctccggctccaacccgacctcactcgaccaataatgcccaccttggctcgagctccaacacggcaaggaacttcttgccaaggcaggctcagattttcaccctgatcccaatgacgtatggggacctcttaccatctctcatcaccaaccaattggccatggtgattccgggaagggtcctccagcctccattcccaaagtggtataaccctagcgtaacctgcgcataa

SEQ ID NO: 29500 - DNA, 303 bp, Glycine max
  Peptide Sequence Number=SeqID_121185
atggctactccatctgcctcgcctcctcctcctcctgcagtagcattagcgtctccgtgtaccttgaaatggacacgcaaagccacatggctacgatccttggccactagaccacctggggcagagagaccagtggtccacgtcgatcttgtgaccgacaaggtcgacggtccccacaagaagaaattaggaacatatttagggattgtcgctcatgataaggtggaatttgatatccctgaaacttctgattgtaggacaaagaagaaggtacttcagactgtcggcaagcagttgagatag

SEQ ID NO: 29501 - DNA, 195 bp, Glycine max
  Peptide Sequence Number=SeqID_121186
atgttgctaagtagcaatgtcatctatatctgtgtaagagtggtcatgttggtgcgcatggtccgcactcttctctttgcagcggcacgggtgaaatcttgccccgttggccctcctccaatatcagggggtggcccaggaaccgttaaaaggaaacgtactggtcccttaaccgggagtgcaagtctcggttaa

SEQ ID NO: 29502 - DNA, 961 bp, Glycine max
  Peptide Sequence Number=SeqID_121187
cgctcttgcgccgaagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaactcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggtgtgggcgttagagcattga

SEQ ID NO: 29503 - DNA, 465 bp, Glycine max
  Peptide Sequence Number=SeqID_121188
atgccaatctccccctgcaaaagtatcagttggtctgtgtgtcgtcccgacatggggatcgcaaccacagagacacccagtggacctgaagaagtcaaacagggccctggggtttctagctctggttacgggcctctgtcgaccctacagggcgcccgttccccccagcaaggattgtgcccgcaagacacctattctagggagtgcctgtcgcccgcagcaagatcatcaggcccccctaccaatcgagctttcatcaagaagtactgcgcccccaggcaggcgcaaggcgaaacaccacagcagcctggggatggccggcagcgggcaacagacgcaccgccatcacctctagagttcacctctgctcatccacaaaaaggtttgagtattgcctacaccacatggccgaccaataggcgaccaagtccaaagccaaaggtaagcaaagtactaggtcagtga

SEQ ID NO: 29504 - DNA, 362 bp, Glycine max
  Peptide Sequence Number=SeqID_121189
atggagcttcagaatgtagctatggcgagacaaagggatgacgatgttaatgtttctattgttgaatttgctacgtgcacccagcattattgctggggcacccagcaaacagtgaagtggcgaaactgcccttcagcaattattcttccggaagaaggttcttccggaaaagttccggaaataatttttccggaaagtttctggaagaatcttcttccggaagatcaatttgtgtcttccggaaatactcacagacaatttccggaagaacgtcatccggaatgtttccggaagaagcttcttccggaagaattccgttgtcttccggaagaagcttcttccggaagaagcttcttccggaa

SEQ ID NO: 29505 - DNA, 1491 bp, Glycine max
  Peptide Sequence Number=SeqID_121190
atgctcaagcaattcctcagcaaactccctcgcaaggcacccaaacccgactcggacgagtcatgccgagccgactcgtcgcgctcggacgattccccacgcgccgccagcagaaacatccgccctcccggcggcggaggctcctccgccgcgaagaaaacatcctcgtcggcggtttttccggcgagcacggtgtcgttgattgaacctttggttccttttaaggatgttccgagttcagagaagatgaaccttttcgtgagcaagctgagcctgtgttgcgtcacgttcgatttcacggaccctggtaagaacacggtggaaaaagaggtgaagagaagaaccctcgttgagctcgttgattttgtgtcctcttgtgggtcctcgaggttcagtgaacctgctattcttgctgtttgcagaatgtgtgctattaatctctttcgcgttttcccgccaaattacaggtccaatcgtggtggtgagaatgatgatgatgagccagcgtttgatcccgcttggcctcatttgcagctggtgtatgagttgctgcttaagtttataacctcaaattgtctcgatgctaaggtggctaagaagtacattgaccattcgtttattttaaggttgttggagttgtttgattcggaggatcctagggagagggactgcttgaagacgattctgcatagggtttatggcaagttcatggtgcataggccctacataaggaaatcaattaacaacttgttctataactttgtgtttgagaccgagaggcacaatgggattgcggagttgttggagatttttgggagcataattagcgggtttgctttgcctttgaaggaggagcacaagatcttcttgtggagggttttgattcccttgcacaagcccaagtctattggggtgtacttccagcagttgtcttattgcgttacacagtttatagagaaagagcccaagttggcaagcattgtgataagggggatgttgaagtattggccgataacgaacagtcagaaagaggtgatgttcctgggtgaactggaggaaattttggaaacaattaacatggtagagtttcagagggtcatggtcccgttgttttggcggattggatgctgcattaacagtttgcacttccaggtagctgaaagagcccttttcttatggaacaacgaccatattgtcaacttgattgctcacaaccgacaagtgatcctgccaatcatatttccagccttagagaagaattctcagggccactggagccagtcagtgctcaacctaacttataacgtgagaaaaatgtttgtagagatggatgagaagctgttcctggcttctcattctcaattcaaggaagaagaagtaatgctaaacatggcggcagagaagcggaaggaagcgtggaaacaactcgagcatgcagccagtctccagcctgcgattggaaataccccagttttagtatctccaatttga

SEQ ID NO: 29506 - DNA, 732 bp, Glycine max
  Peptide Sequence Number=SeqID_121191
atggtgaggtcgcggttgacgtcgagtctcttccatgacattaacggagcggaaggagacgagctccttgaggtagttggtgagggccttgccgccgaggtcgatcctcttgacggcgtagttgagggcgaagttgtggaagacgggggaggcgtgggtgaaggagaacccggcgtcgaggacgaggctgcactgggccttggagaggagcccgttggcgttgttgcggctggcctcgtggaggtggacgagggagggggagtgggccacgtacagggcccggaagttgaagtcctcgaagacgagctcgtccaccgagcgctggatggaggggggagtgaagagaggctccgtgaggaggagcgaggactgggaagggtttatgtggaggacggaagagaagaggtgggaccagatttcgcgctggaggtcggggtttatgaggtagccgcggtccatggggcggcgcacggcggcggaggtgaggtcctcgtcgccggagtggaggtggagccacttcttcgacgacggggggcggtagaggcagttcgggactatggcggaggggtcgcgctcgccgccgatgcccgccttgatcagcccgccgccgttgtccaggactaccacgttcgtcgaggtcgacatcttgctcaaccaattaaatcagtcgtgttgttgcaccgctcctccccaaaagatccctctatccagcttctttctatgtcaaactag

SEQ ID NO: 29507 - DNA, 1026 bp, Glycine max
  Peptide Sequence Number=SeqID_121192
atgaacactctctctgaagcctacaaagcacaccctctccacctcagtcacattattcccttagacttttcttcagcccttagcttacctgattctcacgcatggcctcactgtcaacccaatgatgatgcatcatcatcatcatcatcatcatccatacccatcatagacctcatggatcccaatgctatggacctcataggccatgcatgtgagaagtggggtgctttccaattgaagaaccatggcataccttttggtgtcattgaagatgttgaagaagaggctaaaagactttttgctcttcccactgaacagaagttgaaggctcttcgatctcccggtggtgccactgggtatggcagagcaaggatttcaccgttcttcccaaagtttatgtggcacgaaggattcaccatcattggctctccctctcacgatgccaaaaagatatggcctaatgattatgcacgcttttgtgatttgatggagaattatgagaagcaaatgaaggttctagcggatagactaacagagatgatattcaacttaatggacataagtgaggaaaaaagaaagtgggttggtgcaagcaacataagtgaagctgttcagttaaatttctacccaagttgtcccgagccaaaccgagccatgggcttagcccctcacaccgacacttctctcttcacaattcttcaccaaagtcaaatcactggtcttcaaatcttcaaggaaggaaaagggtgggttcctgtgcaccctcaccctaataccctggtcgtgcacacaggcgatctcttgcacatcatttccaacgcaaggtttcgctgtgcacttcaccgcgtaacggtgaataggacatgggaacgttactctgtggcttatttctattctccaccgatggattatgtagtttctcctttggttcactctgttgctcgttttcgtgatgtgactgtgaaggagtatattgggattaaggctaagaattttggagaagcattgtcctttattagtacttga

SEQ ID NO: 29508 - DNA, 123 bp, Glycine max
  Peptide Sequence Number=SeqID_121193
atggaagagaagatccttatcatcctaaatgatcattggggtgcaatcaacttgggtgttgtccaaccaaatgaaaacccaaatagaagtttctgtgtgagtcttcagatggccgcaggataa

SEQ ID NO: 29509 - DNA, 1029 bp, Glycine max
  Peptide Sequence Number=SeqID_121194
atggagtccttaaagggtgaagaagtaaagtgcgtgtgggttcagggccctatcatcgtaggagcaggaccctcagggctagccgtggccgcgtgcctctcccaccatggagtgccctacgtcattctcgagaggagccactgcatcacctccctctggcaacacagaacctacgaccgtctcaaactccacctccccaaacacttctgcgaactccccctgatgcccttccccctccatttcccaaaatacccctccaagaaccagttcatctcctacctcaactcctacgcttctcgcttcaacatccgccccaggttcaaccaatccgttcagaccgccgagttcgacccttcttctcagctttggctcgtcagaaccaacggttttcagtacatttccccgtggctcgtcgttgctaccggagagaatgctgagcctgttgttccctccatttctggcatggacatgtttcacggtcccattgttcacaccagcgtctacaaatctggttctgattacaataaccagagggtcttggtcattggctgcggcaactccggtatggaagttagcttggatctttgccgccacaacgccaacccttacatggttgcaagaaacacagtacatgttttgcctagagagatgtttgggttttcgacgtttggaatagctatggctctcttgaaatggcttccaataaaggtagtagacaagttggttttggcggcggctaggttaatgttgggtgacaccgctcgttatggcgttaggaggcccaaaacggggcctatagagctcaaactagtaaccgggaaaacccctgtgcttgatgttggacaagtggctcaaataagatccggtaacataaaggtgatggaaggtgtgaaggagataacaagaaatggtgccaagtttatggatggcaaggaccgagctcgaattcgtaatcatggtcatagctgtttcctgtgtgaaattgttatccgctcacaattccacacaacatacgagccggaagcataa

SEQ ID NO: 29510 - DNA, 453 bp, Glycine max
  Peptide Sequence Number=SeqID_121195
atgaggaccacttgcttactaagccttccccctcttacttcaaaccaaccctccaacgcttctttcaaccccgcaaagccacctcaactttcatcggtgaaaaacgaaacatgttggaagaggcaatgcgttatgatgggagtggcatccataattggactagaaatgtgcaatttagtggcactggcccacgaagcaattgaaatcacaactatgccaattggtaaccaagtagtatcaaatagcaattcttatggtggcgccaaatggagccagaaaagaacgtgctcaccttggcaaggcaactcgctcgaaaccatcatgccggagaaccttccccggccgtcggcacggcggcgatacgaggctgttcgttcctccaccaagactgtgccaccgccctcagccccgatcatagtccaaagcaacaagggcagctgcttctccatgtga

SEQ ID NO: 29511 - DNA, 2022 bp, Glycine max
  Peptide Sequence Number=SeqID_121196
atggctgctactgctccttcatctgcatacccttttggaatccctttccactcccactctcgaagagtggattgctcaacctcaacctccatgttccccattcacgcagacctctcaacaatttctatgtgcccacgttctgcttcaaagggattagttgatcaagtatatgcacagcttgataatgatgattactacagggagaaagttccaacacccattcttgacatggttgaaaaccctctttgcttgaagaacttatctcttcaggaactgaaacaactagcagttgaaatccgttcagatttgtcttctattatgtcaggtacacaaatatcaccgaaagcaagtatggcagtggttgagctgacagttgcaatacatcatgttttcaatgctccagtagacaaaatattgtgggatgttggggatcaaacatatgcacataagattcttacaggaaggcgatcactcatgacgacaatgagaagaaagaatggtctttctggtgttacttcccgatttgagagtgaatatgatgcatttggtgcaggtcatggatgcagcagtatttctgctggacttggcatggcagttgcgcgggatattaaggggaggcgagaacgcgtaattgcagttatcagcaattggacaactatggctggtcaggcgtatgaggcaatgagcaatgcaggatatttggactcaaatatggttgtgattttgaatgatagccgtcactctttacttccaaaaattgaggagggcccaaagacatttgtcaatgccctatctagtaccctgagcaagctccagtccagtaaatctttccggagatttagagaagctgctaagggtgttacgaaacgaattggtagaggtatgcatgaattggcagctaaagtggatgaatatgctcgtggtatgatgggtcctctaggttctactctttttgaagagcttgggttgtactacataggcccagtggatggacacaatattgaagatctcatatgtgttctgcaagaagtagcttccctggattcaatgggacctgtcttggtacatgtgataactgacgaaaatcagggagatgaaaacagtcagaaaagtgatatatcagatgggcagcaggatgaaggttctgttaaatctgattcgttagataatcctgttcggcctcaaacatatggcaattgctttgtggagactttggttgtagaagcagagaaagacaaagatattgttgttgttcatgctggattaacgatggagccatcacttgaactgtttcaggaaaaatttccagataggttttttgatgtgggaatggctgaacaacatgcagtcacatttgcttctggattggtaggttctgatggtccccttcaatgtggagcatttgatataaactttatgtcatgcttaccaaacatgattgtcatggccccatctgatgaggttgaactcatgcacatggtggctactgctactcgcatcaatagtcagcctatctgctttcggtatccaaggggtgccctggttgggagagggtacactataagcgatggaatccccatcaagataggaagaggaagagttcttgttgaaggcaaagatgttgctttcctaggatatggatcgatggttcagaactgcctaaaggctcattcactcctcgccaagcttggcattgaggtaactgttgctgatgcaaggttctgcaagccccttgacatcaagcttctgaggcagctttgtaaacaccactcttttctagttactgttgaggaaggatctattggaggatttggttcccaggttgctcagtttattgcggttaatggactactcgatggaagaattcagtggcgaccaattgttttaccagacagatatattgagcatgcatcaccaaatgaacagcttgatcaagcagggttgagtggacatcacattgctgccacggcattgagtttactaggccgtacccgtgaagctctcctatttatgtgttcctga

SEQ ID NO: 29512 - DNA, 1176 bp, Glycine max
  Peptide Sequence Number=SeqID_121197
atgagattgagaaagggaaataaagtggagatccgtggcaatgctgatgggcttactgtggaatggcgttgtgctcgtataatttctggtgatgggcacacctacagtgtccagtatgactgttctagcacaacaagcggggctagcactgagagagtttcaaggaaggccatcagaccatgcccccctcttattaaaggtattgagagtcaggcagcaaatgatcatgtggaggtttacaatgctggttcttggagagtagccactgtcttgaaagttattggtggagacttctacttggtaaggttgtgggtatcttgcaaggagttaaaggttcgcaaagtaaacatgaggccacgtcaatcttggcaaaatggtcaatgggttgtcgtgccaaagggatcaggcaagtctagctggtgtttgatttcaaacagttacaaggatcaacctgaaaatcagtgcagaaatattttttccccaggattagatgccagtggtctccaggaatctcgtctggcctcatcttcaacattgaagagaatgtccccttactcctctgttattgaggcttatcccagaaaattaagggcggttgagaatatgggtgagtgtgaaaggttcaaagctgtaaccacagcccccttgctgcaaaaggtagatgctgttgcttacccacaaaatattatgggtgaaaaatgcatgcatacttcctttactaatggtaccaaccaatgttatgaaacaggaaaggtgaatccttgtaatgtttcaacacacttttttgagagaattgaagaacctgattattcttgtagtgatctgagttcagttggcagttgtagtgtgataagtagtaactcaaataaattttccagtgatactttagcaggtccttgccaggaagaagataccctttacagtgatgcagaatctctagatgttggagatgtggataaaggaggctccacttctcccaaagaggttgtagcagaaattattcataggttagagttgcatgcctatcacagtacccttgaagttttgtatgcttctggtcctttaagttgggaacatgaagaattgttgactaaccttcgtatttcactccatatttcaaatgatgaacatttgatggagataaagaacttagtttcatctggtcagaatttttaa

SEQ ID NO: 29513 - DNA, 720 bp, Glycine max
  Peptide Sequence Number=SeqID_121198
atggcccttcagaattggaccagcaacagaggaaaaaattgtgttattatggtggtgcttccaacacccaagacagaatacaaactatttgcttttgatacagtaaacaagaacctatccccaaagcctggagagcagtccaaaatcccaattcctgcatctttgattgcaggtgcctgtgctggaatcagttcaactatatgtacatatcctcttgaattagtcaagactagattaactgtccagagcgatatttatcatggtctgcttcatgcattcgtgaaaataattcgagaagagggtcctgctcaactttatagaggcctcgcagctagtcttattggagttgtcccgtatgctgctaccaattactatgcctacgacactttaaggaaagcataccagaaaatttttaaagaagagaaggtcggcaacattgaaacccttttgattggttcggtagctggtgctttttcaagtagtgcaacttttccacttgaggtggctcgcaagcagatgcaacttggagctctcagtggaaggcaggtttacaagaatgtgtttcatgcccttgcatgcatatttgaacaagaaggcatacatggtttatatagagggctagcacctagttgcatgaagttggtaccagccgctggaatctctttcatgtgttacgaagcattgaagaggatattgctagaaaacgacgaggaggattag

SEQ ID NO: 29514 - DNA, 1122 bp, Glycine max
  Peptide Sequence Number=SeqID_121199
atgtatggtagtgcaaattatgatcttgaaatgttgaaatatttcatactagttaaaagtttaatggtcatatacatgaaaataaacatcaaagaaacctcactctctggcctcgtcactcccaagtcccaacccgaagaagagaagagaaggatggctgtggtttttcagtgtttatggtgtgctcggagtgaccccttcctcactcttcctttccaacgcaaaccacttctttgctctgtctttctttcctctcgccctcgtaacctctgctcttcaattgtcgctgctgcttccaaaaacaaaaacaagcaaaaaaagtctcgtgatcatgttactaaggacgatgaagatggcgtggacgcttttgagctgctcttcaagcaactcgaagaagatctcaaacgcggtgatttgtcagacgatgatggtgaggatgagataagtgaagaagacatggcattgcttgaacgtgagttggaaaatgctttgggggactttgatggtgaattgttaaactcggatgtaatcgacatcgaaactggcggtgatccagaaaatgatgatgatattgaggatggtggagatgaaaggtcactgaaccttaggaattggcagatgaagaaattggctagagccttaaaagctggccgccgcaaaacaagtataaaaaatcttgctgccgatctttgtcttgatagggctcttgttcttcaattgcttcgtgaccctcctccaaatcttttaatgatgagtctatcaatacctgatgaacccacaacgactgtagtatcacttgaaactaagcccagtgagattgttcataaagaaacaagtattgatcatgcagaaatagaatctgaacctaaggctaaagtacctgttcataccttgcaacgtaattggcatgctcaaaagcgactgaaaaaggcccatgttgacactttggagagagtttataggagatcaaaacgacccactaatgcaatgatcagtagtatcgtacatgtaacaaacattcctcgaaaaaaagttgttaagtggtttgaagacaaacgtgctgaggagggagttccagatcgccgtgttccttaccagcgctctgttcctgaaactgcatga

SEQ ID NO: 29515 - DNA, 1275 bp, Glycine max
  Peptide Sequence Number=SeqID_121200
atgcggcatttgctgcacgggaggctcgatgtgatcatacgtgagatcgacacattaccaagtcttaacgagtggaatttcaatctctgctgcaagtttgtcgagacgggtctctatgcaacagttgatttagatgaggcaagggttggaaggactaaactgttaaatgatcaatcctccaatcccacatggaatgagacctttcacatatattgtgcccatttgatctcctatgttatattcactgtcaaacaaaaagatccaattgatgcaactctaattggaagagcttatgtcccagttgagcaagttttgcgtgccctagtggacagatggttccagattttagacgagaatcttagatggttttgtgccatggatctccttgtcaagtggaaaaccttggacccaatgaagcctagaacaagaatcacccttggggaactgcccaagatgaaagctgaggaaggtgttaaggttcttatgcttgtttgggatgacagaacctctgtgctagatttcaagaaaaatggcttgatggcagctcatgatcaagaaactgctgattacttcaaaaacaaaaaggtgaattgtgttttgtgtccacggaacccggatgatgggaaaagcatagtgcaagttgctggtgctgctacgggacaacaaggacaaaagagaacaatattaagttttgtaggtggcattgatctttgtgatgggagatatgatattcaggaacatcctctattttcaactttggatacagtgcataaagatgatttccatcagccaaatttctctggtgcttccatcaagaaagggtctgttgcttgggatgttttgctcaattttcaacaaaggtgggagaagcaggttgggaatcagctcctattctcttcaagcaagcttgatgagtactttgtccctcgatccacggtggcaacaacaaatgaaaatgagacatggaatgttcagttgttcagatccattgatggtggtgctgcttctggcttcccccaagatcccgaagacgcggctgaattaggccttgttagtgggaaagataacatcactgatagaagcattcatgatgcttatataaatgctattcgacgtgccaaaaactttatctacactgaaaaccatttcgtaaggagttcacatggttggcaagcatatgaaattgggattgatattcgaaaaaacccaaaccccactttgattaaagataaaatcaagatagaatatataagtgagagattagttagtttttag

SEQ ID NO: 29516 - DNA, 1863 bp, Glycine max
  Peptide Sequence Number=SeqID_121201
atgccgccgatgaagtgctgggtcacgaggttgtcggggaagcccaacaaacaacaacacgccgtgaagctgacccaattgaagctcgaattaggcctcttcggagccaggctcggcgccgcaaacgacaggatcgcatttgaaattacggggattgccaccaagaaagaaacgacacctctcccactcgttcccttttccaaacgacgatacactcacagtcacaccacatgctcccgcagattcctcagttccaaatcaccctctctcgcatgggaagcacgcgacctatgcggttttcatctcctcctcaaagaccactccctcgatgtttgcgacatcgcatttcatgtcttatatggagagggaaatgcgggagaatcgaaagcgaaaatgacggcggtcggaaaagcggaaatgagcgttgcggtggcagaattggtggtgaggaaggagaagaagacgcagttcacttctcatcatgactttcaaagaaggcttccaatcaaattaaaggtcaatggtttatgcatagaagctacccttttggtctctatgagattattgaagttgagggattctaatggtgactcagcaggaccctttggaaaaaactgggtccagtcagagaagaaacgagggattataaaggaagtgaagtacttggcaagcttgggaaagaaaaacaaaggcaagtttgatgaatcggaacaaacgagtcctcatgactcggatagatcccccgtgtttgactcggatgactcgtacgattccaccacaagcagtggcagcagtagcaacagcggtggaatccccaacgcacggtcaacactctcaaacgggtctgagagctttacaacctcggagacagcaaagactcgtttgtcccacttgccacggaatagaagcctcaatactcaaacctcctatcctgctcctttcacgaaatcagataaactttctccacaattattataccaaaaaggcaattcaagaagctgggaatacaaggacttttcaagtagagatgggcaaacaaagctcaaaaccaatgtgttttttgcttcctttgaccaaatgagtgaacgagcctccggtgagagtgcgtgcacggttttagttgcactcatagcgcactggctccataccaaccacggtatgccaacaagagcacaatttgagagactcatcacacaaggttcatctgaatggagaaggctatgcaacagtgatgactactcaaagctcttcccagataagcatttcgatctagagacagtcatagaagccaatctcagacctcttgttgttctccctcagaaatcttacacgggttttttctcccctgagaagttccagtgcttgaaaggagccatgtcctttgatgaaatttggaacgagataaagagcaaggtgggtgataaggagtcaagagtttacatagtgagttggaacgaccatttctttgtgttgaaggtagaagcggatgcttactacatcattgactctttgggggagagactttatgaggggtgtcaacaagcattcatactcaagtttgatgattcgagtgtgatgtatgggaaaatagacaaagcgaaagaggtcccaattagtggtgcaagccgtgagaaaatttgccgtggaaaagagtgttgtaaagagttcatcaaacggtttcttgctgcaataccactttggcaactagagaaggaggagaaggaggagaagaaatggagtgtttcaagtccctatcttcaccggcaattgcagattgatttccattatagctcttcatcatcctcatctgcttcagctgattctttgtggtctctcttagaaagtggttctttagaagcctaa

SEQ ID NO: 29517 - DNA, 1875 bp, Glycine max
  Peptide Sequence Number=SeqID_121202
atgggatgccacgtgtcacactttcaactgcttgactactcccaccctcagcaaaacccaacaccaacgttatacatggccattctccactgcacgtcactgccatttctttctctgagaaccaccatcagttcctccaagtccacgttaacctcaacgagaattccgttgttcctagcgatgaactcgttcgccaaatcagaacccgtgtcatcctcagcctcttcatcatcatcaacgtaccagcaggtgccggagcaagatgctaataacgacttggaccgcgtagcagacaacacgtttcgcaggtacacgtccaacgttaccaaggggagtggcaaaggaacagccattgtctggttcaggaacgatctcagagttttggataacgaggctctctataaggcatggctttcctccgaaaccgtgttacctgtctattgtgttgatcctcgactctttgccactacttatcatttcggctttccgaaaaccggtgcattgagagcgcaatttctccttgaatgcttggctgacttgaggaagaatttgatgaaaagaggactaaatttgcttgtacaacatgggaagcctgaggaaatccttccttctcttgcaaaatcttttcaagctcatacagtgtatgcacagaaagaaacttgcagtgaggagctgaatgttgaaaggttagtcatgagaggtcttaaacaagttgtgacatcacctgaggagtccagtggtatcacagtttcaaacaacatccctaagctgcaactagtttggggcaccaccatgtaccaccttgatgaccttccttttgatgctactagtttgccagatgtgtatactcaatttctgctgcttatgcttgctaatgggattcaaaacttgcagcttgttgaaaccaaatgtactatacgctcatgcatcaaactaccagcatctcttggaccacctcccacagttcaggattggggatgccttccttcattagagcagctgggacttagctcacagagtgttaacaaagggatgaagtttgtggggggtgaaactgcagcattgagcagagtatatgaatacttttggaagaaggacttgctgagggtatataaagagaccaggaatgggatgttggggcctgattattctaccaaattctcaccatggcttgcctcaggaagtttgtctcctcgtttcatatatgaagaggtgaagagatatgagaatgatagactagcaaatagttctacctactgggttttgttcgagttgatatggagggattactttaggtttttgtcagtgaaatatgggaattcgcttttccatttaggtggtcctaggaaagttcagcgcaactggagccaagacaagaatttgtttgaatcctggagagatggttgtactggattgtgtgttcatttcttgttcgtgatatgggcattgattggcgcatgggagcagaatggtttgagacatgtcttttggattatgatccatgttctaattatggaaactggacttatggatcaggagttgggaatgatcccagagaagatcgttatttcagcatcccaaaacaaagagatcctcaccttcactaacaaatgctataactgtaaaaatagtgtgcactgggtggtattgattcttggagggcatatggcacaaacgtatgaccctgaaggtgagtatgttgcatactggttgccgcagttgcgaaaaatcccaaaggagaaaagaaactttcctggaaatttaatatacattcctcaaattgtgcctctcaagtttggaacaactagtggacacaataaggacaagttctttggtgcaagaagaaccaacgatagaggaagtaaaagaagatag

SEQ ID NO: 29518 - DNA, 183 bp, Glycine max
  Peptide Sequence Number=SeqID_121203
atgaaagaaggcttctccaccccggatgcaacaaatggtgacaaaggggatgatgaaaagaccaatgttgtgcttttagttgtatttggcgttctggagaaccccaacaacaatgaaaaattcgatcctatttcttgcaccaactttgctttttatggccatgatgcaacaaggaaaagttaa

SEQ ID NO: 29519 - DNA, 690 bp, Glycine max
  Peptide Sequence Number=SeqID_121204
atggttcagcccagcccagcccagcccagcccgggccatttaccaatacagtatactagttgtctagcgtaccgtttggctttccctgatgctgttttacagaagacgacagttagccacgttgccgcttctactcttaacgtgcgcccctccaccgtacccaccacggcacagattccgccttgtccgatccgatcggcgaaacccttgtcctcggcgagaattctaggctgtgacgacgacgacgaagaagatgcagagacgaagtcctccgaagcacaggcacgacgggacttcgccgctgcctctcggcatggattggagccctgcgcctcgaaaatgggggatctcaaccatttccatagtttccttcgtgtattgcctagttcggctggcatctatggaggggagtctcagaaagtcccacatacccctgccttaatggagtgtggtgatctctaccatttctgtagtttccttcgtgtattgcctagtccagcaagtatctatggaggggagtgttggaaggggatctctatggttttcatagtttcctttgtgtatcacttagtccagcagccatcaatggagagtagtgtaagaaagtcccacatcgcccatctcaattacttggatgcagtttatacaccttttggacaatttcacttaatgccaattggtttaagatga

SEQ ID NO: 29520 - DNA, 1140 bp, Glycine max
  Peptide Sequence Number=SeqID_121205
gatatttttaccgattataagcagccatttgcagtaacatatcttggagcttctcttatggtagtttacctcccaatagcattcatcaaggactggttctgtaacttacttaaatcccgctcctctaaaagtggtaaaaatgcagaatgcgtggatgagttttctgtcaggattagctctcctctcaaaagcaatggagtgcataaaaactttgaactggaactggggagtgtgaatcggaaagatagtgatttagacctttcaacacttgcagaagtaaagccattagtagctaaatataatgataatactgtgctgaaggtggagagacaacttactgggaaggaagttgctgcttatggattttacattgcacctatctggtttataacagagtatctatcaaacgctgcccttgcacgaacaagtgttgcaagtacaacagtgttatcatcaacttcaggacttttcactcttttcattggtgcatttatgggtcaagactctttaaatgtagcaaaagtagttgctgtcttagtcagcatggcaggggttgtcatgacaacgctggggaaaacttgggctgcagatgaatcacaattaagtgatgctggaaagcactctttagttggagatctttttggaattctctcagctatgtcatacggtctatttacagttcttcttaagaagttttctggtgaagaaggagaaagggttgatgtgcaaaagctgtttgggtatattggattgtttacacttgtagcattgtggtggctcatctggccattgatggccttaggaattgaacccaaatttaccattccccactctgctaaagtggacgaagtggttcttgcaaatggatttattggaagcgtactttcagactacttctgggcactttgtgttgtatggactactcctcttgtggccactttgggtatgtcactcaccattcctctcgctatggtggctgacatggtaattcatggtcggcattattcagcagtatacattcttggctcagttcagcttatgatgagacacaagccaagattaaggaccaagttagggatgaaaatgggggtttccttggatttcatcaatggtgcagagtatatacagcagctttgctga

SEQ ID NO: 29521 - DNA, 3192 bp, Glycine max
  Peptide Sequence Number=SeqID_121206
atggagaagtctattctgaataaagagcttgttttcttaattttacagtttcttgatgaggagggtctcaaggaaactgcacacaagcttgagcgtgaaagtgggatatactttgacatgaagtatttcgaggacatgctacttgctgggaaatgggatgattctgagaggtacctttctggattcacgagggttgatgacaacagacactcaaccaaagtatactttgaaatcaggaaacagaaattccttgaagcattggatatggacgatcgagccaaggctttggatatcctcatcaaggatctgaaagttttttcctcagggcatgaagaactgttcaatgaaatgacccagcttttgataattaacaatataagggagcatgcatcactttcaacatatggagatacaaattctgtaaggaagattgtggcggatgatattaagaaagtcattgaggcaaatcctgtgttccatggaaaattgaaatgccctgtttttaaaagtcagagtttgaattggcagcatctactttgtaaagatccacttccagttcctggtgtaaaaaccctcttggaggaccatgtttgcaaaccaagtttgaacctttcatctctgcaatcagaagaaagtgattcaattgaaaactctgattctgatcaacatttgtcaaaccataattctggtccatctactataactgattctgtaccctttcctgccacactaacaaatccagtaatcatttcaattcttgcttatgacggtgtagtccatggcctttctatagaaactacaatggaggatcctagtgtaatatcactcaaaggaaggcaatgccagacttccaatgaggtgacgtcggccatagcaaatgttcttcctgaaaatgttgttcagatgttgaaagaggattcacttcctgttaccatggactttcatcctatcgggcatacacttcttctagttggaacaaatattggcagtataggactttgggatgttaattctggggagaaattgttctctgaaaactacagaatatggggtatcggagcaagctccatcaatttcaaggaagctcaggaaaaggactttcgtgtttcagttaagaaaatcaagtggagccctgacggttcactgtttggggttgcattttccaaacattttgttcaattatattcctatcatcatggaaatgacatcattagccaacatttacaaattgatgctcatgatggtagtgtcaacgatctagcattttcttctcttaataagcaattgttggtcataacatgtggagatgacaagaaaataaaggtctgggatgctgttagcggtgtcagatgttatacttttgaaggtcacgatgctcctgtttgttctatttgtcctcatgtgaagcaacatgttgattttattttttcaacttcaaccgacggaaagattaaggcatggttatatgattctttgggagccagagtagattttgatgcccctggttatggttacactacattggcttacagtgctgatgataacaggcttttttcttgtggaactgggaaagatggagagccgtatcttgtggaatgggatgaaagtgaaggatatataaaaagaacatacaagggacttaagaaaccatgcttttctgccatccattttgattcaactcagaaaggacttttggctgctggtgatggccacaaggttaaattttggaatatggacagtgttgagctctggacaagcactgatgttgatgctgaattactggaaaatccatgcattcgctttaacaagaagggaacattactggctgttgctgcaaaaggaaacaaaataaaaattttagcaattgatgacattttgcagaaacagaatgaaacacattcaattcatgtccccaataatcaacatgaagccttaaagtgtacacaaagtccaattttggttgatgctggtgctggagtcgcaggtgaaggcattgtcatgaatgggtaccaaaaaggcttggaggatgggaggtataattcaattgaagagtcccataacaactcaaagttttggaatgtctcagaaatttgtgagccatcccagtgccagttcttgcagcttccagttcatcccaaaataaacaagatagttagactgacttacaccaatgcgggaaatggcattttggcattgacatcaaatggtgatcatcttctttggaaatggcctcgtgataaccttaacttggatggcaaggcgactgcacaagtttcccctcacatctggcaatcaaggagtggcttgcaattgatgagcaataaactaacaagttcttacagtggagtcccagtttcctgtttttctttatcaaagaatgattcatatctcatgtcaacatctgggggggcaatctccttgtttaacatgttgacttttaagactgtgacgactatcatgactccaccacctatggcaacttgtctcaccttctaccctcgtgataataatatacttgctgttggtatggataattacagtataattatatacaatgtccgtactaataagattataagcaagcttgagggccactccaaaagagttactgcccttgccttctcaagtagttttgatcttcttgtttctggtgatataaatgctcagatttttgtatggaacaccaatgaatggaaaaaacagaaagatggaagtttgcaaatacatggacagaaggtgccagaagtgctatctgacactcacattcagtttcacctataccagaggcacttccttgctgtaagaagtaattatcttgcaatgtatgaagcaatagagctaaaatgctgtaaccagtgggttccagaagtttcaatggctatctcccaagcaactttctcatttgatggccaggctgtgtatgccagttttgttgatggagctgtggcaatatttgatactttgaaactccaaatgcgttgtaggattaatccctcagcttatctttctacaactccaagttcaagcatctatccacttgccattgctgcacatccacagaagccaagccagtttgctgtggggctcacagatggtagggttattgtgtttgagcctcagaagacaggagaagactggagcaagtttagccttgatgatgaggcaatcaaacagggttgtgggagtgagtga

SEQ ID NO: 29522 - DNA, 1284 bp, Glycine max
  Peptide Sequence Number=SeqID_121207
atgcagtctgtggcatataccgcagttcctttgttcagtattgcagcagtctggtttagttggatctgtattacaaattgcacttttctctgcgttaacaggattggatgtgcagttctctacattggccaaggaagttttcatcatagcatgacaaatacattgcagtatgtggtgcatcaagctgattctactgtggataagcttagaaatgtgtcagattatcttgctcaagctaagcaggttggaatcgatcgagtttttctccccacaaatgttcaaactgatattgatcaggcagaaacagatatcaataactctgctagcatccttgctgataagacaaaggagaactcagacaacatacatgatctcttagattctgcgacgctggctcttatcataatagctgctgttatgctagtcttgacatttcttggatttttattctcaatatttggcatacagctccttgtctatatcttggtaatcgcaggatgggtccttgttactggcacccttgtattatgtggcttgttccttgttctccataatgtgacagcagatagttgtgtagctgtgaatgaatggatccagtatccgactgcacatacggctatggacgatattctgccctgtgtggacaatgccactgcacaagaaacattgtcacgaagcaaagaagtaacttctgaactagtcaatttggtcaaccaggttatcaccaatgtctccaacttaaatttcgcccccaatttcactccactctactacaatcaatctggtcccctcatgccactcctctgcaatcccttccatcctgacatgacagatagacaatgtgatgctggtgaagtcaccctaagcaatgcaacacaggtgtatggcaattttgtgtgccgggtttcaccatctgagatatgcatgacacaggggcgtttgacccctaccttctataaccaaatatctgctggaataaacgtgggcaactccttgtataattacgctccctccctgattgagctacaagattgcaccttcgttcgagaaactctaagcgacatatccaaggaccattgtcctgatttacggcgtcatagtagatggatctatattggattggtaatggtctcttttgctgtcatgttctccttgatcttctggatcgtgtatgggagagagaggagacatcgtctgcatagaaaagagtcaaaggatttgattcctgcacatgcaccagcaccaggacatgcattagcattggtccagatccctgaaggataa

SEQ ID NO: 29523 - DNA, 2292 bp, Glycine max
  Peptide Sequence Number=SeqID_121208
atgcggcatagaatgtctgagttgtctcagttcaacttggtatatgacttgtcagctgtactgattcacaagggaactggtgctaatagtggccattacattgctcacatcaaggatgtaaacactgggcaatggtgggaatttgatgatgagcatgttactaatttgggttttcatccatttggtgaagagtcttcaagttctactactaaatccatcaagactgatgcaattcattctgataattctgaagcaatggtagctgacagtaatggaaatggtttaaatgctactcattcactatcttcacaagtggagacatttttgtctagtgatgcgtacatgttgatgtaccatcttaaacaaacaaaaaatgttggtgaaagtgggggtgtaatttgtggtgctaaccataaagaaagcgagggtgttgtagttgctgtgcaaaatggtgttcctcttccatctcatatttatgatgagattcaaagtttcaatgcctcatatgatgatgcttgtcggcggtacaataataggaaagagttagaattgagtcttattagtgagagaagacaggaagttcgatctgttttagctgaagctcctgttcaaccattggagcagccattttattggatttctagtgaatggcttcgtcaatgggcagacaacattattccaatggtgcttacgttgcaatgtatatgcagtcctcttgacaacacgccggtccaatgctcacatgggaaagtcccagtttcaaaggttacctcaatgaagcggttgtctgctaaagcatgggatacattgttctccaagtatggtggaggaccagcattgtctcatgataaccactgtcgggattgcctgattcatggggctatgacagtggtgtcagctgacacctatcgggatagaagagaatcaatgaagtcacttgcacgggatattctagatggaaactgcctagatggaaagtattacatatccagaccatggttgcagcagtggtggaaaagaaaagtccttgatgctccatctgaagctgatgctggaccaacagcagccattagttgtccacatggtcaattgatgccagagcaagctcctggtgctaagcgggtgcttattcctgagatcttttggctcttcttatatgaagatgctgtttctgtaaagcctgatgatcctttgggtggcccaactttttcttcagattctgatgagtgttcccaatgcagtaatgaattatctgaagtagcatgcttggaggactccttgagattagttaaacaaaaacaacgtcagaatcatgagaaattattccaggctaaaagtttgcaactttctctgcacagcaagtatttcttggtgcctttgtcatggatttcaaaatggagaaattacattagtccaaccctgaagaattcagataaacctgaaaccttagatggggtaattgactcactgttgtgtgaaaagcactcacggctaattgaaagacctcctgaattggttttcagacgtggtgctataatccagagggaatcttctgcaggtggcttaaccattgtatctgagaatgattggaaatgcttctgtgaagaatggggcggtattgagaccaaaggaatatcagcaacaattgatcatgttaatgattcagagaatgtattgactggatccagtgaagagatgcaagtatgcaaggatcagttgagcacagcagataaaatgaattttgaaaatgggactggacaaaatttaattaagacttgtcctgaggtttgtgaaagttgcatcggagaaagggagagctgtgagctaatgcagaagcttaactattgcaatgaggacatatgtgtaattcttgttcgtggtaaggaggtacccagatcaatattggaggcttcaaagggattcgttgaaacagatcggcgagtttcaaaacgttcccgcaagtctaaaaatgggaattcaattagtctaaaagtttctgcttcaacatctttatatcagctgaaaatgatgatatgggaatcctttggggttgtcaaggaaaaccagatactacataaaggtgataggataattgttggcgatgatgaatgtgctaccctcgcagatgtgaacatatttgctggagatcagattatagtgagggactctgagatccatgaaaatcgagatattgctgatgagctttgtgatgataaaatggatctgcagcataccgaggaagggttccggggaacacttctcacagcaaatgtttcatcccaggttgtttaa

SEQ ID NO: 29524 - DNA, 7696 bp, Glycine max
  Peptide Sequence Number=SeqID_121209
atggggggtggaaaatttagtaggtgttttgttgttgttgttgttgttggtgtgttgttcttagtggggtcagtgagtgggattggtgttaattgggggacacagtcaacacaccctttgtcaccgtcgaaggtggtgaagatgctgaaagacaatggcattcagaaggtgaagctttttgatgctgatgctggtatcttggatgctctcaagaagtctgggatacaggtcatggtggggattccgaatgacatgctttatactctggctaacagtgtggaagcagctgaaaaatgggtttccaagaatatctccaaacatgtctcttctggaggagtggacatcaggtacgttgcagtggggaatgaaccattcttgtcaacatacaacggttccttcgaagccacaactcttccagctctccaaaacatccaggcagctctcacaagatctggtttgagcaaccgtgtcaaagtcaccgtccccttaaatgccgacgtataccaaagctcatccgaaaagccatccgacggcggtttcagacccgacatcaacaatgtcatgctgcagattgtcaagttcttgaacgacaacggtgctccgttcacagtgaacatctatcctttcatcagcctctacgcagaccccaatttccccgttgactatgccttctttaacggctaccagcccaccataaacgacaacggaagagcctacgacaatgtgtttgatgccaaccatgacactctagtatgggcactgcagaagaatggctttggaaacttacctataattgtgggggaaattgggtggccaacagatggggacagaaatgcaaaccttcaatatgcacaacgttttaaccaaggtttcatgtcacgttacatgtctggaaaaggtaccccaatgaggcctggtcctatagatgcttatttgtttagtctcatagatgaagatgccaaaagcattcagccaggtaactttgagcgtcattggggcatgttttactttgatggccaacccaaataccaacttaaccttgggtcagcacgaggtaatgggttagtaggtgctagtggcgttgatcatttggctaaaaagtggtgcgttttgaaaccctcagcaaaccttaatgatgaccaacttgcacctagtgtggcctatgcttgtcaaaatgctgattgcactagtcttgggtatggaacttcgtgtggcaatttagatgttcatggtaacatttcttatgcgtttaatagctactatcagataaatgaccagatggatagtgcatgcaaattccccggcctttccatgatcactgacaaggatccttctgttggagattgcaagttcagaatcatgatccagacagattctgcggagccacatggaaaagttggatatctaacaacagtaaactttgtagcaactagcaagtgtaagaaagaaaacgcgaagaaaatcgcagaaaacgggcatttccaggataggtttaaggaggcgggtcgaatatctccggaagcttccgatccatcatcggtgtcgctgatgatggaggatcaagcgaatcaagtgccacctccgcgggatgaagaggaggattctcagaaggaggaagtgattgcgaaggttaacaaactcatggagaagataacttctgcacccgataaccctaacgccaccgtcctccacgcccttgcctctattcttgaagcgcaagagtcacgatacatggaagaaaatggtcattcttcctccatcactgcacgtgctgcgcatatcattggtcgtcttggcggtttaatccgggaaaatgatgagttctttgagttgatatcttcaaagtttctgttagaaacaagatactcgacttccattcaagctgctgctggcagacttttgcttgtaaatggacagtatcctcatgtttttgaagaatctgtcatggaaaacattaaaaattgggtgatggatgataacactgggttgcctgccgaagagcagaatttgaagcataatccagatagaagggacgctgcctcggactctgaaatgttgaaaacctattctactggactccttgctgtgtgtttggtcggtcaaggtccaatagtggaagacgtattgacatctggcttgtcagctaagctaatgcgttatcttcgtataagtgtgctacgagagacaagtggcaaccagaaagatgttactcatattacagagagtaggcatgcatctgcgaatacttcagggagaggtagagacgatggtcgtggtagatttcgccagctcctcgaatcaaatcatttagatgatactaggatgattgacgagagatctttagatgatgtaactcttgaaaggggtccagatagaagcattagtggacaaacttgccaagaaggatcttggatagatggtgaaccacccgatggacttggtggtgaaggtgctgatgtccacgaggtagattctgatggggaggatagatggcactgtagagatatacgtgatggaaggataaaatatggtgagcacgacgacaatattagagatgactcttcaaggcggcgtgcaaaccgtggatggggaagatctagagggaaaggtaggctcagtgaaggggttgtagaaagtgatcccattttgtcatctcctggatctggaagtcgattaggacaggggcgaagtgttagagatagaagcatattgaggaatgctgacattaggagggtgactgattctaagaagacccttggcaggaccaccccttctgaggcatctgcttctgcttcagaaagagaggataatgatgattgtttccaagagtgccgaattggaagtaaagatattaccgatcttgtccggaaagcagtccgagcggctgaagctgaagctagatcagccaatgcacctgaagaagctgtgaaagcagctggtgatgctgccgctgaccttgttaaaactgcagcttctgaggaatataaatccactaatgatgaagaagcagcttttttggctgcttcgagagctgcatcaactgttattgatgctgcatctgcagttgaagtttcaaggagttctatctgcgacagtactgtgacagagaatgtgagtggcaaagaaatggaaactaacgaggatgttgaagagtacttcatcccagatactcaatcacttgcacagttgagggaaaaatattgcattcagtgtctggagttacttggagaatatgtagaagttcttggccctgtgttgcatgagaagggggttgatgtgtgtcttgcacttctgcagcagaattctaaacattgggaggcatccaaggttgctttgctgttgcctgatatcatgaagctaatctgtgctttggccgcacataggaaatttgctgcactatttgtggaccgtgggggaatgcaaaagctgcttgatgtccctagaatgccacaaactttcttcggcctttcttcttgtctatttactattggttctcttcagggaataatggaacgagtttgtgctcttccatcaaaagttgttgagcgtgttgttgagttagccctccaactccttgactgcaatcaagaccaagcccgtaagaatgcagcattgttttttgctgctgcatttgtctttagagcagttcttgatgcctttgattcccttgatggattacaaaaattacttggccttctaaatgatgctgcttcagtaagatcaggagtaaattctggagccttgagtttatctaactcaggatcacttcgaaatgatcgatcatccgctgaagtgctgacatcatctgagaagcagatagcctatcacacttgtgttgctttgcggcaatatttcagggcacatctccttgtattagtggattccattcgtccaaacaaaagcaatcgtagtgctgctagaaatattccaagtgtaagggctgtgtacaagccgcttgatattagtaacgaggcaatggatgcagtattcctacaattacaaaaggatcggaagttaggtcctgcatttgtgagaacacgttggctagcagttgagaagttcttggcatctaatggacatattactatgttggaattatgtcaggccccacctgtggagcgatatctgcatgatttgcttcagtatgcgttgggtgttctgcacattgttacattagtacctagcagtcgtaagatgattgtaaatgtaacattaagcaataatcgcgttggtatcgcggtaattttggatgctgcaaatatagctagtaatcatgtggaccctgagataattcaaccggcattaaatgttttagtcaatcttgtttgccctcctccttcaatcagcaataaaccagctatgtttgcacaaggtcagcaattcgcatcttcccaaacatctatcggtcctccctcagaggctagagatagaaatgctgaacgtaatgtctcagatagagctgttcactctaccagccagattgatcctagggagaggagtggggagcccaatgctgtagatcgaggcagtgctgcaggatttagtacacagcctgttcatagtactccacaaactcctgttgcttctgcatcttcaggattggttggcgaccgaaggatatctttgggtgcaggagcaggttgtgctggccttgctgcacaattggaacaaggatatcgtcaggcaagagaggttgtccgctctaataatggtataaaggttcttctgcatctcctccaaccgcgcatatattcgcctcctgctgctctggactgtcttcgtgctctagcatgtcgggtcctgcttggattagccagagatgatactattgcacacatattgacaaagcttcaggttgggaaaaagctatcggaactgattcgggattcgggcagcctaacacttggaacagagcagggtaggtggcaagctgaactttcccaggctgcaattgagctaattggggactggacatctgtgagtggtccgatagcgggtggcatgatagaacaaaagatcgctagaataggctctgataccatcttgaaagggtttactattgtgactaattctgggcgtgcaagtacattagctgctactgatgcagctactccaactttaaggcgcatagaaagagcagctatagctgctgccactcctatttcttaccattcaagggaactcctgctcctaattcatgagcacctacaggcatctggattggcgcaaactgcttctatgttgcttaaagaggctcagttgactcctttgccttctttggttcctccctcttctcttgcacaacaacccatcacacaggaagtttcttcaacacaaattcagtggccctctggtcgtgctccttctggatttctcacttacagagtaatgtttaatgcaaaggatgaggatgccggcttgaaaagtgattctgtctctgcaaagaaaaaatccctgactttctcatcatcttttcattcaagacttcaactccttgactctcagtcatcagccaggaaattgtcaaatacaggtaaagagtcatcagaaactagtgtggtagagactacatatggatcttcagtgaaacataacattgatactggatctcagtttaagactccaattaccttgccagcgaaacgaaagttatctgatttgaaggatatatcaatgttttcatcgtctggaaaacgattaaacattggggatcaaggacttcgctctcctatttgttcaagtgcaattcgtaaaagcagcctgcagactgatgctgttgggcttttcacaccaacttgtaacctgaaacagagccgttgtacgattgacttggtggatgagaaccagagtatttcaaatctaggtcagatgacaccatcttcccaagtattaaatgaccttcagcccaacaatgctgagcgtgtaacattagattctttggtggttcaatatttgaagcatcagcatcgccaatgtccagctcctattaccactcttcctccactgtctcttctgcacccgcatgtctgtccagaaccaaagcgaagccttgatgccccttctaatgtgacagctcggtttggtacccgtgaatttaaatatatgtatgggggagtgcatgggaatcgcagggatcgccaatttgtttacagtcggtttaagccatggcgtacttgtcgggatgatgctggtgccttgttaacatgcattacatttgtcggggactcttctcatattgctgttggaagccataatggggagctcaaattttttgactccaacaacagcaatgtggtggagagctacacaggtcaccagtctcctttgactcatgttcagtcttttgtttctggtgagacccagctattactttcttcaagctcccaagatgttaggttgtgggatgcaacatcaattttaggtggtcctagccattcatttgaaggatgcaaggctgccaggtttagcaattctgggaatgtttttgcagccttgtcatcagaatctgcacgacgggaaatccgcttgtatgatatccaaacatgtcatttagagtcaaacttttcagatacatttgcagcttctacagggcgaggtcatgtttattcgttaatccattttaacccttctgactcaatgctgctttggaatggtgtcttatgggaccggcgggattctgggcctgtgcatcgctttgatcagtttacagactatggtggtggaggctttcatcctgctggcaacgaggttattataaactctgaagtctgggatctgcgcaagttcagactgttacgcagtgtaccttcactagatcaaacatcaataacattcaatgcacgtggtgatgtaatgtatgcaatcttaaggagaaatcttgaggatgtaatgtcagcagtccacactcgtcgcgtcaagcatcctctttttgcagctttccgcacagtggatgcgataaattattctgacattgcaactatccctgtggatcgctgtgttcttgattttgcagctgaaccaacagattcatttgttgggctgattactatggatgatcaagatgagatgtatgcttctgccagaatctatgaaattggtcgtcggaggccaactgatgatgattctgatcctgatgatgctgaaagtgaggaggaagacgaggacgatgatgacgacgatcctgatgttgatcctctgttaagccctggtcttggtggggatagtgggagtgatgctgatgacatgagcaatgatgatgatgataactttgatggaggacctggcatattggagattgtgacagaaggtgatgaggaggatgatgatagtcaactacttgaatccctaagtagtagtgacgatgaggattttgtgggaggtgttgtttttgcacataccaacatgcaagtcgcaagtgagagtggcgacttcatgcatgagcgacacgtggcaagcgctgggggacgcgccaagctcgttgtgcagcagcctaggaggaaagcagcaggtttgcagcagaaatcgcaaatgccattggcgatttgcgttggtttgaaatcgcaaaggccattggcgatttgtgtgcttcttcgtttaaaagctgggtcatggcattcattccttgctttcgagtttgcttgtgttaaccgagagagtgaaattgcttgtgtcgagggagagctagttgcttgctatt

SEQ ID NO: 29525 - DNA, 774 bp, Glycine max
  Peptide Sequence Number=SeqID_121210
atggcggacgacaccgtcgtggtggagcttctgctacgcctcaagcaaggtaccgtttcacacaaatctcaccaccagcttatacctttctcctggggtgtcaaacagccgcgctcaagatcaaggcttagcgccgccgtctctcgctgcgacgccgccgtttcaaccagatgcagccccaccacgcccctctcttggagcgctggcaccgacagttacgaagactccagccgccaccaccaccaccacgccgccatatctaagtacgaacctcgcgcaactctgtcatctgtcggagaactgtggtatttcggggcggttcaaatggcttggcgtgcgtcacgaaacattctttgccttccgaatgacacctttgcagaattaaaggaagaggagagctcccttctaaaggaaagcatatatctgaaaaaggaaatagcaactgtaaatgcaaattttgaggcacagagagctaaaaatgagagtctgaagagaatgaagcttgatgtgggattaaaatatcatcagaacaatccaagttcaacatctgttgaaccgcagtgtgtgcttgctggtcaaccccatcagagaatagtagtatcttcggaggccctcatacgtcccattcaagatgatactcattcacatgcatcagaatctaggccaaacaagatagaatcaaccaccgggaaaagttttttcttgataccagatctaaatatgatgccgtccgaggatgtttcttgcactgacaatctatgtggaatgagttga

SEQ ID NO: 29526 - DNA, 678 bp, Glycine max
  Peptide Sequence Number=SeqID_121211
atggatcaacatagaagtgaggtattggatccggttcatgatgggaatttgagccattcggctgaaggggttgcaattgcaagagataatataagtggagaagctggtacttcaggagaggtgggtgaggatttgggatctgataaggagccaaaggaggaagttaagggtcaagacaagcgtgatcaagaaaatattagtgataatttacctggggttgatcagggaactagttataattcaaggcatttggctaatcaggaagtgattgaaactgtggttgtaattgagtctgttcagaccgagtatgccaatgaagataataggaaattggaagcaatagttgatgaatcagggttaagcttggtgtccatgaaaacaccaaaaggggtgtctgaaactgataaaaattcatgtgtgattgatataaagtgcagcagccgcaaagagttttatgagagttctgaaggtgaaaggatttgtaggatttgccatctgacttctgggcagtcattgaatgcaacaactgttggcactgttgagagtgctacaagcgaagatttgattcagcttggttgtgcgtgtaaagacgagctaggcattgcacacggtcattgtgctgaggcgtggttcaagcttaaggggaacagttgccttgataatatggaacatttgtaa

SEQ ID NO: 29527 - DNA, 1407 bp, Glycine max
  Peptide Sequence Number=SeqID_121212
atggcagctccaaagccagaggagataagccacccaccaatggatcaacttcaaggcttagagtactgtatagactcaaacccttcctgggtggagacaatagttcttggtttccagcattacattttggccttaggaactgcagtcatgattccttcatttcttgtgcctttgatgggtggaagtgatgatgataaagtgagggtggtgcagacgctgctttttgttgaaggaattaatacacttctgcagacactctttggaacccggttaccaacagtgataggagggtcttatgcatttatggtccccattatatcgattattcatgattcctcattgaaaaggatagaggacccgcatttgagatttcttaacaccatgagagcaattcaaggggcaatgatagtagcatcgagcatacaagttattttgggctttagtcagttatggggcatttgttctaggtttttcagtccacttggaatggttccagtaattgcattagctggttttgggttatttgaccgaggattccctgtggttgggcattgcgttgaaattggaattcccatgttaattctgtttgttgtcttctctcagcacttagagctgttgccaatgactcttgaacatgttgcctacaggataaagattccataccctcttgagtggggtgctcctacatttgatgctggtcatgcctttggaatgatggctgctgttttagtctccttaatagagtcaactggggcatacaaagctgcatcacgactagcaagtgcaacaccacctccagctcatgttctgagccgtggtattggttggcaaggaattggaatcttgctgaatggcctttttggaacactaaccgggcttctaggaagcactcgtgttgggagtcgaagggtcattcaaatttcagctggctttatgatattcttctcaatgttaggaaaatttggagctttatttgcatcaataccattccccatttttgcagctgtatactgtgttctgtttggccttgtggcttctgtggggctatcattcttgcagttcactaacatgaactcaatgaggaacctctttattgttggtgttgcccttttcttaggtttttctgttcctgagtatttcagagagtacacttcaaaggcccttcatggtcctactcatacaagggctggatggttcgatgatttccttaatactatattcttctcatctccaactgttgcattgattgttgctgtgttcttggacaatactcttgattacaaggatagcgccaaagataggggaatgccatggtgggccaggtttagaacatttaatggagatagccgtaatgaagagttctatacacttcctttcaacctcaaccggtttttccctccacggtag

SEQ ID NO: 29528 - DNA, 921 bp, Glycine max
  Peptide Sequence Number=SeqID_121213
atggggaagaacaagggttgtcaatcgcactcagctgcaaagcaaattatggtgaagggtactacctcaggttcaggtaaatctcaaacatttgctacttctggtctggcttgttgcttggatgttgtccaagcaaatcagaatgcttatactgcttcacaggataatcttgtaggcaaggtgctcgtaaaaaaggcagggacaagttctgcaaaaactgatgatgtcgcacaccaagtgtttgataatttgttggaatgcagtgctgaatctgaatcttccccagaggtttcttgcaccttagggaacaatgattcaaccactgatgatgattcatctcactcctgtggctctaagtcatcaccgcaactagacgacaataaggctcccactccttgggtcaatctgttcaaagataacagaaacccttccaaaagttttggaatgaagttctcccctccaccctctgatgatgaagcttggggacataatcttattggctatgtggctggccgcttcccaggaaagaaagttctgttggattgttgccaaaaatggggagtcaagttttcatactcagctcatgaaagtggttggctgatgtataaatttgagtctgaggatgatctgaaccaagtcctctctgtaggcccttacttcatatttcaaagacccctactgctgaaggttatgccaacattctttgactttggcaatgaggagctcaacaagatccatgtctgggttaaactcagaaatcttcctctggagctttggaatcctcaagccttagggaaaatcctgtccaagattggttcacccattcaatttgaccatcttactgcttctaaggggtctatttcttttgctagaactttagttgaggttaatgcttctttggagctcactgatgaagtgtga

SEQ ID NO: 29529 - DNA, 348 bp, Glycine max
  Peptide Sequence Number=SeqID_121214
atggagtgcgacaggggcgtggccgtgactagaaagcattggatccgacaaagaagaaggagccgttgtcccgttagtgacaccaaaactatttataccaataccggagccaacgaaataagagaaaatgaagttgttgtggacatgaatatgcgtgacgaaagtaatgggttgagtggtaataagcctgatgaggatgccatcactccaccttttcctcacagggcaaagttgcgacaacggcaaagccacgatgaagacaaatatgtgacagtgacagagatgaatctgctacagcattcaaagctatgtcattcgtcagagacactattgctgaagacatcatga

SEQ ID NO: 29530 - DNA, 1089 bp, Glycine max
  Peptide Sequence Number=SeqID_121215
atgcacgtcaaatcggcgcagtcatcgttccgggatcggacacaggaattccacagcatcacagagaggttgaagaagtccggatcagggcccaatgggcccagtagtagcagcacttcttccagatcggaggaacagcgatccgcgatcgcgaatcaatcggagttcaatagaagggcctccaaaatcggctacgggattcaccaaacgtctcagaagctcgccaaactcgccaaattagcgaaaaggacttcggtttttgatgaccctactatggaaatccaagagcttacgggggttattaagcaggatatcactgctctgaactctgctgttgtggatcttcagttggtgtgtagctctaggaatgagactggaaatgtttctgccgatacctctagccattcgagcacggtggtcgatgacttgaagacacggttgatgagcaccaccaaagagtttaaggatgttttgaccatgagaactgagaatatgaaagtgcatgagaatagaagacagttgttttcgtcttctgcttctaaggattctgcgaatccttttattcggcaacggccgttggctgcaagggcggctgctagtacttctagtgcccctgctcttccctgggctaatgggtcaccatcttcatctcaggcgtttcccaagattttagtagcatgtgtttgttgttttcttgctatttgttgtgtaatgcagacattgtgttgttggcctagcctggcccaacgaaactctaggactattgaaactttgcctggccaggagtatttggtgggtcaaacaggctggtccaaaatgcatgtagagaagcaggctggcccactcaagacattttcctttgttgggaagcaagtggatggggagagtcaaccattgttgcaacagcaacagcagcagcaggaggtagttccattgcaagatagttacatgcaaagcagagctgaagcacttcagaatgttgagtccactattcatgagcttagcaacattttcaatcagctagcaacacttgtttcccaacaaggagagattgccatcaggcaatataaaacttttcaatacatctaa

SEQ ID NO: 29531 - DNA, 2139 bp, Glycine max
  Peptide Sequence Number=SeqID_121216
atggaggacattctgaaccttcctgtgcaagaccctctttatcccgagttttctgctgctcacataaattgggtcaaattggaaggtggtcgccaaggtggtgatgatattgctctcattccttttgccagagttgatgattttgtcaaaggggaatcttccaaccccgaatgccctgcgagtttccgcatagaatcaagaaggaaaagacctgtaggaagcattgccaaaccaagggttgatggctatcttgaatatacattatactggtgttcttatggtcctgaagactaccgagagagtgactcaggtgtaggggatggcacaagcaccaaacctgcttcagggaaggggagcagaccggggaggcgtcacatgatgagagggtgcctttgccatttcactgttaaaaggctttacacccgacccctccttgcgctaatcatatataaccaaagaaggcatgtagataaatcaggggcaccgtgtcatggattacttgacagggatgcggtagggacaagagctatgtatgctccgcgaatttcggatgagttacgccagaaagtgatgtctatgctttatgttggaatatcgttggacaagataatccagcaccatgcagaggggatgcagaagcaaggtggcccccaaaaccgtgatgattttctcactcgaaatgatgtgcgtaacatggaaaggacagttcgtaattcttcacatgagctacacgaaaatgatgaatgcagtgtaaagatatgggttcagcggcatcagaagcatgttttctattttcaagataactcaggttcagaaccatttgtgttgggtatacagacagattggcagttgcaacaaatgcttcgttatggaaataatagtttcatttcttttcattcaagttttggcttgaagaagcttaagtatccaatatgttctttacttgttttcaattcatctcaaaatgcaattccggttgcctggatcatcacctcatcttctgttggtaaagctattcataaatggattgtattgctatgtgaaagattacgaaccaaggatcctagatggaggcctaatgctattttgttggatgatccatctttggactattctatcataagagaggctttccagtgtcgcatcctattatgtgcctggcatgttcgccgtacttggattaaaaaacttttaaaaaaatgctgcaacattgaagtgcaacgggagatgtttaagcaattgggatggattctatactgtacaaaatgtgggccaaatgctatggatgcagttgaagagcttatgcaaatttttgttgaccagtgtgccttcatggactatttcaagagccattggctagctagtataggtattcttcaagtgatgattcattttgtgttcattgaagaaatacctgctcttgctgttgtagcctcacatcataatatgtggattaatgccataaaatcactctctgtgacaactcctgagccacatgctgcaatagaatcctatcacctaaaattaaaatccatgcttttgaaggagaattatgccaatttctggccaagagttgactggttaatccatgctttaactactgaatttcactcattatactggctagatcaatacagtttagaaactgggtattttgagaatctacgggacaattctttctcctctaatgcttggtatcatgctcttcatattcctgatgttgatgtgatactggatgagcaaaatctccatcttgccaaagtcttatctcagactgacagaagcttggtgtacacagtttcgaatcctggttcagaattttcactttgtgattgttcctggtctaggctggggaacctctgtaaacatgtcatcaaggtggcaactttctgtagaagtcgacaggttgcaagaccatcattgtctgctcaagtttataaacaggctttgctcacccttctccataatcctcctgatgatcccttagttctggaccacacaattctacatgtggcccatttgcaacaagacattaaggccttggaagacttgtccaacaatggattgctccagcctatagctcctgatttaagttctcaaatggctgaaaatcctctgctttttcagcgcatccagtga

SEQ ID NO: 29532 - DNA, 1266 bp, Glycine max
  Peptide Sequence Number=SeqID_121217
atgtacaccaaatcggcgcagtcatcgtttcgggaccggacacacgaattccagagcattgcggagaggttgaagaagacaggatcagcgccaaatggacaaagcagcagctcatccagatcggaggaacagcgatcggcgattgcaaatcaatcagagttcaacagaagagcttccaagatcggcttggggattcaccaaacgtctcagaagctcgccaagctcgccaagttggcgaaaaggacttcggtttttgatgaccctactatggaaatccaagagcttacgggggttattaagcaagatatcactgctctaaactctgcggttgtggatcttcagttactctgcaactctaggaacgagagtgggaacgcttctaccgacacgactagccattcaaccacggtggttgatgacctgaagacaaggttgatgagcaccactaaagagtttaaggatgttctcaccatgcgaactgagaacttgaaagtgcatgagaatagaaggcagctgttttcggccaatggttctaaggactctgcaaatccttttgtccggcaacggccgttggctacaaggtcggctgctaatacttctaatgcccccgctccaccatgggctaccgggtcatcttcatctcagttgtttcctaagccttattacacagccacactagaatcccatactgtgcaattagatcctaatatcccatttgtagccttggcacacacgtgggcaggctatgcagtacccctttggctagtcttcggtgaacactgcaacgccggtgtcgccattcacaccgttcatttgtattttgtagctaagagacacctggaaggctctaaatctctaagaccaattgataagaatgttgagagaatcacaccactaaagcaagctgttgtattgaagcaggtagatggggagagtcaaccattgctgcaacagcagcagcagcagcagcaagaggtagttcccttgcaagacagttacatgcaaagcagagctgaagctcttcagaatgttgagtccaccattcatgagctcagcaacatctttaatcaactagcaactcttgtttcccaacaaggagagattgccatcaggatcgatgaaaatatggatgatacactggcaaatgtagagggggcgcaaggggctttgttgaagtatctgaacagcatatcttctaatagaaatgaaaacgaggacacatatgacgcccttattactggtgataagccttttgtatttcattaa

SEQ ID NO: 29533 - DNA, 4149 bp, Glycine max
  Peptide Sequence Number=SeqID_121218
atggacactttgtttttcgggataaagcttcgtgctcctttggaagttaacaacactatcaaaagggttttccctagaagcaagaggtgcaatgtttctgcaaaacatgttcgttacccatcgaggcatgcttttaggttttgtagccaaaatgtaaacttgttgaggaaaccccatgtttctgcaagtgggtcgaggttgaaatgcttcaaggaaaaggaaccacccttttctctcagtgttagttatttcacctcattgtggaaagagggtgttcttttgatgagggcctctgtgttcactgttgttatctctggtttgtgtcttttggtttggtttggaaggaacaaagccaagggttttgttgaaacaaatattttgccttctgtttgttcagtgatcagtgagtatgttcagcgcgatgtttgctttggcaaggttgtgagaatctcacccttgagtgtaacattggagtcatgttcatttgggccaggtgaagaggaattttcctgtggtgaggctcccactgcgaaggttcgttttcgcccccttgccagtctgtggagggggaagtttgtgtttgatgcagttttgtcacatccgtgtgtcttagtagtgcaaaagaaagactatagctggttagggataccgctgtctcaagggggcattcagaggcgcttgtcaaccaacgaaggacttgatcatcgcactaaagtgaggagggttgcacgagaggaggcggctgctaaacatgttagagacagggatgatgccgctagggaagctgcagagatgggttactttgtttctgagaagaattgtggtccatccaagggtgatgataatttaaaggaaattgcaactcattcagtaggaggaacaaactccaagggttttttctgcatgaagaaggtggagcagcatggtcatcgttgtgtggacacaggtgttgattatgatatgaaacatgctgatttggaggagtcatttagggtgaagttccctgaaaaaggacttaagttttggaaaagagtcataaaagggcatagaaaacacaaatttaagcagaaggctaaaagaagtgacatcagtgcatctggtattgctctcagaaaaagaattcttgaacgtggtgcatttgcagcaaatgcatactttcacagtcaatcacatgggatgtttgagcatcctttgtcatcttctggatgttttcattctagagatcatgataggcaatgggtaaaaagtgattttgacaaaaatgctgtatctgttgccagtggtgatgataatagaaatgatgataaccgtaatggaacacaattcagagatctgggagtctggtctccttcggcaaatgaaaatattaatggtaattcaaaagatttaaattttttcggtgatctgtcttcacagacaagggagagtaaacatgaaaatttacaatctagtgaggatgttgcagaacatgccaatgctaatattagtacagagaaaaaggaggagttgagacttcatgttgcacacaatccaattgatgttagtgcaactaggggccaaagagatttggtttctgtgaagcctaggtctgtgctggcaacatattttcaggtttcgtttgagaccttgattatgaaatttggcttaacctcgttttttagaaacattgaggggttgacatctttcttccttgctggtcccattgaaaagttgaagtctgaaatgagtctgaaagttgaaggtaccgttgctgaaaatgtagatggggtagatgttctgcagtctgaagacctaactaagattcttcctgttacattggattctgttcaatttagaggtgcaactgtgatgctacttacatatggtgacagggaagttagggtgatggagaatgccaatggccatgtgaagtttcataaccactactacaaccgtataaatgtaaaactgggtggaaattgtaagacttggagatcagatgatatatgtgaaggtgatggctggttgtctgtcattgtttttgttgacactgttgagcagaaatggcatgctaatttgaagattgaccatttttttgtcccgctgtttgaaaggatcctagacattccaattacatggtctaaagggatggccagcggtcaggttcacttgtgcatgtcaaagggtgaaacttttccaaatcatcatggacagcttgacgtaacagggttgaacttccaaatattaaatgctccatcgtgtttttctgacatatcaggaagtttatgttttcgtggtcaaagtatatttttacacaatgcatgtggctggtttggcagcattcctctagaagcatcaggagattttggcattcatcctgaggaaggagaatttcatcttatgtgtcaggttcctagtgttgaagtgaatgctttgatgagaactttcaatatgagatctctcttgttcccactagcaggatcgataactgctctatttaattgtcaaggcccactggatactcctatatttgtgggaactggaacggtttcaaggacattctcttctttgcatgttgacactcctacaactgtagcatctgaagcacttgctaaaagtaaggaggctggagcattggcagcatttgatcgtgtaccattttcacatgtatctgccaatttcactttcaacactgatagctgtattgctgatttgtatggaattagagcgagccttgtggatggtggtgaaattcgaggggctgggactgtatggatatgctcagaggctgtgaatgatgagacagcaatagatgcaaacttctctggaagtttggcctttgaaaaaattatgcttcgctatattcccagttatcatcatttggtgccactcaaatttggggttttaagtgaaaacacaaaactttcaggatctcttttaagaccgaggtttgatataaaatggactgcaccgacggcagaagggcctttcagtgatgctagaggagatatcataatctcacatgatttcattactgttaattctgcttcggctgcattagatttgtatatgaaagttcaaacatctttttctgataatttttcttctaaaagagaagagttttatgcaccgagagccagtctattcactgttggtggagttgagtttgatttgcacatgcgtggatttgaattctttagtttggtcacgccttatacattggattttccaagagctttgattttgaaagcaaccggaaggatcaagtttcagggaaaggttttaagacctagtaccactattattgaacataattttgacaagaacaagcagcatgtgcaaatgttggagaaaggaagtgcagctagtcttgttggtgaggtttcaatctctggtctcaaattgaatcaattgatgcttgcacctcagatgtctgggtcattgagtgtttctcctgattgcatcaagttgaatgcctctggtaggcctgatgaaagtcttgtgatggattttgttgggccactacagctcagtggtgaaagtggtctgaaaagtggacaactgatgtccatttcccttcataagggccagttgagggctaatgtagattttcaaccatgtcattcagctagcttggaggtatggcattttccacttgatgagctggaacttgcttctctcaagggaactatacagaggtcctgcctgaatgatgacttggtgaaggcattatttaatggtcatgcagaaatccagcttaatcttcaaaaaagaagaggacatggaatcatatctgtacttcagccaaagttcaatggagtgcttggtgaagccctggatgtggcagctaggtggagtggagatgttatcactattgaaaaaactattttggaacaaagctacagttattatgaaatgcaaggtgaatatgtattacctggcactcgagatgataaccctgttgacataaaaggggatggctttttaaaaaggttcttgtctgggcatcttggtagtgttatatcctcgatgggtaggtggagaatgaaacttgaagttcccagagctgaggttgctgagatgctccctcttgcaaggcttctttctcgaagtatggatcctgctgttctttcaagatcaaaggttgtattatgctttatatgtcattga

SEQ ID NO: 29534 - DNA, 480 bp, Glycine max
  Peptide Sequence Number=SeqID_121219
atgtcagtggcttcttccttcctttcgcttggaggcgcatacctccacagaattgcgtggctgttttggtatggaaacggaataggtttaactaccaaggggtatcggggcgtttggggagctgcgtctctggtgaaatatatcaccaaaggctttccaagaccttcctcatctgcggattgcatgcatatgtgctactcttccccccccccccattgccgactttcagtcgtccttggtctatcatctgttgcaacaagtcttctactgctaaacatgcttccatgttatgtagcacgccaggaatcttcctcgggcccaccgtggggaataacgccccccttttggccaggcactattcggtggagtggctcggggttttcccatggtatacgcaagttgcgtcaaggttataccactttgggaaaggaggttggtagatctttctgggagatatcacagccatctggttggcgatga

SEQ ID NO: 29535 - DNA, 84 bp, Glycine max
  Peptide Sequence Number=SeqID_121220
atgatggtggcccgggtgatgttggggtatggctacgagcccgaaatgggttttggcatgaacaacgatggcagaaccagcctg

SEQ ID NO: 29536 - DNA, 537 bp, Glycine max
  Peptide Sequence Number=SeqID_121221
atgtcagcatcttccggtagagactattttagtcgcacaccgatttctcaagaactacgggcaaacgagcctgttgacatgcagagactaacgtcgtctgctgcaccttttgtcacccagagacagcaagttcgatggcatgcagagatacccaagcggttatccgtacaaacgatttgtgttaaccctgactcgggaagtcaggtggcaggcagggagactaacatcgtcttctgcaccttttgtcatctagagacggcgagtccgatgacatgcggagatacccaagcggttattcagactaacatcgtctactgcaccttttgtcaaccaggggcaaacaagcccgttgacacgcagagactaacgtcgtcttctgcaccttttgtcacccagagacagtgggggtaccttacggttctccgcaccttttgtcaaccagaggcaaacgagcctgttgacacgcagagactaacgtcatcttctgcaccttttgtcaaccagtggcaagcgagcccgttgacacgcagagactaa

SEQ ID NO: 29537 - DNA, 369 bp, Glycine max
  Peptide Sequence Number=SeqID_121222
atgatggcacatcagagggcgtgcagccctctaaaggcaagggtgtgtggccctctgaaggcgaggacgtgcagccctctaaaggcgagtacgtgcgaccctctgaggacgtgcgaccctctgaaggcgaggatgtatgaccctctgaaggcgagggcatgtggccctctaaaggcgagggtgtgcagccctctgaaggcgatgacatgcggccctctgaaggcgagggcgtgcagccctctgaaggcgataagtactagtatcaaagggtcgacccttatgagaaagcaagagattgactcattgatagatcctttcatcccaaactcaaaagactggacatcagatgcaggaaatttgtgcagttaa

SEQ ID NO: 29538 - DNA, 1236 bp, Glycine max
  Peptide Sequence Number=SeqID_121223
gaggttaaggtgcctatgactcgaagcgcggacatccgggtcgccgtctcgacggtgattctgacgctgcggcgcacggacgacggccgcgccgtgctcgcactccccctcgtgcgtcgaactcgcgagccgttcgcgcagcagtgggcgctgcccggcggctggctgaccaccgccgagtcacccgtcgacgcggccgcgcgcaccctcgccgagaccaccggactcgcacccagctacctcgaacagctctacgcattcggcgccgtcgaccgctcgcccaccagggtggtctcgatcgtgtactgggcgctgctgcgacaggatgacgtcaccgcgcagatcgacgcccaccgggcctcgggacacgcaccggaaaacgtgcagtggttagacgtcgaccaacttccgcagctcgcattcgatcacgccaagatcgtcgaatacgcactgtggcgactgcgcaacaaggtcggctacagccgcgtcgcccaggggttcctccccacggagttcacgctcgccgaactccgcgaggcctacgaatcgatcctcggccggagcctcgacccggcgaacttccggcgccaggtcgaagccgccggaaacctcctgccgaccgaccgcttccgcaccggaagccaccgccctgcccggctaaacgagcacccgatgagcatcaccttcgtacccgctcccgccgtcccaccacgtgacgcctccgtcgaccacgcgatccaggcgatcgtctccggcgcatcgaccgacgccacctgcaccacggacctcgcggccggaccgtgggagttcgacgcccggcccggctacggccccggctcctcgatgggggacgtcatccccacggacgcgccgcgtcagggcgagctccccctcgaataccgagaagccgaggaggaggacctgcaccgacgcatccgcgccgccaaggcgacgctcggcgatcgagtcgtcatcctcgggcacttctatcagcgcgaagaggtcgtccagcacgcggactacgtcggcgactccttccagctcgccactgccgccaagggacggacggatgcggaggcgatcgtgttctgcggcgtgcacttcatggccgagaccgccgacttgctctcccggccggaacaggccgtgatcctgcccaacctcgccgccggctgctcgatggcggacatggccgacatcgaccaggtggaggaatgctgggagccgctcggcgag

SEQ ID NO: 29539 - DNA, 396 bp, Glycine max
  Peptide Sequence Number=SeqID_121224
atggggatcgcacccacaaagacacccagtggacctgaagaagtccaacagggccctggggtttccagctctggttacgggcctctggattgtgcccgcaagacacctagtggacccgaagaaggccaacagtgtcttggagttgccagctctaaatacgggtctctatcagttcaagggagtgcctgttgcccccagcagggtcatcaggccccctaccaatcgagttttcatctagaagtgctgcgtctccaggcaggcgcagggcgaaacaccacagcagcctggggatggccggcagcgggcaacagacgcaccgccatcacctctagagttcacctcagctcatccacaaaaaggttagagcgttgcttacgacccatggccgaccaataa

SEQ ID NO: 29540 - DNA, 177 bp, Glycine max
  Peptide Sequence Number=SeqID_121225
atgagcaaccggaagctctcagctatctcatatggcataacgtttcacccagatgtccgattcagatgcccgattcaggcgcataatatatcgagatgttcaaaattaaacatcgaagcacaaggcatagtcaaacagccataccttttgattcggatgtctgattcaggccaataa

SEQ ID NO: 29541 - DNA, 167 bp, Glycine max
  Peptide Sequence Number=SeqID_121226
gaagagatagagggagacgccacttcaaggagatgagtctagaagaagctcaccgccataggaggccatggataagagtttggaggaagaaggagatgaatgaaaggagaggaagagaagagcatgaaattttatgctctaaaagagttctgaaatttgaagtttaa

SEQ ID NO: 29542 - DNA, 522 bp, Glycine max
  Peptide Sequence Number=SeqID_121227
atggatattcaggcgaaatttgaaatccctaaagcttctgacagtaggacaaagaagaaaattcttcagactgtcgacgagcagtggaggcagtttaaatctgacttgaccaggaaatgggcacttacagccgacaaggacggtgtagacaacactgtctgtgaaaaatacggcattagccaggagaaatgggcccagttttgtcagacccgtagagacccctcgtgggaggatgtgtggaaaaaggcacaggccatccagaagcaaaacactgccccccacgtgttgtctcgtgggggttatgaatatttagaacaaaagctcatggctgagaagacaaagaaaagactggaggaagctgcccagtctggaagcactgagggcatcattgaccctccatctcccataagatgccacgtgaagtggaagatggcccgcacaaagaaaactgggcagatgacgtctgaggcagcaatggaaatagctgagaagattgattctttggaggagcaggcatcataa

SEQ ID NO: 29543 - DNA, 375 bp, Glycine max
  Peptide Sequence Number=SeqID_121228
atggtgggttacatgcctttgagctttgcagatttagtgtttgcgggtgagaggattgaagtaggcctaaaaagaggcaaatttgattacactacttcaatgaattctggtgataggaagcccggggcaaatggagggagtaagaaggagggagaaacctatgttgtggttgtcgttcctacatggccaaatttcccattagcccaacaatatcaatactcggccaatatcagtccttctcattacccaccaccctacaaaccaagaactcccaatcatccacaaaggacacccccaaatcggccacaaaatccagccgattcatatccaagaccaaacaccacccctaataccagtcaaaacaccaaccagtga

SEQ ID NO: 29544 - DNA, 714 bp, Glycine max
  Peptide Sequence Number=SeqID_121229
atggtatcttatctaaccaatccggacaccgactctattgtccttggtaatccacttccggaggaagatgtttcctcttctgtattaggtaaatttaaattagaagataagatcttggagggattctttttagcacctaaatgctatagctataccacagaagagtcagatggcaataagaaggtctataagtacaagggaccgggtagaaatgttataactccagaatggtataaagaacagtacgccgacccttcccgaagtctgataaagaaggtaacttatcaatttcgacccgattggaaagaactctcggttaaaaagaaagagagtacaaccactcttagaactctcagtaactccaagagaatacctttctttaatgaaaaaggtaagtatgtaagtacagatccacttgatatcgatgacttgtcatctctaaattacattggaacaaaactattagaaagttttaaaaggaaaacagctattttagaaaaagagaattcggctctttctcagaaattacagaagctggaacaggaaagaggtataatagcccagcggagagtagaagaaggaaataataccgaagataataatacattagagcaaaataatcctaaaagggctgaagatactatcaatggagatctattggatccagatacgatgccgcgggataaaagcccccctgatcatggttgtggataa

SEQ ID NO: 29545 - DNA, 459 bp, Glycine max
  Peptide Sequence Number=SeqID_121230
gctgatatggaggccatgaaggaacatatgacaacaatgatggaagaaatgatgagcatgaggaagatgatggaggataacactgctatagttgttgctgcgagtattgctactaagatggacccgattcacccagctggtttcaatcaagtgaatcgtccagtctcagatgtagtaggtcaaggaggcgagacagtgaaaaatgcatgtgggcctcatcatgttcaagttcagagaaaacattccttcccaccatataggttgcctcctaattatacatcacccattattgtatacgcttctggtgagaattgtggaagcaatgctttccaagattattttgatgatgccaaagactcaagtcaagaatcaagagtcaagaaagtttcaagaatcaaagagtcgttcaatcaaagtttcaagaatcaaagagtcgttcaatcaagattcaagattcat

SEQ ID NO: 29546 - DNA, 936 bp, Glycine max
  Peptide Sequence Number=SeqID_121231
atggggacaaatcaaaccggcaagaggtttaaccaagtcaaggttaaaagcctagataccaccagcatcaaggaattagggcggatgatggaacccctccaaatgcacgccttccacaagacttacggaaagatcttagagttgaccatagcagaggtatccatagaagccattgcatcactcacccaatactacgaccagcctttgagatgcttcacgttcggagacttccaattagtaccaaccattgaagaatttgaggaaattctaggatgtcctctcgggggaagaaaaccatatctttcctccgggtgtctcccctctttgagcagaattgcaactatggtcaaggattcagcaagaggtttggatcgcataaaacagactcggaacggcatagcgggcctaccacggaggtacctagaagacaaggcgaggggtatggccaatcaaggagattgggtcccgtttatggatgtgttagctttgctaatttttggggtcgtcctctttccaaacgtggatggtttggtggacctagcagcaatcgacgctttccttgcataccaccatagcaaggaaagtccggtggtagctgttctggcagatttatttgacacatttgaccgaagtttcgcacttgttccagcaagacacaaggcatccatgtccgctcctcagccacctcgctcgtgtactgaaaagaggagaatagattgggaccagcttttggccgggataggaggtagaacaatcaattggttcccccgatggaaggaaggaaaggaaggagtccttttctcatgtggaggatacccaaacattccgctgataggaacgaggggttgtattaactacaatcccgcgctcgctataagacaactagggtaccccatgaggggagcaccgacggaagaaagcatgtctcctttcctt

SEQ ID NO: 29547 - DNA, 492 bp, Glycine max
  Peptide Sequence Number=SeqID_121232
atgcagtcccagcttcagtcacaaatgcaatcacagggacttgcactgcctccggagcctgaggttggtccctcagctgctcgtgttagcacaaaggggagttgtgttgatccctcatcgaccgatccaaagacgcgtgactcagaaaaatgcgggctgtacatcaaagaaaatccttcccacctggtgaaagttggtgttgaggaggttaaagatgtaaaggctctcattcctgtacccactaatgaggcagctgtgtctccagcaaagcctctagataagccggatcctgaggtcgatgatcccctgtatctgatgacattgaccatcccacaacttttcttgaagcctctccaggttatgtgggattctaccatgttcggggtgtttaatccagacttcccattgtacatcaagcatgaaaatctctcagaaattgcacacggtggtcaatgtctcagcatatctgttatacagttgtggattctgtaa

SEQ ID NO: 29548 - DNA, 429 bp, Glycine max
  Peptide Sequence Number=SeqID_121233
atgggggatttcatcagcagactctccttccctggtagacgcattgttttcactcaaaaagcatatgctgctctaatcggttggaatatttgtctctttgctaaagcatgtgtgcgttttagtggagaaaacaccgagactttttcaagtctcacaagttatccagaactacgtaggtctgagttcctcattggaggatacgtaggagcaaaagcctcgcttttgtcgaccacaccgctttctgttaccatgacccaagagctggtagcccgcggggacaccttacggttatccgcaccttgtcattcagtgaccccaagtgtgattgatgagcagaggccaatgtggtcatctgcgccctttccggagatgtcggcatcttctggtggagactttttcaagtttcacaagttatctagaactacgtag

SEQ ID NO: 29549 - DNA, 687 bp, Glycine max
  Peptide Sequence Number=SeqID_121234
atgcaatctcagggagttgcagtgcctcctgagcctgtggttggtcctggtccctccggtcctcgagtgagcacaaaggggagttgtgttgatccctcaggaaacgatcctgagaccggtgactctgacaggtgcggcttgtacatagaagcagatcctgcacacctggttgccatcaggagagtttatgagggatccactgttgttcataacactcctttgttgcctggccaagtaaaggtgagtatggaggaggttagagatgcagatgctccaattcttgtacccactgatgaggtttccttagtggggcaggcacttcacaccttccttgcttggccgacacatctggtagctgtgtctccgccaaaaccacctccgaagcccaatccggaggtcgatgatccgctttatctgatgacattgaccatcccagagcttttcttgaggccttatcaggttagatgggatgccaccgtgttcggggtcgttaatccagatttccccctgtacataaagcacgaagacctctccgaaatcgcacacggtggtcaatgtctcagcatatcagtgttacagttgtggattttacatctcactgaaacatgtatgcgagcggggaattctgatatctatggattcctcgagcctcaatccattcagaggtctgggaaaatggcagtttga

SEQ ID NO: 29550 - DNA, 330 bp, Glycine max
  Peptide Sequence Number=SeqID_121235
atgacggttgtaacctgtgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggggctggaggttattaatccagaaggaggaactgaagatgctgaagaggaagcaaaaaagggacgatggaaacaagag

SEQ ID NO: 29551 - DNA, 72 bp, Glycine max
  Peptide Sequence Number=SeqID_121236
gaattttgcaaaggtttcaaccgttcttcgacgttcttcattcgttcttcatcgttcttcgatcttcaacgg

SEQ ID NO: 29552 - DNA, 497 bp, Glycine max
  Peptide Sequence Number=SeqID_121237
atggaagaaagcatgtctcctttccttgtgagggatttcggcgcacaaaatttcaaggctatacaaagaatccataaggcatgggaaaccccgttaaggaaagatcaagaacttaggggcattcgtaatggcatcattggtgattggctcgccaagttaaaagtcgtcagcgaagagagtttcgaagcaccggaagaagacgaagaagtccaaactctcaaaaacgagttaggaaaggcgaaacttgccaaggagaagttcaagttggccgttacacacatccgaaaggaatgtgccggattacgggaagagaatgcaactaccgcaagagcccttgagcaagagaccaagagggctcgcaaggaagagtatggccgtaacaaattttgcggagctgtgtggggtagcaacaatgaactcaagctgcggagggaagagagggaccaatcgcgagcacatagcacggttttgaaagaggagttagttgcctgttcaag

SEQ ID NO: 29553 - DNA, 45 bp, Glycine max
  Peptide Sequence Number=SeqID_121238
atggctttggagcggacatggatgcctcgtgtcttgctggaacag

SEQ ID NO: 29554 - DNA, 576 bp, Glycine max
  Peptide Sequence Number=SeqID_121239
atgggaatctgccatgggaaacccattgaaacccaacaaagtcaaagagagaccaacaacccatcagaattcccaagtgaccacccaactcccacaaaaccccccaaagcctcatcaaaattcccattctacagcccaagccctctccccaattggttcaaaaactccccatcctcaaactcgaaccctagcagtgtcagctcaacacccttaaggatcttcaagcgccccttccctccgccctcgccggccaagcacattcgggcgctgctcgcccggcgccacggctccgtcaagcccaacgaagccgccataccggaggggagcgagtgcgaggtcggtcttgacaagagctttgggtttgctaagcagttttcggctcattatgagctcagtgacgaagtcggccgggggcattttgggtacacctgctctgccaagggcaagaagggggcgttcaagggcgtggatgttgccgtcaaagtcattcctaaagccaaggtctcgataataattcttctcattgctatgatcaaatatgttatttttggttgtttgaaatattttgaaatttag

SEQ ID NO: 29555 - DNA, 240 bp, Glycine max
  Peptide Sequence Number=SeqID_121240
atggtttatattgaggattccgttttcgagggtttgtgtaaaccatggcaagatgcgctagtcgtgaagctacttgacaaacacattggctataatatcatgaaggacaaactatctagaatttggaagttaaaggtgggatttgacatgatagatattggcaatgactttttcgtggtcaagctgaatttggatgaggacaggaaaaagatcattgagaatgcattccgtttttcgtaa

SEQ ID NO: 29556 - DNA, 429 bp, Glycine max
  Peptide Sequence Number=SeqID_121241
atggatcccatcacaatacttgtcgtgcaaaaattcatcgcccttaaaggtcacttctcaagggattgccaaactcatcctatcccttgcaaggagactaaggtggtttcacaaccatcacaggcagcagaagttaccagggaggctaccacgaacacagggaagacgcaatattcatcaccattaaatgagaatcccgatatcaattcaaaattccaacctgacgtggataatgatgacccaactcacggagaatggctggtagttaaaaggaagagtcgtaaaaatggtggggcccagaacaaaaaagggaatgctcaattggaggaccaatcattggctaagggaaaggaggacaacataggcacgaaattcacttggctgttgctaggtgcacccaacaaaattgctggtgcacccagcaattga

SEQ ID NO: 29557 - DNA, 237 bp, Glycine max
  Peptide Sequence Number=SeqID_121242
atggcgatctcttccttcaagcggaggaaagtagagcttattagaaggttggggagagttaaccacagctcacggctgatttttcagaatgcacagctcaaccatattctagatgggttgagaccacaatctaagcagctcttggatgctttggctaggggtaagatcaaaatgaaaacccctgacgaagcaatgtacttaattgaaagcatggctactagcgacattgcattctag

SEQ ID NO: 29558 - DNA, 462 bp, Glycine max
  Peptide Sequence Number=SeqID_121243
atgtcgccacacgggggcgacatggatggggttgaaaaaaggaaagagagggatggggtttctcttgcttttggcatagcgggccccggcgggaggcccgcacgacgggctattagctcagtggtagagcgcgcccctgataattgcgtcgttgtgcctggactgaggatagatggggcgattcaggtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctgggggaccaggagattggatctagccataagaagaatagaatgcttggctga

SEQ ID NO: 29559 - DNA, 394 bp, Glycine max
  Peptide Sequence Number=SeqID_121244
gttacgcatacacagagaagatgcactggcgacatcttggggatattcgtgcgaataagccaagtgcagccgaatggcttgatcaattacccaaacaaaaatgagtacaatgcttcgatgaggggaaacgagacgcatttcaagaccgcacaactttttgctaatagaagtcgacaaactcaggcaatgatcaactctgactcacagtattctgaagttgtcttcgatgctaaacacttaccgtgttctcacgtcatggctgcctgtaaatctgtcaatgaatatgaaggagataagtggggtcctgatccaaggagaaagaggactgtaaagggccatcccgtttcaactcgcattcatactgagatagacgaatatgaaaatgatcgaacac

SEQ ID NO: 29560 - DNA, 262 bp, Glycine max
  Peptide Sequence Number=SeqID_121245
atgccttccgaaaccctaccaactgagcatatcatgtgctacatgggcatttatagaacgggcttcatcatacagcgcacgatgatggcggataactcggaactatccatgggacctctaggaggaagtcctggtgcggctggtacgtctgtggtcgttgggccgggcgctctttctgctgagggaaatccggggtatacttccacggaacggccttattactttgatatgcaaatggcgttggcttgggcgccgcccgcgg

SEQ ID NO: 29561 - DNA, 159 bp, Glycine max
  Peptide Sequence Number=SeqID_121246
atgtcattgcctagcgctgttcatgtgtcctccattatcaagcgcgaagcctctgaagaaaaaagaaggagtagagacgagagttgtcatcacggaaaggcagggcggacgaaatcagtgtcctatctttgctttcctcttatcttcgatgagaggtaa

SEQ ID NO: 29562 - DNA, 360 bp, Glycine max
  Peptide Sequence Number=SeqID_121247
atgccaatctccccctgcaaaagtatcagttggtctgtgtcgtcccgacatggggatcgcacccacaagacacccagtggacccggaaaagtccaacagggccctggggtttccagctctggttacgggcctctatcagtcctacagggtgcccgtaccccccggcaaggtcacgtcatcatagggattgcgcctgcaagacacccagtggacccgaagaattctacggagtacctgtcacctccagcaagggcatcaggccccctactaatcgagctttcatcaagaagtactgtgcccccaggcaggcgcagggcgaaacaccacagcagcattgggatggccggtagcgggcaatag

SEQ ID NO: 29563 - DNA, 255 bp, Glycine max
  Peptide Sequence Number=SeqID_121248
atgggcgcagcaatcgctctccatagtgagccagtaataaccagccctaaggatcttcctggccatagcatgcccattggcatgatggtaccactcacaaagaaaccagtagctaatctccttaacgttcttttgtcattgtcggaaatccctggtggatattctttgttctcaacatattatttgatgttgaagtaccacggtctcccatctcgctcctcctctatcgcacaacaatgtgccggcttgccctga

SEQ ID NO: 29564 - DNA, 351 bp, Glycine max
  Peptide Sequence Number=SeqID_121249
atgagccctctgtcccacgcatctaaccagctcgcgtggttcaccggttccaccgaaaactctcatttgttgaagcggagcatagtgcgctttaggcgccgagcgagaaaggtctctttcttctttcgtttcggggcggcggcgttcttgaatgaagtctatccgaaccgaattagcacttctcagatcaggctaggcctctccagcggagctgggcgccggggccctggatgcgctagcgatcggcacatagggggtggttgcccgggtttctcggcctggtatcctgcacctcgcgttcatgatatctacattcaactgtgccccggagacacggtcgaagcacgccca

SEQ ID NO: 29565 - DNA, 174 bp, Glycine max
  Peptide Sequence Number=SeqID_121250
atgttggtgcgcatggtccgcactcttctctttgcagcggcacggatgaaatcttgccccagtatgcataatagttgtgtgatagcctccctctctggttgtgctcgcacagttggccctcctccaatatcagggggtgtggatgtcgagcacactgaaaataaggacacgtag

SEQ ID NO: 29566 - DNA, 258 bp, Glycine max
  Peptide Sequence Number=SeqID_121251
atgtgcaaattctgcaggctcatgggtactaccattggtgagctattgttgaatcggtacatggtgaagggagcagaagctgttcatgcagcaaatccagatgttctagtcattctatctgggctaaattttgacacaagcttgtcattcattcaggatagaccagtgagcctcacgttcaaagggaagctagtatttgaggtgaacaggtatggcttcactgatggtggagcttgggttgatgggaacctaaactaa

SEQ ID NO: 29567 - DNA, 207 bp, Glycine max
  Peptide Sequence Number=SeqID_121252
atgatgctcgaccttagacaaaatgatggtcagatggagaacatacaacttcaaggtagatggagaacaaagagagcaagaaagcttagatggagaagaagacaacgcgaaggagacgaaacatacctaggtatgggggcgaaggagaagaatcagagacttgtgacgatgctcgagtgcgatgaagacgatgctcaagtgcgatga

SEQ ID NO: 29568 - DNA, 189 bp, Glycine max
  Peptide Sequence Number=SeqID_121253
atgcgtaaggagaaaataccgcatcaggcgccattcgccattcaggctgcgcaactgttgggaagggcgatcgggttttcccagtcacgacgttgtaaaacgacggccagtgccaagcttgcatgcctgcaggtcgactctagaggatccccaaggcacgaaggacatgcacaatgtgtgactatatga

SEQ ID NO: 29569 - DNA, 312 bp, Glycine max
  Peptide Sequence Number=SeqID_121254
atgccaaagaggcggaacctcatgatcaaggaagtccacgagggttcatttggaaagcacgccaatgggcatgctatgggccaggaagatcctgagagcaatttattactggctcaccatggaaatgtgattgctgcacccatacgtcataggggccatcgaacccaaggctttgaacggtcatcacttcattctcgtggcaatagattatttcaccaaatgggtcgaagcggtttcctacaccaatgtcacgaggagtgtagtggtcagattcataaagagggagctgatttgtcggtacggactccctag

SEQ ID NO: 29570 - DNA, 647 bp, Glycine max
  Peptide Sequence Number=SeqID_121255
ctgaaaacgaagcgggcaaaactgaagaagtgtgcgcacgtcagatcgacgcggtgctgaaaactcagggcgcagccgcttttgaaggcgtggttatcgcgtacgaaccagtatgggctatcggtaccggtaaatccgctaccccagcgcaggctcaggcggtacacaaattcatccgtgaccacattgctaaagctgacgctaaaatcgctgagcaggtcatcatccagtacggcggttccgttaacgccggcaacgccgcagagctgttcacccagccggacatcgacggcgcgctggttggcggcgcttccctgaaagcagacgctttcgcggtgatcgttaaagctgcagaagcggcgaaaaaagccgccagacatagcaacatccccgctctcgccgggactttacctaatcccatcgccaccacaatcggcgacgcctgcaacggaaagccggtcgcgtcggcaaagctctgcgcaaaagtcgtatacagcgccgggacgccgttggcggtcataataaaattcagcgcgctggtaattccggtcagcgccaggaagctggtgaacggattatctttatccagcggcatcacctgcagcaacgcgttacccaccgcgccgccaatcccggtttgggtcacg

SEQ ID NO: 29571 - DNA, 216 bp, Glycine max
  Peptide Sequence Number=SeqID_121256
atggcaaaaaagcagtctaaagctactctgtcatcatggacctcatttattttgccttactacaagaaaaatgatctatacctacggacaaaaactgtcactataaataaaaaaatctgtagcccaccaaacctgtctccgaaaaatgacgatctcggacttattcaccgctggatcgtcgtgaaatttgagcaccaagttcgcacccaattctga

SEQ ID NO: 29572 - DNA, 451 bp, Glycine max
  Peptide Sequence Number=SeqID_121257
ggggcggagcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatcggttccaccatttgtgtctccaacttgtcatttggaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 29573 - DNA, 258 bp, Glycine max
  Peptide Sequence Number=SeqID_121258
atggaaaaatctgaaaagaaaaatcatagtgagaagaaactaaagaaagcatacatcacatgggatgaaaatgatttggaatcctctgatgattctgaaaatgaagagataaatctttgccttatggcaaaaagttacgaaagtgatgaagagaagaggacatggcatatcaacttgctacttcagaaaaattacagtaatattaaaatgatatgggtcccaaaggatcctcagttatactacatgcaggacccataa

SEQ ID NO: 29574 - DNA, 645 bp, Glycine max
  Peptide Sequence Number=SeqID_121259
atgggctcaaaaatttaccctgaggttcgtgagaaccctagggccttctttagcaactctagcccaatcctcttggagtcttctatccaatacccttcgggatacattcaaagggccaaagaaaaccaggggcaagagaccagaggcccctactactttagtagcaccaaagacagtcgcaccttcttcatccacagctctagcacctcccagtttgactccagctattcttgctccatttccatttcagcttccagctctttcatcttctggaccatcaaagtttttatttacaccagagatgcttcattctatgctccagagcttacacaaggggtggcttggctagaagccctgccttctccttctgaagggggtggggcctccgcagcccaggagcctgagccagaggagcccacagcagcagctgaggagccagtagagggggaggatgagctcactcctcctgagcccttttattatgatacagatgtacacatggctcaggaggaggagacttctacagatcagatgccagagccacctcctgcaccagcctctaaggacaccttgccatcagtactagccatggagccagagcagcccattcttcaggatgtaccaactgctctagtgctggattaa

SEQ ID NO: 29575 - DNA, 521 bp, Glycine max
  Peptide Sequence Number=SeqID_121260
atcatgggttctccacctgcctccactactcctcctcctcctcctccttctcctttgccgtgaagcggacacgcaaagcctcacgcctacgattgttgtccactagaccacctggtgttgaaagaccagtggtgcatgttgatcctgctacagggaaggccgacggtccccataagaagaaattaagaacatatttggggattgtggcacgtgataaggtggacatcacctacgagaactggaaggaggtccctactgctcagaaggacctgatttgggaggatattcagatggaatttgatatcccggaggcttctgacagtaggacgaaaaggaagttactacagaccgtgggggagagatggaggcagtttacatcagacctcacgaggaaatgggcccttgtagccgatcaagacggtgtcgaggacactgtctgtgacaaatacagcatcagcaaggaaaagtgggcccagttttgccagactcgcagagacccttcttgggagatgtgcgcatga

SEQ ID NO: 29576 - DNA, 420 bp, Glycine max
  Peptide Sequence Number=SeqID_121261
atggcccacacgaagaagacagggcagatgacgactgaggccgcaaaggaaatcgctgagaagattgattcatttgaggagcaggccacacagggatcgttcgtcccccatggacgtcaggatgttctcgccgctgctattggacgtccagagcaccctggacgtgtccatgctgctggagccggtgtcaccatcaagcaatactttggatcggctccacggacatcccgcagctcttcctccctgcctcctgatgaattaccacagctgacccagcagattagggaccagctagaggagtccatcacagagaaagtgacgaggcaggtcatggcatccttcagccagcttcagtcgcagatgcaatctcagggacttgcaatgcctcctgagcctctggttggtccctccggtcctcga

SEQ ID NO: 29577 - DNA, 79 bp, Glycine max
  Peptide Sequence Number=SeqID_121262
atggttaacgaaaccgggattgtagttttactgagaccgttctgggtttctgcgggaaagagaaaggtacggtgcgaag

SEQ ID NO: 29578 - DNA, 291 bp, Glycine max
  Peptide Sequence Number=SeqID_121263
atgtattcaactaaaggcaatagaggaagaaaagagctagttcttaatgacggtggagttgatattgaggaggaagaactaacagatttgaggtcaaatcctcttcaaggggaagaggatgatgcaatcctccctaggaagggaccagacactagagccatgagcaagaggctccaagaggattgggctaaagctgttgaagaaggccctagggttcccatgaacctcaaggtggattttgagcccataggccaaggttgggtccaattatctttgtacatattagactag

SEQ ID NO: 29579 - DNA, 357 bp, Glycine max
  Peptide Sequence Number=SeqID_121264
atgcaaaacagcggggtcaccctaagggctaaatctcaacacttcgcaagtgtgcatgatgacaatacctatgtaccttccatcccttactttgggttcattgatgaaatttgggagcttatctatgtcaaatttattgtattttatgtgcaagacccttctgatgaaaggtggtgcgttgttctacacgggaaaacaattggtgttaatgtagaagatgatcattcatacatggacaattatgttagtcctttgtccacacaaatgactcctaacatcatcggagaaaaagaagttgacgacgttcatgctaatcgtaatgatcatgatgaaggagaattaattaacattgtctaa

SEQ ID NO: 29580 - DNA, 507 bp, Glycine max
  Peptide Sequence Number=SeqID_121265
atggtagtttggtcaactggtattggtgctcgccctgaagtagttgaatttatgaagcagcttggccaggttaatagacgtgcactggtcactgatgaatggctaagggtggaaggatctgacaacatctatgctctaggcgattgtgctactataaatcaacgtagagttatggaaaatagtatcaggctattatcagctagtagctaccacattatggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 29581 - DNA, 280 bp, Glycine max
  Peptide Sequence Number=SeqID_121266
gttgcaggttgtaccatctgtggtgaggctcatgaaacaggccaatgtattcccagtgaagaacacactcaagaagttcactatatgggaaatcaacagagacaaggatatactcaaggaggattttcaggcttccagtagggtccttataaccaacaaggacagtggagatcacaccctagcaatcaattcaacaaagaccaaagtggaccttctaacaggccaatccaacaagggccaaatatctttcaaaggactactaagctggaggagactttga

SEQ ID NO: 29582 - DNA, 159 bp, Glycine max
  Peptide Sequence Number=SeqID_121267
atgctccaaccatatgggatcagcataggcttaaaggagcactcaaacccggtgacccccaaggcctacactccgaagagtccgtcatggcctctccctcctgattcagacactgctcataaattatataatactcatgacctcacacttgtgttttaa

SEQ ID NO: 29583 - DNA, 363 bp, Glycine max
  Peptide Sequence Number=SeqID_121268
atggcccgcgcgaagaaaactggccagatgacgtctaagtcagcaaaggaaattgctgagaagattgactcattggaggagcaggcatcacagggttcctttgtcctccatggatgtcaggatgtcctgactactgccattgggcgaccagaacatccaagttgtgtgcgtgctgctagagccggtgtgactatcaatgctttgaaaggacttgatgatactccacaacctaaatccaagactggtgttaggtggattgttgttaaatgtaatagaaaaaaaggaagcactgagtgtggctattacgtgatgcattggatgaccactataatcttaggaactttcaggaataattgggaaacg

SEQ ID NO: 29584 - DNA, 393 bp, Glycine max
  Peptide Sequence Number=SeqID_121269
atgctagactatgctatcagggctggaagacccttcgccaaagggcgttgctacttttacttttgtgtgactactgatagtgatgacctacttcactcccgctaccgaagactgctgagactaatgggtcgaagcaagggcggtgaggcatggccagagaggtggcgaagttctgccccttccaccaccggatcaagggactacttgcccgaggagtctagcttaacccagcccaactactcctcagtgccttcgaaagctctatctaagcagctttttcaatatagccagtgtgccgtgcatgtgtatcagccacagaagagacttccggagaaaggtctttgctctaaccccggggaagacctttctcccagtgaagctgttgagcaatag

SEQ ID NO: 29585 - DNA, 779 bp, Glycine max
  Peptide Sequence Number=SeqID_121270
atattgctattgtgaaggaattttatgtgaacctctatgaccccaaggataaatcacctaagcagaccccagtcattttggcatatattaagaagaacggttggaatcttgatgatccaatagtgacatttatagggccaaggaaggccaggggtaagagatcagaggtccccactacttcagtagcaccagagacactagctccttcttcttccacagctctagtacctcccattcagactccagttattcctcctacatctactcagataccacttccagctctttcatatgcaggaccattaaactttatatttacacctcagatgcttcattccatgctccagagcttacacagggggcaatccattatcatgcagagcctccagggcttgggcttgccatccatcatgagcatggatgagtttgatgtgcaggtggcctggccaggagctcagccttctccttttggaggggatggggcctccacagcccaggagtctattcctgaggagccagcaacagtagcagcagaaggggaggatgagctcacccctcctgagcccttttattttgatccaggtgaacatatggctcaggaggaggagacttccacagaccagatcccggagccatcctcagtacccatacctgatgatgctataccatctgcacaagcatatgagctagagcagcctatccctcaggattcaccaactgctcaggtgttagatcttaatgagcatacaaaggagcaaccacaggagcaggacatttaa

SEQ ID NO: 29586 - DNA, 123 bp, Glycine max
  Peptide Sequence Number=SeqID_121271
atggcctttgtggataactgggcggtgggtaaggagaaggtgccacttgagctgccaggtctctccacctttgggcgtattcttttgaaggattcgtgccccctttttgcacatgttttgtag

SEQ ID NO: 29587 - DNA, 630 bp, Glycine max
  Peptide Sequence Number=SeqID_121272
atgcaactaccgcaagagcccttgaacaagagaccaagagggctcgcaaggaagagtatggccgtaacaaatttcacggagctctgtggggtagcaacagtgaactcaagctgcgaagggaagagaagggaccagtcgcgagcacatagcatggtcttgaaagaggagttagttgcctgttcaaggtccaaaaggagcttgtctcagcgtttatgcgagacggagaccaacatgctagctatcatcgccaagtaccaagaagagttaggtctagccacgacccacgagcataggatcgcggacgagtatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaggcaatggcggacacctactccgcccccgaagaaattcatgggcttctcgactattggaaaaacaccataactaaacgcgccacaaggcatccctatcgcaccagatccaaatctagaacgatgggtgatcaagaggagacacaggaacagatgaaagccgacatgtcggcggggatcctctag

SEQ ID NO: 29588 - DNA, 48 bp, Glycine max
  Peptide Sequence Number=SeqID_121273
ggtgaatgctgtgaaattttcccagacgcccaaaatggactcggatga

SEQ ID NO: 29589 - DNA, 261 bp, Glycine max
  Peptide Sequence Number=SeqID_121274
atgagcgcatgtgcaatttttggtaccccgaaatgctttgagtatgcatgtatgaaatggccccgaggaagcttgcctcaaagaggtccaggaaggacaaggcagccgaaggaactagttccgctccggagtatgatagtcaccgctttaggagtgctgtacaccagcagcgcttcgaggccatcaagggatggtcgtttctccgggagtgacgcgtccagctcagggacgacgagtatactaatttccaggaggaaatag

SEQ ID NO: 29590 - DNA, 429 bp, Glycine max
  Peptide Sequence Number=SeqID_121275
atgtctcctttccttgtgagggatttcggcgcacaaaattccaagtctatacaaagaatccataaggcatgggaaaccccgttaaggaaagatcaagaacttagaggcattcgtaatggcatcattggtgggtaccacgaatggttgaaagttcatatacgaggtttagattggctccccaagttaaaagtcgtcagcgaagagagttttgaagcaccggaagaggacgaagaagtccaagctctcaaaagcgagttaggaaaggcgaaaccttgccaaggagaagttcaattcggtccatgtacacactggttgaggaatcgggagtgtccgggttcggggaagagaatgatttcctccgcaagagccctctttgaacaagaattgaccaatgagggctgcaaggatcagagttatggaccggaataa

SEQ ID NO: 29591 - DNA, 654 bp, Glycine max
  Peptide Sequence Number=SeqID_121276
atggccagaggaggaaccggtccgatgggttcgatgaggaggccatcggctagctgctatgtataccggggcaagattttgcccggactactgccgggagacggcaacatcctgcccaccgatcataattccgacctccccctgccgaagtgtcagctggtgtacgccatcctgacgcggatgagcatccatgtggctcagttaatcgctgatgccatctatatttttgcaggtatggcgcctaccaggcaccctctggacccagataagtccagcagggccctgggatttcccgccttgatcacaggactctgccagtcgttcggcgtccccgtcacacctagcaaggtgattcagccgcccatcacccgagcttttattgagaagtactgcacgcagagacaggtccagggtgatgcaccacaagccgcggacgagccgccacctcatcaggctggtccggccggatcatttaacacggagcagtatttgcggcatttggttcgccagcaggcggccaaccaccgggcgcatgtacagactcatgattgtctttatcagatgagtctcagcctgcagagccagggcttacttctttctcatgcctactccgaccagttcagggcagagtcgcatggcctgagattggcctga

SEQ ID NO: 29592 - DNA, 327 bp, Glycine max
  Peptide Sequence Number=SeqID_121277
atggtaggtcagggaggcgaagcattgggaagtatgggcggcccccatttcgtgcaagtccagagcaagcatttcttcccaccatgtggcttgactcccaactatacatcacccaatgttgcacacgctcccgatgagaatattgataactccgctcccatacccattgagagccaaaaaccccaatctggtcatgcacaggtccctcaacctatgggggagacacatgaagtaactcgagaccgcactctagccgacttcaagactcacctcgaatatgccactgaggggcaggcattttgtggcatacccctatcaaacacttag

SEQ ID NO: 29593 - DNA, 1428 bp, Glycine max
  Peptide Sequence Number=SeqID_121278
atgagacttttgtccacaaaagcaacgtgcaatagtcacggccaagattcttcatactttctaggatggcaggaatacgagaaaaacccttatgatgaggtccataatcccaaagggattatccaaatgggtctcgcagagaatcagctctcattcgacctcctagagtcatggctcgcaaagaaccctgacgtggcagggttcaaacgtgacggcaaatccatattcagagaactcgctctcttccaagactaccatggcctcccttcattcaaaaaggcattggtggatttcatggccgaaatcagaggaaacaaagtcactttcgaccccaaccacatcgttctcaccgccggcgccacctccgcaaacgaaaccttaatgttctgtctcgccgaacaaggcgaagcattcctcctccccactccttattacccaggattcgacagagacctaaagtggagaaccggggttgagattgttccaatccaatgcaacagttccaacaacttccaaatcacggaggcagcattgcaacaagcctacgaggatgcgatgaagctcaacctaagagtgaagggcgttttggtcacgaacccgtcaaacccattaggcaccacaatgtctcggagtgaactgaaccttctggtcgacttcatcaaagagaaaaacgacattcatttgataagcgacgagatatactccggcaccgtttttagctccccaggcttcgtcagcgtcattgaaattctcaaggaacgaaacgacgtcactgacggagactggaatagagttcacgtcgtctatagtctctcaaaagacttgggtttgccggggttccgcgtcggcgctatttactccgaaaatgacaccgtggttgccgcggcgacgaagatgtcgagctttggtcttgtttcttcgcaaacgcagtacctcctctctgccatgctgggggacaagaagttcaccagaaactacatagctgaaaacaaaaagaggcttaaacgacaacagaaaatgctcgtttcggggttattaaagaccggtattccttgcctcgacagcaatgcggggctgttttgttgggtagacatgagacaacttttgtattcgaacacgttcgaggcggagatggagctgtggaagaagatagtgtaccaagttgggctgaacatttcgcctggctcctcgtgccattgcaccgagccagggtggttccgcgtgtgtttcgcgaacatgtccgaggagactctggccttggccatgaaacgcttgaagaacttcgtggcggctgagtctcagaggaatagtggtagtaatggtggtgctctgttcaacaacaatggaagctccaagagaaagtcactcaccaagtgggtttttcggttatcgtctcgcgatcatcgtcgtgaacaagaagaacggtag

SEQ ID NO: 29594 - DNA, 249 bp, Glycine max
  Peptide Sequence Number=SeqID_121279
atggaggagcccctaggcattccattgagcattgattttcaagtgcaagccattggtcagtttgctcgagcgacctgtgctcctgagtttggacttccaagactgttcaatcagagattactcgtcttgcacattggtggggttgccgtaaaacaacgagtaaagttcaaaacaaattccaaaacaaataagtttcaaaaagaaaaaaaggagcatttgattgactgtgttttcaagacgttcatgtga

SEQ ID NO: 29595 - DNA, 324 bp, Glycine max
  Peptide Sequence Number=SeqID_121280
atgcaccacaggccgcggacgcgccgccacctcatcaggctggtcaagccggatcatttgacacggagcggtatttgcggcatttggttcgccagcaggcggccaaccaccgggcacatagcccagggctttacttcttttccgtgccctactccagaccagttcagggcagaggtcgcatggcctagagattggcctaaggcccaggcaggagaggcaccagcaggggcaccagtagaggctcccgacgaggcagatgaggcccgcgaggataaagagatgaccgatttacttggtttcttaggagggagcgggaccacatga

SEQ ID NO: 29596 - DNA, 511 bp, Glycine max
  Peptide Sequence Number=SeqID_121281
ggtcggaacaggagagcgcacgagggagcttccagggggaaacgctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgcgaaacagctatgaccatgattacgaattcgagctcggtacccgtggcatccttggaggcagaggtcgccaaatgaagggctactgctcgcacagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 29597 - DNA, 291 bp, Glycine max
  Peptide Sequence Number=SeqID_121282
atggttgtatcaaaggacttccacaacctttgtgtgttgccctcgccgaaaagagtgattctttccatcctttcatctttcaacccgttgtttgtcaaaccacatgcagaaaagaaaggttcctcctggaacaaaggaaatcaaagcttcaaccaaggggagatgggaccatttcaagtgcttgaaagaatcaatgacaatgcttacaaagttgagctgcccggtgagtataatatggagatccgatttgtggacaaatccttctcagagggagagatgatgaggacatga

SEQ ID NO: 29598 - DNA, 510 bp, Glycine max
  Peptide Sequence Number=SeqID_121283
atgaaggttacaaccctcaagcaaaccagccatgacatgattgctcatgtgggtaaggctcgggctgccgtggaagagctgagaaagttccttgtggctgattcattggaagaagtgaacagaaaactggacaagttctacatggtcctcatcttgagaagcttacactcagactttgatcatatgcgtgatcaagtactcgctggggatcaggttccatcaatggatttcctcatcactaggtttctccgcgtgcctcatgtatcgaaggatgaaaatcctgctgagggtgtggagacgtcagccatggttgcatctcatggtagagaaggcggccgcaacagtagaggaggccgtagtggaaggggtgaatgtcttcattgcacttactgcaagaggatgggtcacacccaagagaattgctattcgttgcatgggtttcctgacaaggtcgcacaggtttctagatcagagaaagcagagtctaagttctctgatgaagagtattaa

SEQ ID NO: 29599 - DNA, 225 bp, Glycine max
  Peptide Sequence Number=SeqID_121284
atgccccataaatctataccccagacatcaaacaccccattaattcaaggtaggctcatttggctagaggcttataagaaaaaaatgcctaaatcatctcccaacatgcatatgaagcaagaagtatcaataagagtcaagccaaggctattgtgcaagcaatcaatgtggcaaaacacaccaaataaaatagatgatgatggctcaaattctcaccaagggtaa

SEQ ID NO: 29600 - DNA, 189 bp, Glycine max
  Peptide Sequence Number=SeqID_121285
atgactaaagcacgtcaaaagggggtacgggaagtaaatgaaatgaaaataaaagcacgaaaatgggggagatgcttgccacccagctcgcccaggcgagcaaggtggcttcctccagaagcaaccaccatctggaggatctttggagggcccaagtgggcttgtgctatttgcaccccattttactaa

SEQ ID NO: 29601 - DNA, 510 bp, Glycine max
  Peptide Sequence Number=SeqID_121286
atggtgagggttaccattattggaaaacccggacaatggaggaaccaccctggaaatcagttcaacagagatcaaggtggaccatccacaaggccatcgcaacaaaggcctagtctctatgatcgcacaacaaagctggaagagactctagctcagttcatgcaggtttccatgtccaatcagaagagcacaaagtctgccataaagaatcttgaggtccaagtgggacagcttgcaaagcaattgacggatagatcatcaagcagttttacagctaatacagagaaaaatcccaaggaggaatgtaaagttgtgatgactagaagtagaatggccatccaaagagatgatagtgaagatggaaagaagatggaggaacataaacaacagttggcacctaagccatcacttgaacatgtttctgattttgtagaacttaaagagattaatgaggagactgaagatgacaaggaagaagaggcaccaataaaagaagaagaaaaaaaataa

SEQ ID NO: 29602 - DNA, 156 bp, Glycine max
  Peptide Sequence Number=SeqID_121287
atgcttactaaggcacctgttctagctcttcctgacttttctaaaacttttgagctagaatgtgatgcctctggagtgggagtaccccctggagctgcagcaagccttcctaataggccagcctataggactaaccctcagagactaaggagatag

SEQ ID NO: 29603 - DNA, 234 bp, Glycine max
  Peptide Sequence Number=SeqID_121288
atggcagcctcctcctccaactcatccaatgctgctgggtcaattactttgctacaaataacattaaaaacaaaacacaaccgtgttatggcaacccgaactttcacaggcaagattccccgaatggctacagatatgttcgcgaaccttgtgatattgggtgcaactgttctcttatacccatttcaaccaagtcctgacgacacttcaaaccatcctttgtttttcctttaa

SEQ ID NO: 29604 - DNA, 500 bp, Glycine max
  Peptide Sequence Number=SeqID_121289
atggcatcgttcagccagatgcagtcccagatgcaatctcagggacttgcactgcctcccgagcctctagttggtccctcaggtcctcgagtaagcacaaaggggagttgtgttgatccctcaggaaacgatcctgagacgggtgactcagacatgtgcagcttgtacatcgaagtagatcctgcccgcctggttgccctggggagagtttatgagggatccactgttgttcatcacactcctttgttgtctggcaaagtaaaggtgggtgtggaggaggttatagatgcagatgctccagttcctgtactcagtgatgagtttgagtctgaaagttacataaagacttggatgcagagttcaaaacgcgatgtgtatcttggagcctacctaaatgggccagacaactaccttaaggggattattaacagtgctttaaaacgtgttgatgatgctccaaagcctaaatcaaaggctcctgctagatggattgtcgtcaa

SEQ ID NO: 29605 - DNA, 129 bp, Glycine max
  Peptide Sequence Number=SeqID_121290
atggtcatttgtccagagatcaaaccgccaatgttcatgtccatcctggtgattaagccatacaccaacctagctctgtctgtgttcaaatctgaagtgcggcaggaattaatgaaacattgggcttaa

SEQ ID NO: 29606 - DNA, 207 bp, Glycine max
  Peptide Sequence Number=SeqID_121291
atgggaaatcaacaacgacagggtatactcaaggaggattttcaggcttccagcagggtccctataattaacaaggacagtggagacacaccttggcaatcggttcaacaaagacagagtgggccttcaaacagaccaatccaacaaggacctaacatattccagagaactactaagctggaggagaccttgactcagtttatgcag

SEQ ID NO: 29607 - DNA, 411 bp, Glycine max
  Peptide Sequence Number=SeqID_121292
atgaaggaaaacaacaaaggatggagtcgcccaactgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagaggggatcaagacagaacccatgtgcgatgcatatgcgaaaggcacaacacgggaatgtacacagtacgacaatattcacaaacaaatataagcaaaagggtacatgacacttatgcatggcagtgtgaaaaatggcacgtaacgtgtttgctccgtgcccctattttagggacctacaagggagggagctaa

SEQ ID NO: 29608 - DNA, 556 bp, Glycine max
  Peptide Sequence Number=SeqID_121293
gtatatcatgaattcaattattacagtgttgtatttcaatggaagagtatatgaagacaatgatggtgtaatatttgaatgcagtaaaaaggcgattcagattaaatgcggaattagtttcaatgctttgaaaaaaaatttggagataagatttttagtttctcgaaaatatgttgccttacaaatttgtgatgacgaagatgtggaaactatgatcgaaagttttcaacaacaacaaatgtcagttctagaattatacgtagaaaatgatgttgctggtggttccatgtttcattctgtaaattctgttacgtcatgtagacataatctatctcatcatgagtcagaattgctaagaaatataagaaatttacatgatgatgaagatgatgatgatgattatcttgcgtctaactcatacgttgaagagtctttggatgaagatgatagcgttgaaggaatatctgatacagacgatgaagtcaccgacattattgaactagtttcaattgttcacccaacaaaaggtgtaccaggaattcaaaatccattttag

SEQ ID NO: 29609 - DNA, 376 bp, Glycine max
  Peptide Sequence Number=SeqID_121294
ggtacatcctttgtggtacaagtagagggtacatctacttgggttgttgtaactgaaaacaagagagggtacatctcttgtggatcagttcaagtggagggtttttacaaggttgaaaagaaatctcaaggaccgcaggttgcttggggactggatgtaggcgcggaactaaagctgatggttgagaaaacaaagaaaaaactagaggaagctgctcagtccggaagcactgagggtgtcattaaccctccatctcccacaagacgacatgtgaagtggaagatggcctgcaccaagaaaactaggcagatgacgtctgaggccgcaaaggatattgttgagaagtttgattctttggaggagcaggcatcacagg

SEQ ID NO: 29610 - DNA, 789 bp, Glycine max
  Peptide Sequence Number=SeqID_121295
atggcatatcatgctagctctaaagctaatcaaaattcaatgcaaaatcatgagattcattttggcaagagctattctttagaagattatcaaagggaaccagagttacaaacctactatcaaaaggaggtagaaagaggtttcaatctggacaatttgttgatgcagttcaaggatacaattaaatcaattcaacgagcatttaaaagtacagaaattcaggttagtaagctggtagaagaagtgactcaagctgtgggcagaagagaagaagaatttgtagaggttgaagctcaagaggaaagccctgtaaatgagcatgatttaaaagaagaagatgaggagaaagtgcaacaacgggagcaatgctcacaagtacacactcaacaagaaaataatctccaagttaagacatttcctcatcaactgattgtcaaagaagaaaggcatgaagaccatgaggttctaataattctgggacaaccctgtctgtcaactgctagttgtgtattagacatgggtaaaggtaaattggaactaagtgtagaggatcagaagatctcctttaacttatttgaagcaatgaaacacccagatgatagtgaggcctgttttgaagaagaaacgttggagcatgagatagaattaacagcctcaaccatggtattgcagtctcctttggaggaagaattcaacaatttgacaaaatgcttagtcagtgaaaatgaaggagaagagctagcttgtattgaagagatggatggtccagaagataagtctgctggtcat

SEQ ID NO: 29611 - DNA, 882 bp, Glycine max
  Peptide Sequence Number=SeqID_121296
gtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttgttaacagcgcggttgggcaccccgtaacccagcttccggttcatcccgcatcgccagttctgcttaccaaaaatggcccacttggagctctcgattccatggcgcggctcaacagagcagccgcaccgtcctacctatttaaagtttga

SEQ ID NO: 29612 - DNA, 257 bp, Glycine max
  Peptide Sequence Number=SeqID_121297
atgggcagttcagatagaatcgaactttcgattgattcgggtacttggaatcctatggatgaagacatggtttctctggatcctattgaatttcattccgaagaggaaccttataaagatcgtattgattcttatcaaagaaaaacgggattaactgaggctgttcaaacagtttatggggggcagtatggatccgcagtagtgagaaaatcacccgtttgtagaataatgctactatcaactttacttctattctg

SEQ ID NO: 29613 - DNA, 1822 bp, Glycine max
  Peptide Sequence Number=SeqID_121298
gcctttggctggtcgcgcaccgagccccgacgccgcgctgctggcggcggtgcagacggcggattatcagccgatggtggtgtttcccggtgcctatgccgatgccgatcgccaggtgctgaccacgccacccaccggcggcaagcccccgctgtttattatgctcgacggcacctggaccgaagcgcgcaaaatgttccgcaaaagtccgtggctggatagctttccggtgatgtcactgaatgtggcgacgccgtcgcgctacacgctgcgcgaagcccatgcgccggtccagcactgcaccgccgaagtggccgccgcgctactggaacaggcaggtgacgtcccggcggcgcaggcgttgctgcagcactttgaacgcttccgtcaggcctatctggccgctggctcgcagcctgacatcgacaaatcggcaaccggcgtaaaagcgtttacaatcatgccaatcccgagagcaggagcgaatgatgagccaacgtggactggaagcgctgttacgaccgaaatcaattgcggtgctgggtgcgtcggtaaaaccgggccgcgctggctatctgatgatgcgcaatctgctggcgggcggctttggcggtccggtgttgccggtcacgcccaaatacaaggcggtcagcggcgtgctggcctggccggacgtggccagcctgcctttcgcccccgacctggcgattatatgcacccacgccagacgcaacctggaactgttacagcagctgggagaaaaaggctcctgtgccagccagtggcagatgcgcctgctgggccccaacagtctgggcctgttagccccctggcaggggctgaatgccagcttctcaccggtaccgattgcgaaaggacgcatcgcctttatttcgcaatcggcggcggcgacagcctggatattgatgtcgacgacctgctggattttcttgcacgcgatggcaaaaccagcgccattttgctctacctggaacacctgagcgatgcccggcgcttcgtttctgcctcgcgtagcgcagcgcgtaataaaccgattctggtgataaaaagcggtcgcagccatcaggcacaggcgatgatcggcaccgccagcggactggatgccgcctgggatgccgccattcagcgcgccggtctgctgcgcgtgcaggacacgcatgagctgttttccgccgtggagtcgctcagccacatgcgcccgctgcgcggtgagcgcctgatgattatcagcaacggcgccgccccggcagcgctggcgctggatgaactctatgcgcgtaacggcaagctggcgacgctggatgagcccacgctgcaggcgctggcggccctgctgccggagggcatcgggcgcggtaatccgctggatttgaaagatcatgcgacgcccgcgctgtatgtagcctgcgtaacacagctgctcgacagccatgaactggatgcgctgatgattattcattcacccagcgccgtctctccggccagtgaaaccgccgcgcagattattgcggcggtggccgcgcatccgcggggtaagcaggtgacgctgctgaccaactggtgcggcgaacactcttcgcaggaagcccgccgcgcattcacccaggccggcattccgacctggcgcacgccagaaggcacggtgacggcattcatgcatcaggttgagtatcggcgtaaccagaaacagctacgcgaaacgccagcgctgccgctgggcctgacgcaaaacagcgccgaggcacatcagttgctgcagcaggcactggatagcggcattaccacgctggatacgcacgag

SEQ ID NO: 29614 - DNA, 1011 bp, Glycine max
  Peptide Sequence Number=SeqID_121299
atggcaaacgtggagaacgacatgagtgcgacagcggaagctcaaagcccgcaacagcccgcgaacaaaaagaagaagcgcaaaggtgcgctgatcctgctggctatcgtgtttatcgtgattggtgtgggttatctggcttactggtatctggtgctgcgccacttccaggaaaccgatgacgcctacgtggcaggcaaccaggtgcaggtgatggcccaggtttccggcagcgtgaataaagtgtggttcgaggatacggatcgggtgaaaaaaggcgacattctggtgtcgctggataaaaccgatgcgcagcaggcattcgagaaagcgcagaccgcgctggccaccagcgtgcgccagacgcaccagctgatgatcaacggcaaacagccgaatcctgacctgaaacgtcgtgagccgctcggtgccgccaatctgattggtcgcgaagagctgcagcacgcgcgtgatgccgtggccacggcgaaagcccagctggacgtggcgattcagcagtacaacgcgaaccaggcgatgatcctgaataccgacctcgaaaaccagccggcggtaaaacagagcgccgctgagctgcgcgatgcctggctggcgctgcagcgcaccgacatccgcagtccgatggacggctatgtctcgcgtcgcagcgtgcaggtcggttcacagatctccaccagcacaccgctgctggcggtggtgccggccaccaacctgtgggttgacgccaactttaaagagacgcagctggcaggcgtgcgcatcggtcagcccgccacggtcaattcagtgatatctacggcgatgatgtggagtatcacggcaaagtggttggtctggatatgggcaccggtagcgctttctcgctgctgccagcgcagaacgccaccggtaactggatcaaagtggtacagcgcctgccggtgcgtatcgaactcgatccgcagcaagtggcgcaacatccgctgcgtatcggcctctccacgctggtga

SEQ ID NO: 29615 - DNA, 1002 bp, Glycine max
  Peptide Sequence Number=SeqID_121300
atgactatgcgcaagacagctctattcgccgccgtcctgaccacggttgccgcgacgcacgtgtccgccgccgaccttccgggcaaaggcattaccgttaaaccggctcagagtaccatttccgaagagaccttccagacgctgctggtgagccgcgcgctggagaaactcggctacaccgttgagaagccgagtgaagtggattacaacgtggcttacaccaccattgccggcggtgatgccacgtttatcgccaccaactggcaaccgctgcatgacgacatgtacaaagccgccggcggtgataataaattttatcgccagggcacctacgtcagcggtgccgcgcagggttacctgatcgacaagaaaaccgccgatcagtaccacatcaccaacatcgagcagctgaaggatccgaagctggccaaactgtttgataccaatggcgatggcaaagcagacctgaccggctgtacgccaggctggggctgtgaagcggtgattaaccatcagatcgaggcctacaaactgagcgacaccgtggtgcacaaccagggtaactactcggcgatgattgccgacaccattacacgcttcaaacagggtaaaccgattctctattacacctggacgccatactgggtcagcgacgtgctgaagccgggtaaagatgtggtgtggctgcaggtgccgttctcctcactgccaggcgcgcagagcaaagtggataccagactggccaacggcgccaactatggcttcccggtgaacaccatgcatatcgtggccaacaaagcctgggcagagaagaatccggcggcggcaaaactgtttgctgaaatgaagctgccgattggcgacatcaatgccgagaacgccgcgatgcatgccggtcacgcctcagaagcggacatcaacggccacgttgacggctggatcaaagctcatcaggcggaatttgataaatgggtcagcgacgccatggcggcggcgaaataa

SEQ ID NO: 29616 - DNA, 882 bp, Glycine max
  Peptide Sequence Number=SeqID_121301
atggcgctacaaggcacggagattcaggcgattaactggaaccgcatccaggacgagaaagatctcgaagtgtggaaccgtcttaccagcaacttctggctaccggaaaaggtgccgctgtccaacgatctgccggcatggcagtcgctcgacccgcagcagcagcagctgacgattcgggtgtttaccggtctgacgctgctcgacaccattcagaacgtcattggcgcaccgggactgatggaagatgcgctgacgccgcacgaagaggcggtgctgtcgaacatcagctttatggaagcggtacatgcgcgctcttacagttcgatcttctccacgctgtgtaataccgccgacgtggatgccgcctaccgctggagtgaggagaatgccgccctgcagaacaaggcaaagatcgtgctggagcactaccgcgccagcgatccgctgaagaagaaaatctccagcgtctttctggagtcgttcctgttttactccggcttctggctgccgatgtactggtcaagccgcggcaagctgaccaataccgccgatctgattcggctgattatccgtgatgaagcggtgcacggttattacatcggctataagtaccagaaagcgctggaaaccgttgacgacgcgcgccgcgctgagctgcagcagttcgctatcgatttattgctggcgctgtatgaaaacgaggtggtgtacaccgaagcgctgtatgccgacgtgggctgggctgaagaggtgaaaaccttcctgcattacaatgccaacaaggcgctgatgaacctgggttacgaaagcgctgttcccggcggagctgacggcggtgaatccggcgattctgtcggcgctgtcgcccaacgccgatga

SEQ ID NO: 29617 - DNA, 304 bp, Glycine max
  Peptide Sequence Number=SeqID_121302
atgaaggtgcggcatctggtgatgctgtcgctcggcggcgtgattggcaccgggctgtttttcaacaccggctacatcatctccaccaccggcgcagcgggcacgctgctggcctatctgattggtgcgctggtggtatggctggtgatggtgtgtcttggcgagctggcggtggcgatgccggaaaccggcgcgtttcacgtctacgccgcgcgctacctcagtccggcgaccggttacaccgtggcctggctctactggctcacctggacggtggcgctcggctccagcctgaccgccgccg

SEQ ID NO: 29618 - DNA, 933 bp, Glycine max
  Peptide Sequence Number=SeqID_121303
atgtcgcgtaaccccatcgctgcggccctgacccacactgataccctgattctggatggcgcgctggcgacagagctggaagcgcgcggctgtaatctggccgatacgctgtggtcagccaaagtgctgatggaaaatcccgagctgatttatcaggtgcactatgactacttcgccgccggcgctaatgtggcgatcaccgccagctatcaggcgacgccgctgggcttcgccgcccgtggactggatagcggccaggccagcgcgctgatccgccagagcgtggcgctggcccagcgggcgcgcgacgattatcgtgccaccacaggcagccaggcaccgctgctggtggccggatcggtcggtccttatggcgcttatctggccaacggcgccgagtatcgcggcgactacgccttgccggctgccgaaatgaaagatttccaccgtccgcgcgtggcggcgctgctggaggcgggcgtggatttgctggcgtgtgaaacgctgccgtcgtttggtgaaattcaggcgctgattagcctgctggcggagtttccgcacagcagcgcgtggttctccttcacgctgcgcgatgcgcaacacctgagtgacggcacgccgctgagcaaggtggcggaagtcatcaatgccgcgccgcaggtggtcgctgtcggcctcaactgcgtggcgctggagagcgtgacgccggcgctgcaaacgctacaggcgctgacggacaagccgctgctggtctatcctaactccggcgagcagtatgatgcggtcagcaaaagctggcactcggcgccgtctggctgcacgctgcacgataagttccccgagtggcaacaggcgggcgcacggctgattggcggctgctgtcgcaccacgccgcaggatatcgcggcgattgccgcctgttgtcaaccgtaa

SEQ ID NO: 29619 - DNA, 1092 bp, Glycine max
  Peptide Sequence Number=SeqID_121304
atggcggaagcccgcgttgatgcgatcgtcgatgttatcgcgtcgcagcagcttaagcggttccgccagcgtgcggcgcagccggtggcgcggatgcagcgaagcgtagggatcctgaaacaccatctgcacatcgcgccgcagctggccggtaaagggtttgcccggctgcacggcggtattcgccagcgtcatctggccgcgccagtgcgggttcagtccggccatcacccacagcagcgacgatttaccgcagccggaaggccccaccagaccgaaacactcgccggccgccacctgcaggttcacatcgtgcaccacggtgcgcagttcataaccctgtttgtgcgaaacgctcagcgtgcgggtataaggatggctggcgtccgacagctgcgccgccggcagggtgtccagcaggcggcctttgtacatcaccatcacccgctgacagtgctcggagacctgttgcagatcgtgactgatcagcagcaggcccatattgcgctgctccaccaggcgacgaatcagcgccagcacctgatcgcgcatggcgtgatcgagcgccgaggttggctcatcggcaatcagcagagcgggatcggtaatcagcgcgatcgccagcatcacgcgctggcccatgccgccggagagctgatgcggatagcgcttcatcagctggcgcggctcgggcaggcccaccgcgtccagcatctcgcacactttctctttgcgctcggcgcggctcagcttgcggtgcagcaccagcggctcttcaacctgccagccaatggtgcgcgtcgggttgagcgcgtatttcggatcctgcatgaccatcgccactttgccgccgcgcaggccgatccagtcgcgctcgcgcaggtgcagggcgtctgcgcccgccacctgcagccggtcagcctgcagctgcagcgcgggcgacagcaggcccatcagcgcacgcgcggtcagggatttgcccgagccggattcaccgaccagcgccacgcgttcgcggccaagggtaaagctgatgttatccaccagcagcgcgtcgtggctgcgaatcgtcagcccctgcgcattaattaa

SEQ ID NO: 29620 - DNA, 2505 bp, Glycine max
  Peptide Sequence Number=SeqID_121305
atgctgccgatgattgtcagctcgaatctggccaaaggggcgattgccatgtcgcgccgaaaagtgatcgtcaaacgcctgaacgcgatccagaacctcggcgccatggacattctgtgtaccgacaaaaccggcacgctgacgcaggacaacattatccttgagcaccatctcgactgtgccggggtagagaactcgcgcgtcctgatgctgagctggctcaacagccattaccagagcggcacgcctaacctgatggatcgcgccatcctgcgctacggcaaaggacgcatcagcgcggacatgagcgactactacagcaaagtggatgagctgccgtttgattttgtgcgtcgtcgcgtttcagtggtggtgcgtgaccgccgcctcaaccagcagatgctgatctgtaagggcgcggtcgaagagatgctgagcattgccagcgccgaacgcgaaggcaaactgattcagccgctcaatgaaacccgtcgcgctgagctgctggcgctggcgcatcagtacaatcagcagggcttccgcgtactgctggtggccagccgcgcgctggcggagccaggcctgcaacaggcgctgagcgtcgcgaatgaacaggggctgaccatcgaagggttgctgaccttcctcgatccgccgaaggagagtgcggcgaaggcgattaccgcgctgaacgagaacggcgtaacggtcaaagtgctgaccggcgataatccggtagtgacggcgcgcatctgtcagcaggtgggcatcgactgtggcgagatcctcaccggcgaggcgattgcggcgatgagcgatgagcagctggcgcaggccgcggcgcgcagttcggtgtttgccaaactgacgccgctgcagaagtcacgcattctgcgtgcgctgcagcagcagggccacacggtgggttttctcggtgacggcattaatgatgcgccggcgctgcgtgacgccgatgtggggatctcggtcgacagcgcggcggacatcgccaaagagtcttcagacatcatcctgctggaaaaggatttaatggtgctggaagagggcgtgatgaaggggcgcgagacgttcggcaacatcatcaagtacctgaacatgaccgccagttccaacttcggcaatgtgttctcggtgctggtggcgagcgcgttcattccgttcctgccgatgctggcgattcacctgctgattcagaacctgatgtacgatctgtcacagctggcgctgccgtgggacaaaatggatcgcgagttcctgcgcaaaccacgcaaatgggacgcgcgcaacatcaaacgctttatgctgtggattgggccaacgtcgtcaatttttgacatcaccacttttgcgctgatgtggtacgtgttcgcggcgaataccccagcgatgcagtcactgttccagtccggctggtttgttggaagggctgctgtcgcagacgctggtggtgcacatgctgcgcacgcgcaaaattccgtttatccagagccgcgcggcgctgccggtgctgctgaccaccgcctgcgtaatgattgccggcattctgctgccgttctcgccgctcggcgcgatggtcggcctggtgccgctgccatggagctatttcccgtggctgctggccacgctgctcggctactgcctggtggcgcagggcatgaaaacgctgtacatcaagcgctttggccagtggttctgagtgcaggaggcgcgatgaagcaacgcaacctggataaaacgtgttccggtaaggacaacagggcagggtatcctgccctttttcgtggcacaccaaccagcgagagacagatgagccaacaacagcgagcattgattattggggcgtcaaaaggcattggcctggccgtggtgcagcaactactgcaggcgggctggcaggtgaccgccacctaccgttccacggcggtttcgtttcagcatccgcagctgcagtggctggcgctggatatcaccgatggcgcgcagcgtgacgcgctggtccggcagctcggcgacgcaccctttgattgcatcctgattaacgccgggattctcggtccgcacgcatcgcagctgcgcgacgtggacgatgcgcagctcagcgagctgttctttaccaatgcggtggcgccggtgcgcctggcggagagcctgctgccgctgctgcgcgataaacagagcgtgctgggcctgaccacgtcgcgtctcgccagcctcaacgagaaccgtgacgcggcgatgccgttctactcagccagcaaagcggcgctgaatatgctgagccgcgcgctggcgacgcagatgcaccagcagggcagcacgctgctgtcattgcatccgggctgggtaaaaaccgacatgggcggtgagggcgcggatatcaccgtcgccgagagtgcgcagggcatggtcacgcagctgcagcagtttagcgggcgtggtggccatcattacgtggattaccgcggccagctgctgaattggtaa

SEQ ID NO: 29621 - DNA, 315 bp, Glycine max
  Peptide Sequence Number=SeqID_121306
atgggacaccttagtgatcaagggattcccacaaaccctaagagaataaaggtcattcctgagtggcccactccaccaacaccactcattgagttggtgaggaaccatgttccctcatgggaagatgcccgggaaatgggttttcagaccttaccttactccaacataccaaacaccgctaatatatatgtttttattctttttagagatgttgagggaagaagcccagagtttcaagaacctttggatttgaggtcaaatccttttcaagggagagggaatgatgcaatcctatcccccaagggcattggatag

SEQ ID NO: 29622 - DNA, 382 bp, Glycine max
  Peptide Sequence Number=SeqID_121307
atgactagaggcaatccatctgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccacctcgtgagaggactctaagggaaatggctgcacctgatttcacctatgaaagcttatgcatccaataccctgatgaggatgtcccatatgttcttaaaactggactgattcatttgcttccaaagtttcatggccttgcag

SEQ ID NO: 29623 - DNA, 533 bp, Glycine max
  Peptide Sequence Number=SeqID_121308
atgactagaggcaatccatctgacttacaaccctttgatcctgagatagataggacatttcatagattagttaggcatcattttataccttttgatcattctgagcattccattactggtgaatctgtgcattctgttattggtgattttgaacatcctgatcttgagcattataattttgagcattctgattctgagcattctgattttgcacattctgagaacatgacacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgtaggtgaagacccgcacaaacatttgaaagaatttcacattgtctgctccaccatgaaacccccagatgtccaagaggatcacatatttctgaaggcttttcctcattcattagagggagtggcaaaagactggttgtattaccttgctccaag

SEQ ID NO: 29624 - DNA, 390 bp, Glycine max
  Peptide Sequence Number=SeqID_121309
atggtggtgagcttcttcttgactcatcttctccttgaagtggcgtctcctctctctcttccttctccattccactgccattcatcttccaagaagcaaaggaatccattgatgatgaagatcctaggcctacaagctccaatggagcttacattaggaaggccatggaaatttgataggaagatcatttgcaatggcctaactaatgagattacccacacccatcttggaactaaatttgtgttgcatcctcaaacaccttcacaggtggccaaggatcaactaactatgaaagataagagggatgaggaagaaaaactagaaaaccaaaagaaaaagaaggatagtaaggccttgtcttcaaaggccaaggggaaggaaaaagagtaa

SEQ ID NO: 29625 - DNA, 499 bp, Glycine max
  Peptide Sequence Number=SeqID_121310
taactggttcagcagagcgcagataccaaatactgttctctagtgtagccgtagttaggccaccacttcaagaactctgtagcacgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 29626 - DNA, 463 bp, Glycine max
  Peptide Sequence Number=SeqID_121311
atggaatcaagcaatgtgaagaacaagtcaagtggaaaaagaaagatgtctagtgaggacacaagaagttacttcacatggaacttggaaatggatcgtgtgctagctgatcgttttggagttcacctcatggcagataatgttaagaaccgttttaagctttggagaacatggtatggaattgtgagtgacattcttagtcaaagtggatttgattgggatagcacaaagtacatgattatctcacatgaaaaggccaaacgatttcgattcaaagtcattcctaattgggatgatattgttgacctatgtgcaaaggatagagctattggactcggagcagaaaatgcattagatgcagatgatatcatgagcaaagaaacaaatgaagaggaaacaattaatagtgtgagttttgacttagagggatcaagttctgccacaagaaaaaacattcgcccaa

SEQ ID NO: 29627 - DNA, 471 bp, Glycine max
  Peptide Sequence Number=SeqID_121312
atggcctgcaccaagaaaactgggcaaatgatgtttgaggtagcaaaggaaattgttgagaagattgcctcacggggttcctttgtcgcccatggacgtcaggatgtactgactgctgccattaggcaaccagaacaccctggtcatgtgcgttctgctagagctagtgtcatgatcaagaaatactttggaccgactccaaggacctcccacacatcttcctccatggctcctgaagacctggagcagctgatgcaaaaaattagggaccagctggaggagtcaatcacagaaaaaatgcaatcacaaggtccttcagctgctcatgttagcacaaaggagagttatgttgatccctcagagaacaatccaaacacgaatgactcagacaaatgcgggttgtacgtcaaagaaaatcctccctgcctggttagagatgcagatgctcccattcttgtacccactgaagag

SEQ ID NO: 29628 - DNA, 180 bp, Glycine max
  Peptide Sequence Number=SeqID_121313
atggaagtttgtgatgacattgctgagaggttggagtgccatctgagtctaggggtggtcacgccaggctcatcgacacatgaggtgatcgaagaatgcctcaggttagccaggagtgtgacacaggaccatctagtatatgttaggtctagacgcaggcggcgcacggatcaggcgtag

SEQ ID NO: 29629 - DNA, 239 bp, Glycine max
  Peptide Sequence Number=SeqID_121314
gcccacttgggccttccagattcttcctccagaaggttgttgcttctggaggaagcaaccttgctcgcctgggcgagctaggtggcaagctcctcccctattttgctataaatagggggaggagtgaagggagaaggggttcagccttcttggcacttctcattctctcgaaattgctgaggaaaatggggttccgtgaagaaaatccaagcggaggcgcttctgtaacgtttccgtga

SEQ ID NO: 29630 - DNA, 279 bp, Glycine max
  Peptide Sequence Number=SeqID_121315
atgctctcaggaacggaagcttctagcacactccagacatcttctcacagatcgcaacgaagtttcattaagaggcttctagcacactatagacatcgtctcaaagatcccaacggtcagatcatggaaaaatgtcttgtaaagtttaataccaaatttcgagaagatccaacggttaatgaaggctgggaagcgtttttaccgaggcagctgcatgtagctttctctagaagcttcattaagaggcttcctctagaagcttcctcgtggcttctttga

SEQ ID NO: 29631 - DNA, 725 bp, Glycine max
  Peptide Sequence Number=SeqID_121316
ggggctacacgtcctcaccttcagaggactacacaccctcaccttcagaggactacacgtcctcgccttcagaggactacacgtcctcgcctttagaggactgcacgtcctcgcttttagagggctccacatctgcgccttcagagaactcaagggcaccattgttgatgactggaagtttgattattctagtcatgatgctcggtgtatggtctgcaatgaccaggctgatatgaccggcaaattacttgttgggtcattaacctttgattgctgcatcatgcactatattattgttcgtattttacttttccgttcttctaaccttgctcaagccttcgaggaggatttgattcttatgtgggcttttcttaccagtcgtcagatcgactgggctcacttgattcggtaccggatgcataaggcattacgggccaatgcacctctcccttatcctcacctcgtcaccctttttcttcatcatttcaaaattcctttggaagatgaaccatttgttcaagtaaaaaggtcttttgctattggtgttggtgcgattatcttgtttggttaccgtaaggatgatgatggtcagtgggttcgaaaacaagacttacctcagccaatccctgacgaacgtactctttctcctccaccgcaaagggttgattcctcttcacttctgaacgatgttctctctgaactccacagtcttcgagcttttgtgg

SEQ ID NO: 29632 - DNA, 90 bp, Glycine max
  Peptide Sequence Number=SeqID_121317
atggatgcaatgcatgaagaaatgcatatgggaggcacagggcgaacacggattcttcctccgtcggttctaagcgaggggatcaattaa

SEQ ID NO: 29633 - DNA, 311 bp, Glycine max
  Peptide Sequence Number=SeqID_121318
atgggaacaaatcaaactggaaaaaggttttatcaagtcaagattaagggcctagatatcaccagcattaaggagttagggcggttgatgggacctctccaaatgcaagccttccgcaaggcgtacggaaatattttagatttgaccatatcagagatatccacagaagccgttgtatcactcacccaatactatgaccaacatttgagatgcttcacgtttggagacttccaattagtacctactgtcgaagaatttgaggagattctaggatgtcctcttgggggaaggaaactatatcttttctccag

SEQ ID NO: 29634 - DNA, 126 bp, Glycine max
  Peptide Sequence Number=SeqID_121319
atgaatgagaaagaggtctctaagtggcgcaaagagaaaaccgacgggaagctcacaatagacttggaaagtgtgaatctcaggcatgaaaaatatgcgtatatgcggaatgcgacttactgttga

SEQ ID NO: 29635 - DNA, 207 bp, Glycine max
  Peptide Sequence Number=SeqID_121320
atgtacccctacttgtgccacaaaggatgtaccttccaatgtgttaagacaaagaattctcaggcggttagtcctttgaatctttgtaaggggaaacaaaagatatcttatgtgggagaagggagacacaaaagaattcaggcggttagtccctctattctcttggaaaagggagaagagagaaacaaaaagaattcaagcgcttag

SEQ ID NO: 29636 - DNA, 225 bp, Glycine max
  Peptide Sequence Number=SeqID_121321
atgtcaagatttacacgcaattctcctcaaatttcagtcagcccgcatcaattagaccttgcaccttacgcttcagagccctaccatgctcaatggaacgccccggggcttctccgtgacaagcacacgttgcgttcgagtcatattctcggagaaatggaggttgatgaaccttatcaagtagatatgggagcaagtcagcataggacactggaattggggtga

SEQ ID NO: 29637 - DNA, 418 bp, Glycine max
  Peptide Sequence Number=SeqID_121322
tggctgctgccagtggcgataagtcgtgtctaccgggttggactcaagacgatagttaccgggataaggcgcagcgcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 29638 - DNA, 557 bp, Glycine max
  Peptide Sequence Number=SeqID_121323
atgacggaagggtgtggtgaagggttttgccttgcaaaccttcccggtgatgcttttagtctatgggggaacttctttgaggcaaagaaacaaatgatggctgatgccaagtcttggcaagccgttggtgaaattttgccccccggtcaacttcgtggttttgcccgttgtggcttgctagggtcggcggtgctgggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacg

SEQ ID NO: 29639 - DNA, 330 bp, Glycine max
  Peptide Sequence Number=SeqID_121324
atgcatatggcacagatgcattttatgaatatgggagcccagggaattgtccccttcttagatacaacattcgggcagcatggtgcccgacgtatgcatttaagaagcgtgtttgctctatgcccctattttagggacctatacgggaggaaactaaaagggcttttagtgataattcccaaggtggtcatatctctcttgatggggtctagaggtatcatccccttcgaagaacatattgcggcagtagggactactagcaacaatatgttatcaaagagaaaaactctagatgagggttcactgttatcaagcaagtcgaagacctag

SEQ ID NO: 29640 - DNA, 591 bp, Glycine max
  Peptide Sequence Number=SeqID_121325
atggtctgcgcactggaggcgaaatttcacgactttctcggcgcgatcttcatggagcttgagctgggcgacgaccggaacgggcagtatttcacgccgtatcatctccagtcgctaatggcgaagctgctcatgccggatgtcgaacagacaatcaggcgggaagggtttgtgaccgtcagcgatccggcaagcggtgcggcgggaatgattgtggcttatgcggagaatctgctggaggcaggctataacccgtctgaacatatgttcgcgagctgcattgatatcgacccgattgcagccgatatggcatttattcagctttccctgctgggtattcctgctgaggtggtcacgggtaatacactcacaatgcagcttaacagggttcggtatactccgggacacgactgtcgtgaacagagccagcaagctgtctctgcccttcgggcgtccatcctgacgcaaattcaaattcacgcttgctgcatcctgaaaggatgcgccgctttcaccgtggcggtaataaattcccgcctctttaatggccggaacggaaattcgtcttgcgacgattttccattccgggat

SEQ ID NO: 29641 - DNA, 249 bp, Glycine max
  Peptide Sequence Number=SeqID_121326
atggcgaggacgtgtagtcctctaaaggtgaggacgtgtagtcctctgaaggtacatgaccctttgacggcgaggacgtgtagtcctctgaagttgaaggtacatgaccctttgacggcgaggacgtgtagtcctctgaaggtgaaggcgaggacttatagtcctctggaggtgagggcgtgcagccctctggtggtgaggacgtgtagtcctctcaaggcgaggacgtgtagtcctctgacggtgagg

SEQ ID NO: 29642 - DNA, 325 bp, Glycine max
  Peptide Sequence Number=SeqID_121327
ctgctgtggatgcccttgactttctagagggtgatgaggatccacttcttgaggtggattctcccgaggaagtcatgtcgacggatgtacctaaactgaggcgagctcctggagtcaacagggagataaaaggaaaacagatcaagcaaggaggcttgtggaggctgaagccaccactatggacccttgctctggaatcgacttacgggcgcaagcttgggagaccctcgaaggtaacacgaggtgccgatttcggggcaccattcgattcacgactacttctttggtgcatccagatgaacctgcacggacgcttcagcgcact

SEQ ID NO: 29643 - DNA, 169 bp, Glycine max
  Peptide Sequence Number=SeqID_121328
gggcattgcacaagccgaaaggcatcctcctataagcaaaagtgtcgaaggggcaggcgttcaagcatctgcggtcagaatcagaggaaaaggtcccctttgctccgctcttatcagcaatctcctatgtcaaactcttggagccagagcatccatcggatcaacctag

SEQ ID NO: 29644 - DNA, 423 bp, Glycine max
  Peptide Sequence Number=SeqID_121329
atgattccagcttgcaaaagcttggttatctccttctttactacatcaagaatcaccgggttgagtcttctctgtggctgtcttactggtttagctccatcctctaaatttattcgacgcatacatgtggatgggctaataccaggaatgtccgccagggtccagcctatagccttcttatgcttcttgagaacagacaacaacttctcttgctcatcagcaagggaggcagatataatcactggaaaacttttgctatcatccaagcttcaattttggtgtggccggctggatagtggtagaaggagatggtttctcagcctgtacctcataaagaaagtcagaggtaaaacaccaccaccaccagacatgcaatcaatatcaatttcaaattcactctcaacatcaaattcagacatatga

SEQ ID NO: 29645 - DNA, 495 bp, Glycine max
  Peptide Sequence Number=SeqID_121330
gggggcggagcctatggaaaaacgccagcaacgcgccctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccctcttcgctcagagactctcgaagcttctagaagttcctcacatttccatggccacgctcctcagccaggacctcaaccctcgctcctccctctaccagcagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 29646 - DNA, 318 bp, Glycine max
  Peptide Sequence Number=SeqID_121331
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggatccccggcccgacctcatcgagacgacccaggtccagatcggggtaccgagctcgaattcgtaa

SEQ ID NO: 29647 - DNA, 216 bp, Glycine max
  Peptide Sequence Number=SeqID_121332
atgcatacgcatacacatacatatttgttatcttatgacagaagcaggatcgtcttaggcgatggtcaaataccgagccaaatccaaagacacagacaaatcgaggtaagaggtactcagggacggacgcgagtagaggctaggcccatgatcgaaggatcatcgtcccatgtccagctccagacaagcaggaagcgctgctgggaggcagcctag

SEQ ID NO: 29648 - DNA, 137 bp, Glycine max
  Peptide Sequence Number=SeqID_121333
aacgtaacagtgctttaaaaggtcttgatgatgctccacagcctaaatcaaaggctcctgctaggtggattgtcgtcaagtattttaacgatcctagaccattggagccagagagattaaaggcattgcggatctag

SEQ ID NO: 29649 - DNA, 365 bp, Glycine max
  Peptide Sequence Number=SeqID_121334
atgactagaggcaatccatctgacttacaaccctttgatcctgagatagataggacatttcatagattatttaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccacctcgtgagaggactctaagggaaatggctgcacctgatttcacctatgaaagcttgtgcatccaataccctgatgaggatgtcccatatgttcttaagactggactgattcatttgcttccaaa

SEQ ID NO: 29650 - DNA, 609 bp, Glycine max
  Peptide Sequence Number=SeqID_121335
atgtatgtgatagtctcattgggacgctccttaacattcacggcaagacgaaagatgaaaaatatacttgcctccagcttgtcatactttgtccagaaaggaaaagatcagtttttttcagtgcctacgacgggtcaaagttccacaaccattcacaacattcctttgctacatgatcaagtcaaggttggtgttgaggagattagagatgcaaatgctctcattcctgtacccactaaagtggttaagggagttgtgggacccgcgaaacctgtagatagaccggatgatgaggttgatgatcccctatatctaatgacattgaccatcccacagctttttctgaagccattgcaggttatgtgggatgctaccttgtttggcctattttatgaaaacttccctttgtacataaagcatgaagatctgtctgaaattgcacacggtggtcaatatctcagcatatctgttatacagttgtggattctacatatgactgagacaagtatgcgagccgggaatatcgatgtgtatggattcctcgaaccacagtctatccagagatctggccaatcacaatttgaatcagaaagttacattaagaattga

SEQ ID NO: 29651 - DNA, 360 bp, Glycine max
  Peptide Sequence Number=SeqID_121336
atgtcgatctccccctgcggaagtatcagttggtctgtgccgtcccgacatagggatcgtgcccacaagacacccagtggacccaaaaaagtccaacagggctctgaggtttccagctctggttacgggcctctatcagtcctacagggtgcccgtaccccccccccccggcaaaggatcgcacccacaaagacacctagtggacccggagaagtccaacagggccctggggtctccagctttggttatgggcctctgtcagtccaacagggtgcccgttcccccagcaagggatcgcgcccgcaagacacccaatggacccggagaagtccaacagggtcctggggtttccagctctga

SEQ ID NO: 29652 - DNA, 63 bp, Glycine max
  Peptide Sequence Number=SeqID_121337
agaaagaagaaggagagacagaagtcatcatacactaatcacggagagagcgaagacagatga

SEQ ID NO: 29653 - DNA, 234 bp, Glycine max
  Peptide Sequence Number=SeqID_121338
atggtgaattccatgttatcctattcgggtttaagtgaaggattttggggtgaggctatgttgacagtctgttacttgttgaaccgaattcctaacaaaaggaataagagattgaaacacatcatcgaaagtatcccaaaaggtgcaagaaagaaaatgactacctatataagcatgaagtttagccgcttcaagaagctgagacttggctttgatatgcttatgatcggatag

SEQ ID NO: 29654 - DNA, 228 bp, Glycine max
  Peptide Sequence Number=SeqID_121339
atgatgaagaacgatggaaaaccttcgcaaaatcgcccacggaaatgtctcagaagcgttacggaagcgcctcggcttggattttcttcacggaaacaatttttctcactaattttaagggaaaagagggaggtggttgctgcccagctcgcccaggcaggctgggttgcttccaccagaaggcaccgccttctgttggaacatcctggaaggtccaagtggacctga

SEQ ID NO: 29655 - DNA, 366 bp, Glycine max
  Peptide Sequence Number=SeqID_121340
atggataatcacttgggtatatccgcctaccacttgacgcatgggtcaagatcaacagatgttgtgagaccaaaagagtctcaaccggaagaagctgacatctccggaaagggcacacacgaccaaattggtctgcgcttgtcaatcagacttggggtctccaaattacgaggtgcaaataaccgtaaggcgtctccgcatgctaccgaacttgtcgcaacatgcccttttgtgggcgtgcgaggcgaggctcacgggtgcgctttccaaaggaggaaagatgcgcggagtcgccaccaacgtcgacaaaagcggggctcttgctcctacgtaccctccatcgaagaggaaatcggacctacgtag

SEQ ID NO: 29656 - DNA, 444 bp, Glycine max
  Peptide Sequence Number=SeqID_121341
atgactatacttgtaacttctgtgaagttactggaacttggtggtttaccaagaactggatgtactctcagtggaagagatgaaccggtatgggaaccaaaaaacataatcattcaagaagtaagatacttaaagaatcttgcatgggatgagctacttggcattcttagagttcatgaagtcgaccttcaaaacaaagatcatctgcaaaagaagaatttttttgctctcaagtatgaagaaacaagctatagaagaaaagaaaagaagagtcaatttaaagctcttaaagtgcagatgaatgaatatgatggatccatagatgatgaggtagtccttatgtccaaaaatttcaaatggacgatgaaaaaagagaggaaggtttcaacacttctccagaagaaaggatacacgattcaaaaagaaaaacaaagaggagagtaa

SEQ ID NO: 29657 - DNA, 270 bp, Glycine max
  Peptide Sequence Number=SeqID_121342
atggttacgggcctctgtcagtcctacagggtacccgttcccccagcaagctcatgccatcatgacataggcaagtatacacggatcgcgcccacaagacacccagtggacccgaagaagtccaacagggtcttggagttgacaagctataattacgtgcttcagtcagttgtcagtgaccgacaagtcatcaagcgtccagctcaagacgttaaagaagcgctactaggaggcaacctagtaccttttaaatctgtgcttgttatttga

SEQ ID NO: 29658 - DNA, 627 bp, Glycine max
  Peptide Sequence Number=SeqID_121343
atggcacgcagagacaaaatttggtcattctgcaccctttgtcatccagaggcggcgggcccgatgacatgcggagacaaaatttggtcattccgcacccctttgccattcagacacagccgtgtccgatggcgtgcagagacaaaaatttggtcattctgcaccctttgtcatccagaggcggcgggcccgatgacatgcggagacaaaatttggtcattccgcgcccctttgccattcagacacagtcgtgtccgatggcacgcagagacaaaatttggtcattctgcacccttttcatccagaggcggcgggcccgatgacatgcggagacaaaatttggtcattccgcacccctttgccattcagacacagacgtgtccgatggcgcagagacaaaatttggtcattctgcaccctttgtcatccagaggcgacgggcccgatgacatgcggagacaaaatttggtcattccgcgcccctttgccattcagacacagtcgtgtccgatggcacgcagagacaaaatttggtcattctgcacccttcgtcaatcgtggccgataagcccgttgatacgcggagatttacattatcttccgcactcacaagatctgtcatactga

SEQ ID NO: 29659 - DNA, 381 bp, Glycine max
  Peptide Sequence Number=SeqID_121344
atgccactgaagggcaagcagttggtggtataccctttgaaaacactttggagggccctcagtttcgcccgcaactacaccattgcattttgcggtgggaagagcccctcctgctatggccgaaaagggaaagttggatcatttagaggaaaggctcagggcattgaaggaggatgcaactatagaacatttgcaaaaagggggacggatctttcaaagaacacgcccaaaaggtggagggatctggcggcccaagtggtacccccaatgatggaaagggagacgataatcgtgatggtagacacattatcgatactctactatgaaaagatggtgggctacgcaccctcaaagctttgcggatttggtcttcgccagtga

SEQ ID NO: 29660 - DNA, 54 bp, Glycine max
  Peptide Sequence Number=SeqID_121345
atggcggacacctactccgcccccgaggagatccacggacttctcaaatgttga

SEQ ID NO: 29661 - DNA, 333 bp, Glycine max
  Peptide Sequence Number=SeqID_121346
atgagctggttactgaccggcacggtcgtcctgttagttcttctattttccgcgatgatcgtccgcgattatggtcgggagaccgccgccgcccggcaaaacatcgaagaaaaggggagtgtgctgatccgcgccctggagtccggcacgcgtgtcggcatggggatgcgaatgcatcacgcgcagctgcaggcgttgctggaggagatggcatggcagcccggagtgctgtggttcgcggtgaccgatgaaaacggtaagattatcgcccacagcgacccgcaacaggtggataccgcgctgtacagtcctgcgcaaatgcgtgaactcaag

SEQ ID NO: 29662 - DNA, 99 bp, Glycine max
  Peptide Sequence Number=SeqID_121347
atgggtgagaactttgatcgaccctatgttcacttgaggctcatgcacggtgccctcattgcccagtgtaaggctttaaggagggaacctattgggtga

SEQ ID NO: 29663 - DNA, 259 bp, Glycine max
  Peptide Sequence Number=SeqID_121348
atgacatcttcgtcgtcatgtttatcaagtataccaactaggtctggtccaattgagggtgacgttttgtggatgcaacctaagcatgtttcaaaacatgtttggaatagggaaccaaacagaaaactacacattagacgagcagttccgacgtatcaaggtgaagaacaaatactagaggaaattgttcctctgctttggcaatctgagttttggataatgaagatgggatacctaaagatccctgtggccttaatta

SEQ ID NO: 29664 - DNA, 192 bp, Glycine max
  Peptide Sequence Number=SeqID_121349
atgtcgggcaaacctaacatgaatgatgtagcagaacgaagaaaccgaactcttaaggatatagtgagaagtatgattagtcattcttctttgtcaaagtcactttggggagaagccttaagaccgcagtttacatccttaatagggtaccaagtaaagcagttaacaaaaccccttatgaactttggactg

SEQ ID NO: 29665 - DNA, 144 bp, Glycine max
  Peptide Sequence Number=SeqID_121350
atgaccaagagcaagggcaaggatccacttgaaggacttggaggacctatgacaagggctagagcaaggaaagccaaggaagctcttcaacaagtgttgtccatactatttgaatacaagcccaggttagtgggtcattactaa

SEQ ID NO: 29666 - DNA, 612 bp, Glycine max
  Peptide Sequence Number=SeqID_121351
atgatgtttgcctttacctctactggtattaagctagacaaatcaattaatgaaaccaaaggacctcctacaattagaattcaaggccaaccatgccatcgaataggcagcctattaccaatgcctggaaaacaacccaaatttgcacaattatatatctttgatacacagaatgaagttgaaaatagaattaataccatgagccaacatgttgcaattcagccacacattgtttcaactttaagtcaaatgttggatgaccacaatgtccatgcaaaaaattttagaatggccagggatagattgacaaatagtcaagtagataatgtgaaattgagattgatagtcagtcgtgaaaaggatggtcgtacatataatctcccaaatgtttctgaagttgctgctctcattgttggtgattttgatgcaaactcaagaagggatattattgttgaaactcaaaatggagaattacaaagaatccatgaattacactctagctatctaggactgcaataccctttactctacccttatggtgaagatggatatagacctgacatacttcaccgttctacatttgacaacaaaaaaggaagagaaatcgtgtaa

SEQ ID NO: 29667 - DNA, 486 bp, Glycine max
  Peptide Sequence Number=SeqID_121352
ctggaaaaagaaggcatcaactgtaacctgaccctgctgttctccttcgctcaggctcgtgcttgtgcggaagcgggcgtgttcctgatctcgccgtttgttggccgtattcttgactggtacaaagcgaataccgataagaaagagtacgctccggcagaagatccgggcgtggaatataccaggcagctattaaagcctcattcagcagtacgtttagcggacatctcggggtggggtatagccatggtgccggatgttgaaagggaaaattctggggcaaaaaaagcccgccagttacggcgggaaacctcatcctatgggagaacaatgaataatgaaattgcggggttatcatctcccaccttaaggtgtaaagggggaggtggaaatagcaatgaggagtatcagcaagaatactcgccgctttaccacaacgtggatgagagggatgaaaaactcaaggcagagataactctgccttga

SEQ ID NO: 29668 - DNA, 447 bp, Glycine max
  Peptide Sequence Number=SeqID_121353
atgccgatctccccctacggaagtatcagtcggtctgtgttgttccgacatagggatcgtacccacaagacacccagtggacccggagaagtccaacagggccctgaggtttccaactttggttacgggcctcagtcagtcctacagggtgcccattccccccagcaaggggtagcgcccacaagacacccagtggacccggaggagcccaacagggccctggggtttccagctctggttacgagcctctgtcagtcctacagggcgcctatccccccaacaagttcatgccatcgtgacatagggatcacgcccgcaagacactcaatggacccggagaagtccaacatggtcctggggtttccagctctaattataggcctttgtcagttctatggagtgcctatctcccccaacaaggtcatcaagaccccgggatcgctctag

SEQ ID NO: 29669 - DNA, 567 bp, Glycine max
  Peptide Sequence Number=SeqID_121354
atgctgtacgccgagcatcacttcgcctgcggcgacacgcaggtgacgaccagtatgcatcgccgcggcggcagccagcgcgaaagcgtgcaggcggtgaccgacggcgcgctgtatcagttgaccgatatgcgccactggctgcgtgaagatgcgcagggcgagttggagcagccggtgccgggctggcaaagcacgctggtgcaacgcggcttcgacggggcggtgcggcatttccttgatgccgtcgccaatcagagcgcgccggaaaccggcggcgaacaggcgctggccgcccagcgggcgttgatatttacggtacctatcagacaaccacatgaacctactcaaatccttggctgccgtcagctcgatgacgatgttttcgcgggtgttgggctttgcccgcgatgcgatcgtcgcgcgcgtgttcggggccggcatggcaacggacgcctttttcgtggcgttcaaactcccgaatctgttacgccgtatctttgccgaaggggcgttttcgcaggccttcgtgccgatcctggccgaatacaagagccagcagggtga

SEQ ID NO: 29670 - DNA, 246 bp, Glycine max
  Peptide Sequence Number=SeqID_121355
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaaaatcaacaacaaactatcactctgcttctgccggtgtcatggcaaaatcaacatcttaacaaccactaggattatgtttggggtaccgagctcgaattcgtaa

SEQ ID NO: 29671 - DNA, 402 bp, Glycine max
  Peptide Sequence Number=SeqID_121356
atggaatgccctaaagatgttgagaagtataacaacatgattaattctcaacgagtttatgtctttttggctagcctggattcacatttggatgcagttcatggtcgtatccttgctaccactccccttccaaatgcaaaccgccaagaggctatgcttgatagtgagtctactatagggactacttttgttgttaagaagtattttaagaaagaaatccgcaagtgtacccactgcaatggggataatcatgtcgtggagacatgttttaaactccatggctatccggattggcatccaaaaggcaaaactactcctaataccaaggtagacgctacttccaagagccatatttctactgctgctagatttgtgaccaagtcaggggtagtgagtggataa

SEQ ID NO: 29672 - DNA, 634 bp, Glycine max
  Peptide Sequence Number=SeqID_121357
gtatccggtaaacggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccaacccaactctggcggggacttgccgccggaggaaccccctcaagagatcaaagaagaagaacaacaacaagagcaacaccgaaggcaacactcacattcccattgtgatagctaagtgtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 29673 - DNA, 393 bp, Glycine max
  Peptide Sequence Number=SeqID_121358
atgagcacatccatttccttgaaatactcctcaacccccttgttgccttggtcggcgtcggccaggaaagatgaccgatcgaggtctaacatacaagcttcaccagatgatgccgatcgaacatttcctaatcgacatcatccaattgttattcagggattgaatagaataaacaatggccggtgtcgatcgttatatggccctgtcgcaacctacccttcggcgggagggcgacgcgtgactcgcgggatgcgtgttccacgaaaggaatacgcgcggagtcgccaccaacgtttattcgaggaaaacgtcggaaaaaccggaaaagacgcgatctacgaacttttaagtgaaaggttcgggagttgtatttacgcacggggaaggtattag

SEQ ID NO: 29674 - DNA, 102 bp, Glycine max
  Peptide Sequence Number=SeqID_121359
atggcgcaatgtcggttgaaaaatatcagtcgggatacttcaagaccgatgtcggctattgagttttctgttcaatcccttaatgaaatatgcatgatgtcg

SEQ ID NO: 29675 - DNA, 231 bp, Glycine max
  Peptide Sequence Number=SeqID_121360
atggcgtcagcaatcacttgggccacgtggacgctcatccgtgtcaggatggcatacaccaactggcacttaggcagagggagatcggagttattatcgctaggcaagacattgctgagcagcagtatcatccacgtctgggtcaaggtggtcatgctggtgcgcatgatccacacctgcctccccacagcggtccgagcgaaatcctaccccggtgtgcataacagctgg

SEQ ID NO: 29676 - DNA, 327 bp, Glycine max
  Peptide Sequence Number=SeqID_121361
gtcgactctagaggatccccacatccggagcaacccgctcgcacacttcagcagcctgtggagtggatactacctacgcctactccatatcgactagttgagcctgttcaattgatagaggtgtcatcctctaaagaggatcttgaagaggacccaggggagttatctcctgaacctgctatggatgcccctgacttaccagaggatgatgaggacccgctccctgatgttgattctccagaggatattatgcctgcatctgaggcaaactctacagaggagagtggccctagagggacagcgaatagtgatgactcttcatcatag

SEQ ID NO: 29677 - DNA, 438 bp, Glycine max
  Peptide Sequence Number=SeqID_121362
atggttatgggggatttcatcaacatactctccttccccggtggacgcattgtttttcactcaaaaaagcatatagctgctctaatcagttggaatatttgtcttttgctaaagcatgtttgcatttttagtggagaaaacaccaagactttttcaagtctcacaagttatccagaactacgtaggtctgagttcctcattggaggatacgtaggagcaagagcctcgcttttgtcgaccgcaccgctttttgttaccatgacccaagagctggtagcccgcggagacaccttacggttatccgcaccttgtcattcagtgaccccaactgtgattgatgagcagaggccaatgtggtcatctgcgccctttccggagatgtcggcatcttccggtggagactttttcaagtctcacaagttatctagaactacgtag

SEQ ID NO: 29678 - DNA, 477 bp, Glycine max
  Peptide Sequence Number=SeqID_121363
aaaactgacttgactccttcatgcatgctccactcggctcggggggatatagctcagttggtagagctccgctcttgcaattgggtcgttgcgattacgggttggatgtctaattgtccaggcggtaatgatagtatcttgtacctgaaccgtggctcactttttctaagtaatgggaaagaggaccgatacatgccactgaaagactctactgagacaaagacgggctgtcaagaacgtagaggaggtaggatggccagttggtcagatctaggtttcctcatttgggatcctggggaagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 29679 - DNA, 888 bp, Glycine max
  Peptide Sequence Number=SeqID_121364
atggtcgaaagaaaaaatccctatttgacaaggcttcttactatacctatgaattccattggacccaaaaatgatacattggaagaatcatctgagtcttccaatatcaataggttgattgttccgctcctgtatcttccaaaaggaaaaaagatctctgagagctatttcctggatccgaaagagagtactcgggttctcccaataactaaaaagtatatcatgcctgaatctaactggggttcgcggtggtggaggaactggataggaaaaaagagcgattctagttgtaagatatctaatgaaaccattgctggaattgagatctcattcaaagagaaagatatcaaatatctggagttcctttttgtatattatatggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaaaataccaaaggaagtggagggttttttcaaacaacaagggactgggtcaattattcaatcaaatgatattgagcatgtttcccatctcttcttgagaaacaagcgggctatttctttgcaaaattgtgctcaatttcatatgtggcaattccgtcaagatctcttcgttagttgggggaagagtccgcacgaatcggattttttgaggaacaacatgtcgagagagaattggatttggttagacaatgtgtggttggtaaacaaggatcggttttttagcaaggtacggaatgtatcatcaattattcaatatgattccacgagatctagtttcattcaagttaacgggttctag

SEQ ID NO: 29680 - DNA, 93 bp, Glycine max
  Peptide Sequence Number=SeqID_121365
atggctgggacgccacagaagacaccaactcatggattcttcgagccgattcagctaaacattttcatagatggtttgagaccacagtcctag

SEQ ID NO: 29681 - DNA, 456 bp, Glycine max
  Peptide Sequence Number=SeqID_121366
atggctgtacagctacagtaccctatgaagagattttccactttttgtagagtagggttaccgcgctctctatctagaatcggccatgttagaagtcttaaggaaccaaagacttccttgagtggtaaattctcagaggtggacgcaggattggcttcggtctgtccacaggaactctcagttaagaggtgtattctcttaaagccggaagtgacgcagaacagctacaccgctagcaggaggggatattctttaaccaagaccggcattttagtggaagggcgtgctcctcaactcctatacccggaagtgggaactagtaagatggttatcccctctcaaacaacaaagagaacacagaatcagagcaaccattcgaggcttctgattcaactcaaagacaagacaacaaggaagggcgacctatcaaggaagtacgaactaggatacttctga

SEQ ID NO: 29682 - DNA, 306 bp, Glycine max
  Peptide Sequence Number=SeqID_121367
atgaatggagatgagtgcgtatatgagagcattatgtctgaagaaattaatatgaataaagacaatggagaggaacctgttgtgtttgaatatattgattgttttgatactttcaatacttctcaggtgtttgctacttgtgataactcattgcaatggactcctattattgcgtatgatattggttttgtagttgtgataatgaggccagacacatcaattggaaagagagaaagaatctcatttattttaattagttgtgagaggagtgaaaaatatagagcatacaagaaaaatttaatatga

SEQ ID NO: 29683 - DNA, 414 bp, Glycine max
  Peptide Sequence Number=SeqID_121368
atgccattgcatcgcgatcatcttgccctcggcgtcgaggaccgcaaatccgggcgcgctgcccttgcggatataggtgaccggcacgacgaccccgcgctcgcagatgtaatcgacccgctcgatcggattcgcctcctcggccttcagggaaagagacgacgccagcagcagtgccgggcctgcggcaatcacgaaaagcgtgccgatagagcgtttgccaaatgccatggtgaaaaatcctttgctggtcagccggtaactttccggataatccagacgggacaaatcatgcttattatctgtgaccaagagcgaatatccgaccgcgaagcgcctgcaaagaaagcgaaaaaatgcattcgctgcctgtcgagatttcgtgcaaccgaaacgggtttcgtccgttgttag

SEQ ID NO: 29684 - DNA, 594 bp, Glycine max
  Peptide Sequence Number=SeqID_121369
atggctataaaaagggctttgcaacaagagctgtgggatatttcaaatgcttatgaatccttgttgaggcagaaatctagggctaagtggatcaaggagggtgacagaaatacagcttacatccacaaactgatcaatttaagaagaagctcaaatgttgttcatggtattctcattgatggtgcttgggtccagcagcctgaccttgttaagaatgcagtgacctactttggatggggtctcttttccctctatttagcaatatcaaagagaggggctgagattgattcacggattacggacactaagattaatcaaaaagaatatggggaggggatgtttcttcattctccagaactagctgggaagacccctaagcaagactgtccctcacaaagccctgccactaataatagcttcaataatagttattttgagaatgaggaggatcttcatagggagattgctagagatttgggtgtgtcctatgctgataaaaacacctgtaaggacaagatgaagtatgatgttattaacagtagcattttccctcaatcagcagcagtgatgggaacgaagcagaatgacccatga

SEQ ID NO: 29685 - DNA, 414 bp, Glycine max
  Peptide Sequence Number=SeqID_121370
atgggggattccatcagcggactctcctttcctgaaaacaccgagactttttcaagtctcacaagttatccagaactacgtaggtctgagttcctcattggaggatacgtaggagcaagagcctcgcttttgtcgagcacaccaccttttgttgtcatgacccaagagctggtagcccgtggagacaccttacggttatccgcacctcgtcattcagtgaccccaagtgtgattgatgagcaaaggctagtgtggtcattgcaccctttccggagatgtcagcatcttccggtggagactttttcaagtctcacaagttatctagaactacgtaggtctgagttcctcattggaggatacgtaggagcaagagccttgcttttgtcgcacgccccacaagatctgtcatactga

SEQ ID NO: 29686 - DNA, 309 bp, Glycine max
  Peptide Sequence Number=SeqID_121371
atggcttttctccaaacttcttctttcgtgcttcctcaaacttttgaggttcacaggcaaaaaatccaacatttgcgtactttggattcggtttgtgtggccttcctgatcttcgaagttgttgttgtgggacttcttctacttcttcttgctggtgctattggtgatggtggtagtgtgcacgggcttggattggttacttcttgcgtctcattgacttcagtactccattgtcagcttgctccttcgtcaaagatgacatctcttgaaatgatcagctgctttgaatctggtttgaataatcggtaa

SEQ ID NO: 29687 - DNA, 426 bp, Glycine max
  Peptide Sequence Number=SeqID_121372
atgcataaggcattacgggccaatgcacctctcccttaccctcaattgataactctgtttctgcgtcattttcaaattccgcttgatgatgaaccatttgttcaagtcaagcgctcctttgctattggtgctggtgcagtgacttcttttggataccgtaaggatcagaatggtcaatggctgaagaaagatgcacttcctcctcaagatgagcgtactccttctcctcctcctcagcgagatgattcagccctcatgactgaagttttttccgagttacggggtcttcattcttatgttggtgaacgtttcgactcattggatactcactttgccggaatggatatccgtctcacacagcttaaagaagatgtgggttacattcgtcagagttttgatcttccaccaccacctccaccttcttag

SEQ ID NO: 29688 - DNA, 324 bp, Glycine max
  Peptide Sequence Number=SeqID_121373
acttatcaaggtaatccttgtggcgtctacccagacttatcttccttcattggaagtggcgtctacccagacttatcttccttaaccggaagtggcgtctacccagacttatcttccttcaccggaagtggcgtctaccctgacttatcttccttcatcggaagtggcgtctacccagacttatcttccttcaccggaagtggcgtctaccctgacttatcttccttcaccggaagtggcgtcatccaaaaaactctacagcctgtatcaagtgatccgccccgtatggttcacatcatctggtatcagagctttggctcttga

SEQ ID NO: 29689 - DNA, 399 bp, Glycine max
  Peptide Sequence Number=SeqID_121374
atgttggagattggattgacttttggtcgtcctcttgttctagatctagttaatcctactaggattgatcgggttcttactaacaaagaccttcttgccgattcgtatccagatcttgaggcttttaatctagatgaaaaagaatttctcctattgaaggttatttctaccttaccggagttatcttgcttaatttgttctatggttggagcgggtctagggactgacaatgtggccttgtccatgacccatttcccgaaaagagttgcctcatcccattttatggttcttgggagagaaacattggcctttgtcatatcagtgataaacaaagttgtctctcctctttgtggttttaaaaagactcttgtctcacaagtattcatgaccttgtactga

SEQ ID NO: 29690 - DNA, 888 bp, Glycine max
  Peptide Sequence Number=SeqID_121375
atgcgcatgctcgacaacgtcatcgacatcaactattacgccgtcgacaaggcccgcaactccaacgcgcgccatcgcccggtgggcatgggcatcatgggcttccaggactgcctgcagatgatgcgcgtgccgtacgcgtcgcaagccgccgttgaattcgccgaccgctcgatggaagcggtgtgctatcacgcctactgggcctcgagcctgctggccgaagaacgtggccgctatcaatcgtacgaaggctcgctgtggtcgcgtggcatcctgccgcaagacacgttgaagatgctgcgtgacgaacgcggtggtcatgtcgaggtcgatgaatcgagcacgctcgattgggatgcgttgcgcgcgcgcatcaaacaacatggcatgcgcaactccaattgcatcgcaatcgccccaaccgcgactatttccaatatcattggtgtatctgcgtgcatcgaacccactttccagaacttgtacgtcaaatcgaatctctccggcgagttcacggtcgttaacgattacctcgtgcgtgacctgaagaaactcggtctctgggacgaagtcatggtcgccgacctcaagtacttcgacggcagcctgtcccgcatcgatcgcgtaccttccgaactccgcgaactctacgccaccgcgttcgaagtcgaaccgagctggctggtggaatgcgcctcgcgtcgccagaagtggatcgatcaagcccagtcgctgaacatctacatggccggcgcctccggcaagaagctggacgacacctacaagctggcctggaagcgtggcctgaagacgacctattacctgcgtacccttggcgccaccagcgccgagaagtcgacgggacgcggcggggggatcctctag

SEQ ID NO: 29691 - DNA, 312 bp, Glycine max
  Peptide Sequence Number=SeqID_121376
atgggaggagctacttgtgccgccaggtctctccaccgttgtgcgtattctttaaagctgaggcgatcgggagcccagttatcggaattgtactcaaagatattgcttaggaaggcagtaatcaagatcctcaatgtgacggagtactggagaagcttccaaattagtgtaccagaaactaaccgcggcaatccggcaagcatcgaaggctggatctttgagcttcaatggggtcctttaatggtgattttccaccatggagatgcagcggaagacaaaggaaaggaggtgagaggaggcgccatccattaa

SEQ ID NO: 29692 - DNA, 525 bp, Glycine max
  Peptide Sequence Number=SeqID_121377
atggagagaagtatgatagatgctgccagtgatggagcccttggagacatgactcctgctgaagccagaaatttaattgagaagatggcctccaactcccagcagtttagcgccagaaatgatgccatagtcattagaggagtgcatgaggtagctacaaacccatctgcatcatctgaaactaagaagcttgaaggcaaactggatgcgttggtcaacttggtaacccagctggccttgaatcagaaatctgtacctgtcgcaagggtttgtggcttgtgctcctctgctgaccaccatacagacctttgcccttccatgcagcaacctggagcaattgagcagcctgaagcttatgctgcaaatatttacaatagacctcctcaacctcagcaacaaaatcaaccacagcagagcaattatgacctttccagcaacagatacaaccctggatggaggaatcaccctaacctcagatggtccagccctcagcaacaacaacaacaacctgctccttccttctaa

SEQ ID NO: 29693 - DNA, 102 bp, Glycine max
  Peptide Sequence Number=SeqID_121378
atgaggagaggcgcaggaacactcaagaaaaagatttactgctgcgaatttctcaaatttctccattgggtgttcattcatggcttttggaagatgcaataa

SEQ ID NO: 29694 - DNA, 390 bp, Glycine max
  Peptide Sequence Number=SeqID_121379
atggcttccaactcccagcaatttagtgccagaaatgatgctattgtcattagaggagtgcatgaagtagccacgaattcatcttcatcagccgagactaagaagcttgaagcaattgaacagcctgaagcttatgctgcaaacatctacaatagacctcctcaacctcagcagcaaaatcagccacaacagaacagttatgacctctccagcaacaggtacaatcccgagtggaggaatcatcccaaccttagatggtcgaatccttcacaacaacaacaacaaccttattttcagaatgttgctggcccaagcagaccatacgttcctccaccaatccagcagcaacaacaacaacagcaacagccccagaaaaaagaaaacagttga

SEQ ID NO: 29695 - DNA, 1029 bp, Glycine max
  Peptide Sequence Number=SeqID_121380
tcgaacgccaacctcgcgccggaggtgaacattgaatatgtcgatccgttgccggcgcgttttgacgtagtgatcaccgcacgcgcctatggggctaacgcccatcgaccgattccggtgcgcgtcggcgatcaagtgcagcagctcaatctgggtgacgcgttctccacgcaaacgctgcatttcaccaaccccggcgccagccgcaacctgatcatcacgccgccagaaccacagctgtctaatctcggcaacatcaccggtcaggatccacgcaaactcggtatcggcatggcggagataaaaataattccgcagcccgaaaagcaacaggaaaggcgaccaggagcaacagggatgataccgacgatgatgaacacccataaggcattcaaagcgctgcagcaggcgggcgtggccgatcaccaggccgaagtgatggtcgacatttttgccgaaatgcagcaggaaaacagcctgactaaaacgcacctttcgcaggccatggaaggcgtgatgcgggcaaatcacgccaccgcgcaacgtgtcgataaactggcacagagcctcaggcattttgaaaatgaggtccgccatacgtttaaagccattgagctacggtttgataacgtcgatgagcaattccggaaaattgatcaacgattcaaaaaagtggatgagcaattcaggctaatcgatcaacgctttgaaaaagtagatgcacaattcagagaaatcgataaacgctttgaaaaggtagatgcgcaattcaggacaatcgctcaacgttttgagcaaatcgatgaacaattcaggaaaatcgatcagcgttttgaacaaatcgatgagcgattcaggcaaattgataaacgctttgaaaaagtggatgagcgtctgctggatctcgaccatcgcatgcagctcggtttcaatgagctcaaacgcgataatctctggcatcggcggctgatgatggcgatggccagtgcctttgtgttgtcagccgccaaatatatttttgccggttag

SEQ ID NO: 29696 - DNA, 144 bp, Glycine max
  Peptide Sequence Number=SeqID_121381
ggggtgtgtcacctggtagggaactcccttgtggcccaggctgatcaccgaggggggggggggagcagttacggtgcacgactaggtgacctcgacaaatactatatagtttccctaagtgaggggtcgtgtggacacacttag

SEQ ID NO: 29697 - DNA, 189 bp, Glycine max
  Peptide Sequence Number=SeqID_121382
atgtcaaacgagaaattgaaaccttccgacgcacaaaacaatatgaaaaagggtcaaataattttcaattatcctcaagcatacagtaaacagaatttgatttcagcacttgagtctctcttgtctaaggtgataggggaggtggggcagggggaggaagttgtggtctgccaggcgcacgaccactaa

SEQ ID NO: 29698 - DNA, 252 bp, Glycine max
  Peptide Sequence Number=SeqID_121383
atgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcatggggaagcaaaataggggaggtggttgccgcccagctcgcccaggcgagctcagctcgcccaggcgagccaggttgcttcctccagaagcaacaaccttctagaggaatggggatcctctag

SEQ ID NO: 29699 - DNA, 111 bp, Glycine max
  Peptide Sequence Number=SeqID_121384
atgcctactatagactgtttttctcccatgtttaagttgtatgtgtcataccctaattttgtccggggacctttgcttgatgacatgcgacctttctttggtccttgtgag

SEQ ID NO: 29700 - DNA, 294 bp, Glycine max
  Peptide Sequence Number=SeqID_121385
atgcggggttacgttatggttagccgcacctttcgtcaacgagggggaaacgagcccgttgacgcgcggagactaacatcgtcctctgcaccttttgtcgtcctgacccgtgaagtcaggggcaaacgagcccgttggcgcacggagactaacatcgtcctctgcaccttttgtgtcttgacccgtgaagtcagccgcacctttcgtcaacgagggggaaacgagcccgttgacgcgcggagactaacatcgtcctctgcaccttttgtcgtcctgacccgtgaagtcaggtga

SEQ ID NO: 29701 - DNA, 598 bp, Glycine max
  Peptide Sequence Number=SeqID_121386
atggccgaagatcttttgaagaaaccaagaaatggtaggactttagaagaggttggtcatgagtattttgatgatttggtttcgagatcatttttccaacgttcaagtacaaatagaagtagttggtctgatcggaaatggtttgtgatgcatgacctcatgcatgatctagcaacgtcactcggtggagatttttattttagatcagaagaacttgggaaagaaacaaagatcaatactaagactcgtcatttgtcatttgccaaattcaattcttcattcttggacaaccctgatgttgttggtagagtaaaatttctgagaactttcttgtccattatcaattttgaagctgctccattcaacaatgaggaggcaccatgtatcataatgtcaaagcttataaaactgactaagttgcctagtgacatgcgcaatgttgttaacttgcgtcatcttgagatatgtgaaactcctataaaagagatgccgagaggaatgagtaaattaaatcatctacaacatctggatttctttgttgtgggcaagcacaaagagaatgggatcaaagaattgggaggactttcaaatcttcatg

SEQ ID NO: 29702 - DNA, 417 bp, Glycine max
  Peptide Sequence Number=SeqID_121387
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgtgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 29703 - DNA, 225 bp, Glycine max
  Peptide Sequence Number=SeqID_121388
atggccgaggaaggttcgaccttaaacaacactggtagcgagacaatctgcaaccgcattgaggctgtccattatcttcttcacgctcaatcatggtcctccatcattgcgccattatgctctttcatgttcggcctccatgtcggaacctccatcatactcttgtacctcctccactttacccgttactcaagctctagcacaggttcggtgagggcaccgtaa

SEQ ID NO: 29704 - DNA, 483 bp, Glycine max
  Peptide Sequence Number=SeqID_121389
gttccactgcagcggacactggcagatggtggtcatcctgcccaaggaacacctagttgtctgagggtcttgatgatgctccacagcgctaacatcaaaggatcttctgctagccgcctggattgtcggcaggacgtcagtttacatagaaacttccactgtatatatatttctttatgtgtctgtacagtaagtattttaacaatcctagaccatggaccacagagattaaaagcatctgtaggtcgatgggcacattcgctttatctgatgacattgaccatcccagagcttttcttgaggccttatcaggttacatgggatgtcaccgtgttcgaggtctttaatccagatttcccgctctacataaagcacgaagacctctctgaaatcgcacacggtggtcaatgtctcagcatatcattgttacagttgtggattctgcatctcactgaaaacaagtatgcgagcgcggaattctga

SEQ ID NO: 29705 - DNA, 323 bp, Glycine max
  Peptide Sequence Number=SeqID_121390
ggctgttcatgtgtcctccactttcgagtttggagctgagtttcatgattgcctaagtgcggaccctcaagggaatcctccatactccacctttgttcggagcaccatgaatatcggttccttcgccaagtataaggaaaaagaagaagtggagatgagagtcgtcatcacgaagagggcaggacggacgaaatcagtgtcctatctttgctttcctcttatctccgatgagaggcttgcgcaatctgtgaaattccgtaatgtggcggaaattgaaagagttgtttttgcgcaatccgtgagttttcgtaacttcttcaaag

SEQ ID NO: 29706 - DNA, 156 bp, Glycine max
  Peptide Sequence Number=SeqID_121391
atggcttgcacccacattccagtggaagcaaagatgtcatacaatgctcaatggaatgcctcaaggctcctccatgatatacacatgttgcgttcaagccgtatcctcggaaaaatggaggtgaggaaacctagcagggtttatggctaccattga

SEQ ID NO: 29707 - DNA, 366 bp, Glycine max
  Peptide Sequence Number=SeqID_121392
atgtggcttttcagaatatttttcaaaaattctctcactggtaatcgattacagcttcttggtaatcgattacacaattatgttttgaatggtcatgacttttcaaagttaacttctaaagtttcttcactggtaatcgattacagacaagtgacttatcaaggtaatccttgtggcgtctacccagacttatcttccttcactggaagtggcgtctacccagacttatcttccttcaccggaagtggtgtctaccctgacttatcttccttcaccagaagtggcgtctaccctgacttatcttccttcaccggaagtggcgtcatccaaaccttcgtagcctgtatcaaacgatccgccccgtaa

SEQ ID NO: 29708 - DNA, 57 bp, Glycine max
  Peptide Sequence Number=SeqID_121393
atggctgagaaggatgcactccctcctcagatgaacgtactccttcactcccctcac

SEQ ID NO: 29709 - DNA, 315 bp, Glycine max
  Peptide Sequence Number=SeqID_121394
atgtctatcaggtgtgatagtcaggcaactttggctaaggcatatagtcaagtgtataatgggaagtctagacacttgggtgttagacacaacatggttcgggagttaatcatgcatggtgttgaattcaatgtggaaagcttaacatgtagagattggaacacatcatcgaaagtatcccaaaaggaatgtgttcggttctcatttacaggtgcaagaaagaaaaggactacctatataagcatgaagtttagccgcttcaagaagctgggacttggctttgatatgcttatgaaggatagggacacaggctag

SEQ ID NO: 29710 - DNA, 366 bp, Glycine max
  Peptide Sequence Number=SeqID_121395
atggatgttaggatgtcctgtctgctgccattgggcgaccagaacaccctagtcgtgtgcgtactgctggagccaggacttgcactgcctccagaggttggtcccttagctgctcgggtcagcacaaaggagagttgtgttgatcccacaaggaacaattcaggcacgggtgactcagacaaatgcgggttgtacatcgaagaaaatcctccccgcttggttgccctaggaagaatttatgagggatccacaaccgttcacaacatccctttgttgcatgatcaagtgaaggtcggtgttgaggagattaaagttggagatgctctcattcctgtacccaccaacgaggttattttagtgggctag

SEQ ID NO: 29711 - DNA, 441 bp, Glycine max
  Peptide Sequence Number=SeqID_121396
atgggttgtccaatcgggtgcctggatgatgggggtggtagtcagcgctcttttgaggcaatcaaaagcctctttgcatctgtcattaaagtcaaactccacctgcttttgcaacaagttggacagtggaagggctactttgctaaaatcccttataaagcgcctgtagaatcctgcatgaccaagaaaagatcgcacctctcgcacacagagggggcatttgcacaggccgaaaggcatcctcctataggcaaaagtgccgaagggacaggcgttcacgccctctggtcaatgaatggcaggggaaaccggtcctttttggccggtcttcttcaggactacctggacgggactcacccattgactgtcagagataggataaatgattccagcttgcaaaagcttggttatctccttcttcactacatcaagaatcaccgg

SEQ ID NO: 29712 - DNA, 1140 bp, Glycine max
  Peptide Sequence Number=SeqID_121397
atggcccagcttctttctgccttttggattcaagccaatcttcctgataatttaccttcaaatattgaagctgtagctcattcattcatattgacactaattgtcttacgcataaaggtttcatcttctcgaattacgggatctgtgggtgtgaagaaggcatcaaaaggagataccatttttttttataatgcaagaaattctccagggcagtatgatttatcaagaattaatcatttgcatagtagttttgttcctgaagatgttcctgatgctgcttccgagaaagatctgggtaacgagtttttcaagcagaaaaagtttaaggaagctagagactgctattcaaggagcattgccttatcaccaacagctgtagcatatgcaaatagggcaatggccaatatcaagctcagaaggcaagcttatgttttattccaagaggctgaggatgactgcacagaggccttaaatcttgatgatcgttacataaaagcatactcacgaagagcaacagctagaaaagaacttggaaaaattaaagaatcaatggacgatgctgaatttgccttgaggttggaaccaaacaatcaagaaatcaagaaacagtatgctgatgctaagtctttctatgagaaagatattcttcagaaagcatcaggggttctgagaagcactgtacagggaactcaaaaagtggggaagtcagaggaaaaagttaatggagacagcatccaccccatttcacatagtactcaaaagtctggactagctgaagttcatcatcataaaaaggataatgaacggaaaatacttgttaaagaatcactcttaacagaggatgttgatagcagagaaataaaagccagaagcaggcctcaatcacaaggagatgatggctctaagggaggtttgagtgcaagcaacagtttggagcagagaaatcacagaattaccaagccagaaatgaaagcttctgttgaacagcttgcttctcgcgctgcttctagagccatgtctgaagctgccaaaaacgtaacacctccaactacagcttatcagtttgaggtctcctggagagcattttcaggtgatcttgctctgcaggctcgtctattaaaggctatatctccccattaa

SEQ ID NO: 29713 - DNA, 594 bp, Glycine max
  Peptide Sequence Number=SeqID_121398
atgcaaccacagggactcgcacagcctcctgagcctgagattggtccttcagttactcgtgtcaacacaaaggagagttttgttgatccctcagggaatgatccaaacacgggtgacttagacaaatacgagttgtacatcaaagaaaatcctccccgcctggttgccctgggaagagtttataagggatccacaactgctcacaacattcctttgttgcatgatcaaatcaaggttggtgttgaggaggttagagatgcagatgctcccattcttgtacccactgaatacgttatgttagtgggggaggcacttaacaccttccttgcttggccgacacatcttgtcaagcatttatcagaacagggagatgtgggaccggcaaaacctgcagataggccggatcatgatgtcaatgatcccttatatatgatgacattgaaaatcccacaagtttttctgaagccattgcaagttatgtgggatgctactgtgttcgggatgtttaatgaagacttccctttgtacataaatcatgaagatttgtttgaaatagcatacagtagtcaatgtcttagcatctctattatatag

SEQ ID NO: 29714 - DNA, 276 bp, Glycine max
  Peptide Sequence Number=SeqID_121399
atggcatattgcctagaagcgtcaaagacagtgatatatttcggtgtcgatatcggctctgttcatcgacccgactctgtttatctccgactaaaccgactctttgtcccgatccgaaaggttctgaaagaaagaagagttccattcgattatccgggctcattgcctagtccctctaaactatctaaagcctggggattctccttaccagatgatctccagcctgcattgtgcccctctcggataccctgcagggtcgacgtaactcttacctag

SEQ ID NO: 29715 - DNA, 366 bp, Glycine max
  Peptide Sequence Number=SeqID_121400
atggataagagcttgaagctatggttcatcccactaatccaagatcgagtccaagattctccactaagtgtgcttaggtgtcatgaggcatcccatggacatgaaatctaccctaaggctcatgagaacctagggccttctttttcatctctggcccaatcttcttggagtcttccatccaatgcccttaggggtaggattgcatcaaacatcataatggtgtcattaagtgatgcaatcctcccaaggaggggacccatcaccagagccatggctaggagacttcaagaagattgggccagagatgcaggggaagaccctagggttctcatgagccttatggtggattttggtcccatgggctaa

SEQ ID NO: 29716 - DNA, 384 bp, Glycine max
  Peptide Sequence Number=SeqID_121401
atgagggttcactgtaatcaagcaagtcgaagacctagcatgaccacagattcacctccactccttatgttctcatggacccggaacataagaaaaaaagacaaagaaaaagaacaaaagggaagtcagagtaaagaaagcacactgattgattggcctaactctctaacaatagtccccagtggagtcgccaactgtctcaacctacccttcggcgggagggcgacgcgagggctcacaggtgcatcttccaagaaaggaaaatgcgcggagtcgccaccaacgtttattcaaggaaaacatcggaaaacccggaaaagacgtggtctacgaactttaagtgaaaggttcgggagttgtatttacgcaaggggaaggtattag

SEQ ID NO: 29717 - DNA, 282 bp, Glycine max
  Peptide Sequence Number=SeqID_121402
gaactagctcagcaaaggccaattatgagtgtagagcagttcattgaaaagaaaaacgatcactcatctaaagccatcatccctgaagctgttgaattttcaaaaagaaaattagagacgagatccaatgaggttgctcatcctggaccagtgccagtaccagctgatgtaccatttccaggggctctggacacttctcctccaactacttcagtattgcatctgacagataaggaggatgttcaggcacaggatacccaagaccagttacaagaattttga

SEQ ID NO: 29718 - DNA, 471 bp, Glycine max
  Peptide Sequence Number=SeqID_121403
acacttgctagcattgccacacctcttgggcttgagtttattcctcaagtaaagaagttgttggatgagggtttggttcgcaagagcttaaatccttgtgctttgttggtgcccaaaataggtattattaggcaccaaatccctaaaataggtggtatgatgaatgttttgagtggtgcaaccctcttttgtaaaatcactcatgcacccaacatcttcatgatttgtgtacatagggacccattaggtagtgatcaaggggttcccatgaaccctaagagaataaaggtcattcctgagtggcccactccaccaagtataagaaaaatttggggcttccatgacttaacaaacttttacaaaagtgttgagggaaggagcccagagtatgaaaaacctcgggatttgaggtcaaatcctttccaaggtggagggaatgatgcaatcctatcccgcaagggcattgggtag

SEQ ID NO: 29719 - DNA, 228 bp, Glycine max
  Peptide Sequence Number=SeqID_121404
atgacggtgaaaactctgacacatgcagctcccgggagacggtcacagctgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 29720 - DNA, 246 bp, Glycine max
  Peptide Sequence Number=SeqID_121405
atgggggtgcaaatagaaaccagacccacttgggccctccaaaaggcggttgcttctggaggaagtcaccttgctcgcttgggcgagctgggtggcaagcatctcccccattttcctataaatagggggagaaatgaagaagaatttcgttcaggcctcctggtttccgtggggattttcgcgaagatcttcagccgttcttcgacgttcttcgttcgttcgtcattgttcttcggtcttcaacga

SEQ ID NO: 29721 - DNA, 267 bp, Glycine max
  Peptide Sequence Number=SeqID_121406
ttactcaatcccacagaatttttagggaacattgtggttgaacatgattatgctgagtgcactggatctgctattcaagctttagttttgtttaagaagctatatccaaggcatagggagacagagataaagaattccattgccaatgtagttcatggtatggaagttggggagtttgctacatttatggcacttggtttgcactacgtggtcttgcagcggcgagtaaaacttacactacttgtgctcccattcacaaagccgtaa

SEQ ID NO: 29722 - DNA, 348 bp, Glycine max
  Peptide Sequence Number=SeqID_121407
atgaacggggctaagcgatctgccgaagctgtgggatgtaaaaaagaatcggtaggggagcgttccgccttagagggaaggacccgcgcgagcagtgctggacgaagcggaagcgagaagctcggcttgagtaacgcaaacgttggtgagaatccaatgcctcagaaaaccctaagggttccttttccgcaaggttcgttccacggagctgggagagaaaatgcctcgagccaaagttcgagtaccaggcgctacagcgctgaagtaatccatgccatactcccaggaaaagctcgaacgaccttcaacaaatgggtacctgtacccgaaaccgacacaggtgggtag

SEQ ID NO: 29723 - DNA, 225 bp, Glycine max
  Peptide Sequence Number=SeqID_121408
agagaagatcgagaggcatcaaaatttcaaccatggaaaagattccaagaagactttccaactcttagatgctacaagtgcaaccaacttggtcacatcaaagcaaattgcccctcaaacgagcaatggcctgagaagaatgagaagaaaagtcatgaagaaagaagatccaagaaggcgtatattgcatgggatgacaatgactcatctgatggttcggactag

SEQ ID NO: 29724 - DNA, 756 bp, Glycine max
  Peptide Sequence Number=SeqID_121409
aggaaaagaaagcaaaagcgattcccgtagtagcggcgagcgaaatgggagcagcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggggtgaaatgccactcgaacccagagctagctggttctccccgaaatgcgttgaggcgcagcagttgactagacatctaggggtaaagcactgtttcggtgcgggccgcgagagcgacgatggggataagcttcatcgtcaagagggaaacagcccagatcaccagctaaggcccctaaatgaccgctcagtgataaaggagatgaacggggctaagcgatctgccaaagctgtggggtgtaaaaatgaatcggtaggggagtgtaccatcttagagggaaggacccatgcgagtagtgctggacgaagcagaagcgggaatgttggcttgactaacgcaaacgttggtaagaatccaatgcctcgaaaacccaagggttccttcgtaaggttcatccacggagg

SEQ ID NO: 29725 - DNA, 783 bp, Glycine max
  Peptide Sequence Number=SeqID_121410
gcagagatgaagaggcataacttacacaaacacctcgccaatctccaagacggaagcatagatgtaactgtggtgaaggagttttatgctaacttatacagcccggaagaccagagccctaagcaagtgagggtaagagggcatttaatcaagattagtgctgacagcctgaacaccatcttagagaccccagtagttttggaggagggtgagacacttcctacctattccagatttacgaggatgaggattgatcctcaggagtttgctgcccgtctctacatccctggtaggggttttgttctgaatgcagagggccatccttggaagcttctgaggaaagatcttaccactcttgctcagacgtgcagtgtcttctcctacaacaacctgactctcacttcccacacctctgatcttaatatggacagagccgggttggtgtacggattagtcacgggcatggacatgaactttggagccctaatctcaggtcagatttctaccattgcccaaagtaactcctttaggctcgaattcctagccttgaccactactctaagtagagctagaggagttaccactgatagtctgacctacgagagcctaagcccagccattaacttggcctacattaagaagaactgttgtgatgtaagctccattggagcttgtaggcctaggatcttcttcgtcaatggattcctttacttcttggatgatgaatggcagcgaaatggagaaggaagagagagaggagacgccacttcaaggagaagatga

SEQ ID NO: 29726 - DNA, 165 bp, Glycine max
  Peptide Sequence Number=SeqID_121411
atgccaaagatagggggagattgtcatcatcaaaaagggggagattgtagacaaaggatcaagctgaatgttttgatgatgccgaaggatcacatgcttctcaaagctttattcaagacaaagaaattaaagatattcaagatggatgatcaagacagtctctag

SEQ ID NO: 29727 - DNA, 579 bp, Glycine max
  Peptide Sequence Number=SeqID_121412
atggagaaggacattccgtgggacaagttcgacgcttcgctgctcaccgacgagcaggcgaagacgatcaagatgaacgcgatcaccgaatggtcggcgctgcccgcgacggagaatgttcctgcgcgacaaccagcacgccagcgacttttccgcgttcatgagcgtctggttcttcgaggagcagaagcactcgctcgtgctgatggaatacctgcgccgcttcaagccggagatggtgccgaccgaagaggaactgcacgcggtgcgcttccagttcgatccggcgccgccgctcgagacgctgatgctgcacttctgcggcgagattcgcctgaaccactggtaccgctgtgcggccgactggcacaccgagcccgtcatcaagcagatctacgaaacgatttcgcgcgacgaagcgcgtcatggcggcgcgtacctgcgctacatgaagaaggcgttgaacaactgcggcgacgtcgcccgtgccgcattcgcgaagatcggcgtgctgatggcgtcggcgcgccgcaccgagaagccgctgcacccgaccaacctgcacgtgaaccaggcgct

SEQ ID NO: 29728 - DNA, 192 bp, Glycine max
  Peptide Sequence Number=SeqID_121413
atgaaggaaaacaacaaaggatccccagtggagtcgccaactgtcgcaacctacccttcggcgggagggcgacgcgtgactcgcgggatgcgtgttccacgaaaggaatacgcgcggagtcgccaccaacgtttattcgaggaaaacgtcggaaaaaccggaaaagacgcgatctacgaacttttaagttga

SEQ ID NO: 29729 - DNA, 517 bp, Glycine max
  Peptide Sequence Number=SeqID_121414
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaacgctgcgccttatccggtaactatcgtcttgagtccaaccg

SEQ ID NO: 29730 - DNA, 335 bp, Glycine max
  Peptide Sequence Number=SeqID_121415
atgtcattgcctagcgctgttcatgtgtctccattatcatgtgcgaagcttctggtgactgggaagcacaaggaaaaagaagaagtagaggtgagagtcgtcatcgcgaaaagggcaggacggacgaaatcagtgtcctatctttggtttcctcttatctccgatgagaggcttgtgcaatccgtgaaattccgtaatatggcggaagtcgaaaagaggttcctccagaaggctgttgcttctggaggaagcaaccctgctcgcctgggcgagctaggcggcaagcatctcccctattttgctataaataagggaggaagtgagaaggaaaaggg

SEQ ID NO: 29731 - DNA, 330 bp, Glycine max
  Peptide Sequence Number=SeqID_121416
atggtggttggtgtggcggttaacagtggatgtaagatggacgaagatcattggatttatgataacataatgtttgaagaagttgatatgaatgaagagaaacttggtgtgaatgaagaaaatgtagaagaacctggtgtgcatcaacatgtatttgatacccatgatgatgttttgcattgggctcaatctgttgtgtatgatattggttttgtgatggtgattatgagattagacacaaatactggagttagaggaaggaccttatttattttaattggttgtgaaatgagtggaaaatatagggataggaagaaagttttaatatga

SEQ ID NO: 29732 - DNA, 1863 bp, Glycine max
  Peptide Sequence Number=SeqID_121417
atggatttgtgtttgctcaagaaggtggagatgatcctaggctacaaatttagaaacaaaaagcttttagaagaagctctcacccatccctccttcaccaaagttgtctcctataagcgcctcgagttcattggaaatagcatcttgagtgctaccttcaccgactgcctctttattctttacccttttttcaagcttggccaacatctgcaccaagaagcttgctcgcgttaccattactactacaaaatgcttgatctcacacataagacatttccgtgcatgtccactaaccatgccatgtccattatacttctttgggacatgctaggtgcacccaacaatgttgttggtgcacccactgccattgttgcgttgctgcgaagcttccgcggtgctgttgctacgtttctgtcgtcgagggtagaagacatggaaatcgcctcaaaatggagaagagcaaccgttccgatactcccggaagaacttcttccgataacttctctggaagaaggttcttccagtagaacaaaagttcttccggagaagcttccggaagaagttcttccgatcatggttagaacacgaggtttaggtcatgttttagctagggttataggcagaggtagacaggatgagcatgatgcagtcgatgttccccagaggcgtaggcctactgcatcaacccgtaggcgacgagtacatattacggttgataagggtgttcctcaggtgactgaggatgttcctcagatgagtgaaaatgcgcctcagatgactgtggacatagatgcgactgttgcagaggacttaggtcgtgatggtgctgaggggtcacatgctgatgagggattccctggtgggccctgtgacccatcagttctgacttcatttgcggagcatgagcgtcctgagctaaagttggtgtcgcacaggaggaaggtggcattaattgggaagccagtgcctgcgattgaagggttggttgtcaccacaggattaagtccattgatcgagtgttcagttgtaactgacgatcctggacttatatccgcatttgtggagaggtggcacagggagactagcaccttccaccttccagtaggagagttgacgatcacactatatgatgtgtcgtcactcctccatctccctatcagtggtgccttgcacaacttcgaggctctttccgtggacgagacgatatttttgttgattgagttgcttgaagtgtccggtgaggaggctagagccgagacagcttttcgcgacatgggtcagagtgggggctatgcctggggagctgcggccctggttcatatgtatgatcagttagatgaagtttctagaaccatgacatggcagattggggggtgctggatctatgagcatttttcaagtgtgcatcagtgcatcatcaatgatgcgtatgaggagacgtcctctcgtgcctcccggtggctgacgatgaaggctcatatgaagggaattacaggagcgttgtaccgggcacgttgtgatgctttgacagtcacagacgtgtgctggttgccttacagtgaccatcgagggctgagatggggtcctatggtgctcacagttcgaccggagagggtgctacgccagtttgggtacattcagagcatccctccaccgcctgatagcgcttcgttgtcatatgatgatatagatgacaggtggatgcatttctcagaccacgtagtagttgtgagtgacctttgtgtagtgcttgggcaggtatctaaagattacatggagtggtttttccagacatttcacccattcatgataccgacccaggcaggtgaccaacccagacatgatccctctgccgcctgttag

SEQ ID NO: 29733 - DNA, 1134 bp, Glycine max
  Peptide Sequence Number=SeqID_121418
atggcatgtgctccagataacatcaagtctattaatggatcaaaagagacacttaaacttgtcgtaagaattactgatctttggtttgttgggactcccaacaggtctgaacaagcggaaatggtcataattgattctcatggagatgcaatccataatgatggtcaatttagaatctgtgatcaccggtataaattagtttttactggagctactgttgtgaggcaatccgatttggaagatcttccttttaagaaatataaatttgctgatttcaccaatgtcattgttgggctcttccaacctgagctattggttggtggtcttccgccatgtgggatcaaagagtacaagggttgttttcaaactcaaggattagagttcttagactacttgaatgagtctgaaaataatgtccccatctgcgcgaatcaaagaagcccaggggcctccaaattattgatcaatgaagctgtgtttgaaattcaagaatttaggaagaggtttgttggtcatggccttggtcctgtatttataaactttctgaattacatgggagttcgcagctttcaggttcaagccaattgtcgtcaaaggatgcatttctttcaaaagctgaagcaaagacaatatgagattaacaacatttttgaggaaattgtttgtgttactgttggcaccattaatagaattgttatggataaccattcatggtgttattcagcttgcagttactcctacaaaaaagttgatgttgagacagccgcattcacatgcgcatgtggaaaatataatgatcaacctgtgctgaggtatagacttgaggtgatggtcaaccacaaggaggaaagcacaaaatttttgctctgggaccgcgaatgcactgagctgattggacaatcaacaaatgaagagggtgatgttgatttaaatgtttctcctcaagcccttgataagttgttgagttatgtccttgcatttaaagtcaaagttcaacccaagtttaacaatgttgttgttcttagatactcaaatgacatagatttgatcaatgctgtggtggacatgttgcctgatgctgaggctcctatccttgactccgatgatcctttccaacttgaatctgtaagttga

SEQ ID NO: 29734 - DNA, 204 bp, Glycine max
  Peptide Sequence Number=SeqID_121419
atgacgatcttggactcgttcaccgttggattgtcgagaaatttgagcaccacggagaaaaataaatcgcatggtgacagtacaagtggaggcttcaatcccttctctgtctctttgacgtttaggaattctatcggagcagctagaggaaaaaaatttgaggaatctcagagaaccgctagagatggtgctatcgctggctga

SEQ ID NO: 29735 - DNA, 249 bp, Glycine max
  Peptide Sequence Number=SeqID_121420
atgaacttggatgaagatgatgctgtaatgggtgatgctactgctagaagtgacgctacaagtgatgctattgctggagaagctggtgttccatttttctatcgggcaggatcagaatttgaggagattaatcaaaatagtcatcaggagagtgcctttgcttgtcatcatgttgctgctggtcatgctgctgctggtgctactgctgatcctgatgctggtggtgaggttgttgttgttgatgaataa

SEQ ID NO: 29736 - DNA, 434 bp, Glycine max
  Peptide Sequence Number=SeqID_121421
atgaatcttagggtagaagacgccggaaaaaatggcggaagcttggtgacggtgagccttccggaagacccgttaggggttcttccagaacttccggaagaagatcttccggaagatttccggaagaagggttctttcggaagtaatgaaacgaattccggaagaacaggtcttccgaaaagctcttggaacacctcttccggaatgtttccggaagatgtacttcttccggaaacattccggaagagggttcttccggatgaccttttagttgttccggaagacccttcttccggaatgtttccggaagaaatcatggtcagaacacgaggttttggtcgtgccataggtagagttgtaggcagagataaacctgctgacgaggatgctgccgatgttcccgagaggcgtaggcctactatctcagctcgtag

SEQ ID NO: 29737 - DNA, 171 bp, Glycine max
  Peptide Sequence Number=SeqID_121422
atgacttatccatgggcatctttgatgatgttgggaagaggaaaccttgtgttgatgttcaatgcaaattatggagtgcaaaaggcaaaggtggtctccaaaggtggccacatggtcgagaacattgagaattgtattttgaaaaatctcatgcaaaaagttccaccatga

SEQ ID NO: 29738 - DNA, 204 bp, Glycine max
  Peptide Sequence Number=SeqID_121423
atgtcatcctttcagaagttagagcacaccatacaaagacaaagtggtggggatggaggtgtctatgggggaattgttgtcactgaggacatctatccatctgctgatgaagaggatgatgaagacgtgatagatgtaccctttaaaccctgcccaaatattccggtggatgctgagaactatgataggtggtgtaggccttga

SEQ ID NO: 29739 - DNA, 561 bp, Glycine max
  Peptide Sequence Number=SeqID_121424
atggtttcaaggtatgctttaaatcagattgttgttgagtttgagcatgtacattatgctggcaagaatccttcttcttgtggttgtttcatgagaactacgcaggtcttccttgtgcatagtaaacttcgggaaattgcataccctgatcaaaactccatgtgtcctcctccaacaaaggtcaacactaaaggtgcaccgaagaaaccgatgaacagaaaccaaagattaacaaagcatgatccatcttactgggagtatgttgatgctttacattttttgcaaaatagcaattcttcagtgaagcgtagtgcatcatcttctgaccagcccaatccaagaaggatcatgccgatgttggatcaatttcagtcatttatacacgatttcattgactatattgtggatgtcaaagctgacagtaactgtggatatcaatcgattactgctttattaggtatgggtgaagattgttggtccttgacttatttaaaagatcgttgtcctttaccgcctctagcattgttatggtctaggaattgtcatcctcaggcaaagtag

SEQ ID NO: 29740 - DNA, 1617 bp, Glycine max
  Peptide Sequence Number=SeqID_121425
atgactgtggtctttatgatgcccaaaatgcccacattccaggcaagggccaagctagatgcacctagcattattgctgtcgtgtcattttcgttggcccttggagcttcttctcctccgttgggtgtcagcattgaggacatgcatttggctactccaccgtcgaccgtcgagatcatggttaaaaccagagggttaggtcgtgccttaggtaaggttataggcaaagccctggggagacaggatcatcatgattcagatgatggtccccagcgacgaaggcctacaacatccgcacgtaggcaacaggaagttgcctctgttgctgaggatgagcctgtggtagctgaagacgtacatgcacatggtgcagaagctggtcttgatgctaagggatttctaggtgggtcgcgtgacccatcagtactgacggagtatggtgaccatgttgcagtcatcgtatggaatggagaggaacgtcctgaattgaaattatcctcccatggcaggaaggttcaaaaattagggaggcctgctccagaaattgaagggctagtcgttgtcacaagattaagtcctttgatcacatgttcagtagacactggcgatcgggaacttatattcgctttcgtggagaggtggcataaggaaactagcagtttccatcttcttgttggggagctgacatcaccctggatgatttacttgaagtctctagtgaggaagctagagctgagacaatacagtgtcatggggcatacgtatgcctatcttggctatgagatatttatcagaggagatgtgaggccggacattggactgttgcaactcgtgcctattcagagtggaagctatgcatggggagctgccgccctagtgcatatgtacgatcatttgaattatgcttgtaagagcgaaggccgacagcttgctggttacatcactctattacaggcttctttgaagtccttacctgcatcgacatataggaaacgttcagtagttcggaagtttgggagtttgctggatggttgttggatgccctacgatgagcatcgaggagttcgagagtttgatttgatttcatgcttctccggacatctacgatgggggcccgttgtcgtgagacaccgcctagagagggtgatgcaacaattcagatatgttcagactattcctatagaggctacaggtttcaggttgtcatttgaagaaattgacgacaagtggatgcactactcagactatcttgcagtaacagggcagatttgtgttgtgccaggacaatgtgcatcagattacatggactggttcttcatgatttctcatccgttcatgacacctgaacagcctgcaaatccagcccgacatccacctgtcccaatggcaccagcagcaccggcacatgcctcttctgatgtggagcaacctagacatgtagtggttttccaagcaatcgcggaaaggttgaagcatctgctcaacctaaggatagtcacgacaggcacaaaaatacacaaggtcatggaagactgcatcaggatcgctaagggtgtcacaccatatgacaatgtttatgttagggcgcgacgaagacggcacacagatcagtcgtag

SEQ ID NO: 29741 - DNA, 621 bp, Glycine max
  Peptide Sequence Number=SeqID_121426
atgggggagaagaaaaagaaacaactggaggaaactgctaaatccaaaagtcctgacaacgtcattgatcctccatttcccatcagacgacatgtgaagtggaagatgacccgcaccaagaaaactagccaaatgacgtctgaggtagcaaaggaaattgctaacaagattaaaacattactttggactgactccaaggacctcccgcacgatcaaacaatactttggactgactccaaggacctcccgcacgtcttcatccatggctcccgaagacttggagtagctgacgcaaaaaatcagggaccaatgcaatcacggggactcgcactgtctcctgagcttgaggttggtcctttagctgcttgtgtcagtacaaaggagagttttgtttatccctcatggaacaacccagacacaggtgactcagagaaatgcaggttgtacatcgaagaaaatcctccccgcctggttggtgttgaggaagttagagatgtagatgctcacattcaagtacccactcaagaggttcagttagtggggcagacacttaacacctttgttgcttggctgacacatcttgtcaagtgtttctcagaacatatatttcactatcattaa

SEQ ID NO: 29742 - DNA, 2616 bp, Glycine max
  Peptide Sequence Number=SeqID_121427
atgagagcaggagtttgcagcatacagctacaggctctgacatcagaggctgcaaccctagttaaacaagctgttactcttgccacaagaagagggcatgctcaagtgacccctcttcacattgccactgtcatgcttgctacttccacaggccttctccgcaaagcttgccttcaatgccactctcaccctctccaatacaaggcattggaactttgcttcaacgtttccctcaaccgtttgccagcatccacaccaaaccctcttctgataagtcctccatataattccaccactactactccctcactttccaatgccttggttgcagccttcaaacgtgctcaggctcaccaacgccgtggatccattgatcagaaccagcagcaacccattttgactttaaagattaaggtggagcagctcatagtctctatccttgatgaccctagtattagtagggtcatgcgagaagctggtttctctagctcccttgttaaaacaagggttgaacaagctgtttcaatggaattagtttgttcacagcaacaagcttattccaaggaaaacaccaccgagcttcaagttcttggtggtggtactagcagcatgcccccttctagatcctttggtcattttggaggctcattcaagtctatggaggaccttgttcatgatgatgctggtgatcatgtagtagatgatgtaactagtgttttgagcgaacttgtgagcaagagaagaaacacagtcattgttggggagagtcttgctagtcctgagggaatagttaggggactgatagagaatttagagagagggagtgttcaaggagagttgaggtttgtacaatttgtgagtctccctcttgtctccttcaggaacattggcaagaaggaggttgaaaggaagcttgtggagcttagaaaccttgtaaaaagtcatgtgggaagagggtttattctatacttgggtgatctgaagtggttgtttgagttctggtcaagttactgtgagcaaagaacaaactactactgttctgtggtgcatatagtgatggagcttaaaaaattgattagtggaaatggggagaatggtagattgtggcttatggggattgcaacttttggaacatacatgaagggccaagcatgtcacccctcccttgaaactatttgggatcttcacctctttacagttccagtgttactatcatccttgagacttggtttaacttttgatagtgattttcaagttcaggagagaagcaaggtaacattcaaggacgaatcttttgaagaacgagccaaagtgcgcaagtatctaacttgctgcagagatttctcattaaattttgaaaaagaagctaaaagcaccactaatagtattactataagcaagagagattgcaccactaacttgccaacatggctccaaaattgcaaggaagagagaagtcgcatcatggagaatcaggaaaatgctaagcttagggatatttgtaagaaatggaactcattttgcagttcagcgcatggatttccttccaatcctgagaaacaattttttttcatttcatcctctccttcatcccctacttcagtctcttcacatgaaagaaagcttagtttgaatctgaaacacctaaattggccactcatttctgaaccaaaacaagtacctaaagaatgtgagttatacactgagactactgttagtgatgattcctatgaaggaaacttgataatgttcatgccagagaagaacattcctaagccagaccttttgtcaaatcccaattctagccccaattctgcttcttcaagtgaggcagtggaaggtttggacagcactcaaatattcaaggagcataatgatgaaaatctaaagattctctgtgatgcattgttgaaaaaggtttcacaacagaaagaaatagttaaggagattgcaagcactgtgcttctttgcaggtcaggaatgagagaaggagtgaatcacttagtgaagagagatgataggcaagaaatttggtttttctttttaggtttggattctcaagcaaaagaaatggtctcaaaagagctagctaaagttgtttttggctcttacagtaactttgtttccattggtataagtagtttctcttccactcatgaggagtccaaaaataaaagaccaagagatgagtttggtggcagttatcttcagaggtttggggaagcactgaatgagaaccctcatagggtgttcttcttggaagatttggagcaagttgatcatttttctaaaaagggtgttaagaaaggaattgaaagtggaactataacccttcctggtggtgaatctgtgcctctcaaggatgcaattgtcattttcagtagtgaaagcttcagttcagtgccaagagcttgttctcctgcaagaaccacttctccattttccgatgaagacatggaaaagaataatattaacaaatcagaggagaaaactccatgcctctctttggatttgaacatggccattgaagttgatgtgcaaaaaaatgtgcatttagatggagacactgctgagatactagagttagttgataagcaaattaattttaaaatatga

SEQ ID NO: 29743 - DNA, 279 bp, Glycine max
  Peptide Sequence Number=SeqID_121428
atggttcttgctgattcttctcctttgcatggagtttcttggaaatttctcttggttgatgaaggccatcgacgaaagcatttccatttttcctcagatctgcaaaacctcatagcccctgaacatgggaaactgctgcgggagctggcgtgcaagtcaatctcgaagaagaagctttgtacggtgatagacatcgacgacgtcaggagggaggtggagatcatgcgccacttgcgtcaggagggagctaaccttgaaggatacctacgaggacgataa

SEQ ID NO: 29744 - DNA, 330 bp, Glycine max
  Peptide Sequence Number=SeqID_121429
atgaagaaaatccgcaactcgatcctactcttatcaatctttctggcagtttcagcagcggaaccgattccttccgccgcctacgaccggatgctgttcccggaccgccgatgccagaagtcggtgtcggagaacaagacgcgaggaggatcctcggcggcggcggcggcggcggatctgatggaagttagttatcggtatcctctcgccaagaccggtattcgatctggatcgacacggggagtccgcctttgcgatcagagcagccttgaacgcactttcccatccaggttaatactactagcttctttacccgttatctgcatctaa

SEQ ID NO: 29745 - DNA, 540 bp, Glycine max
  Peptide Sequence Number=SeqID_121430
atggtgggatgttcatttatcaaccctttactctgcatatcaatggtcatatcgaagaagaagaatggggttgggatgtggatactatgtcttatattgacttcaagaagaagattaactccctcgggaccccagaaaagcactgagcagagggtgattgacacatcctcaaaaaagttgaatgatgttgaggatgacgacgttgttgtaattgatggagtggaggctcgggttgaagttgtggcagagggtgaagttaaagcagtggtggagggtgaaattatggctgaggggcaagttgatcaacaggctttggttgaggtggagcctgtagaggagactaatgttcaagctcaaatggaggctgaagttcatgctgaaggggaggttggtgttcaaggtgagatggaggctgaggctgaaggggaggctagtgttcaagctgatgatgttgaagctgaggaagatgatgatgatgatagtagtgagtatagtgaagtttcagatagtgactttgaagaaaattgggattggacataa

SEQ ID NO: 29746 - DNA, 225 bp, Glycine max
  Peptide Sequence Number=SeqID_121431
atgggtgttaaacattttgaggtggtcaaacgaaggtcacatgccgacaaacaatggtccctggacaaaattaggacacaacaactgatcgtgaatgggaagtcagactatgagtcccgatcagtgagatattcattccctcctgtatctgttgaaccatctattgctcctcatcctaaatcatatatggagtttactatgttgttctttgtttgttggtactaa

SEQ ID NO: 29747 - DNA, 576 bp, Glycine max
  Peptide Sequence Number=SeqID_121432
tctcggtcggaagatgctgacatctccgaggaaggtgtagatgacgactctcggccggaagacgttgacatctccggggaaggcgtagatgatgacgtgcggataaccataaggtatctctgcatgtcatcggacttgccgtctttggatgacaaaggtgaagatgacgatatgacaaaggtgcaaatgacgatgttagtcactgcgtgtcaacgggctcgcttgcctctagctaaaaaaggtgtggataaccataaggtgtctccgcatgctaacggactcactggtcacgatagcaaaaagtgtgcgcggataaccatcagtctctactggaagatgatgacatctccggaaagggtgcagatgaccacattggtctctgcttgtcaatcagacttggggtctccgaatgacgaggtgcggataaccataaggtgtcttcgcatgctaccggactctcagcacgttggccgtttaacagtgaatggctcttctttcttgggagatcccactgttccttcttccgaggacagggatggaaattctcatcctgggtcaaggtttatggtggtttga

SEQ ID NO: 29748 - DNA, 261 bp, Glycine max
  Peptide Sequence Number=SeqID_121433
atggtgacaagtaaggtggaccgctataaagatgtattaaaagagaaggatgacttggcagttaaggtggagcactctgctaaggagagggaagcactcgatgccacggtgacagaaatttcagctaacgaagtagaaaaaaaaatggctaagctcaagcaacgaacaaggtcatccttaaagtcctacacacgagacttgacaaatcaaaaggcttatggaaggaagaactccctgttggatcaagtggcctcagaataa

SEQ ID NO: 29749 - DNA, 1002 bp, Glycine max
  Peptide Sequence Number=SeqID_121434
atgacggaaaaggaggcaaaggagaacacaatgtgcgcattggttcagttatcacaaaacaaggaggaagaggaggcaatgatagggagggctggagcgattctgcatctagtgaagcttcttgaaggagaaggattacgtggtgaaattgagcaaacagaaaatgtagatcagcataataggggagaagagcttggtaaacagagtttagacacatcggtgtttgtgaactcagagccattgcgtgaggcacaaattcataatgctgtgaaatttttgtcgcacctgaaagttagaggttctcctgtcacccatagacgatcatttttggagaagaagggtcttatgaaggaggagattgatgaagcctttcggcgtgtgcctgattcacctctaagtgtgcagacatctggcataaatcaagttggattactggctgcttcaggtgctggtacaattatagtaattaagaattctattctccctcggttaaaatcttggatacacaatgttgtccgagaaaagggtcatgaccaatcaaagagaacaagctcaaaaccaacattggcagaagaggctgcacaggttgcaaaagcagttgcagttgcagttgcagatgttgatattgcaaaagcaagccaagaactactgagttcaaaaattgaagagaagagatattttgtagaagttgtgaaccttttggataagcaagtgcaggaaatgaagttgatgactaatgcaataagaagattggaagcttctggtggactctctatctcaaagcaagaagactactgtcgcaacctacccttcagcgggagggcgacacggggctcacgggtgcgtcttccaagaaaggaaaatgcacacagttgccaccaacatttatttgagaaaaacgtcagaaaaaccggaaagggtgtttccctcgctcctacatatcctcaattgcgaggaggaaatcatacctacgtagttctttcagaactaaacgttggttaa

SEQ ID NO: 29750 - DNA, 948 bp, Glycine max
  Peptide Sequence Number=SeqID_121435
atggagcttgcatcactttgggggttccatttaacaacctatagtagagtgggaagtggttcccatcagagattcttcgttggaggaggttccttgcaaggtagttctgggctacacgcaatgatagaatctcccatagctcttacggaggatcaatcctcccctattatgacaatcttgccctcacccccgtgggagaatccagtgatagttgaggccacaggaagagacgatggcaatgaagttagggtttctagttctgaagagacgccgaggagtaggtgttgccatggtggcaatacaccttctccttctccatgcatcaacaatttcaagtgggtgagggatgatgtcctaaagtatcatttgtcgataatgtcttccttgagtgttggtttcttgtggtgtcaacttgacttgacaaagcatagtgatgctcataatatgactttagtggcctgtgaagaagataagtacccttttttatgcatcctacccttgatggtccccattatttctatgtttaccggtattgggcctagcgttcctgtgctcatggcaattagtgttggttgtagattcaaggatcgtttttttaaggtcaaggcaattagtgtcatttctgatgggttgccattgatgtatgaggagagtgggagccttagtgtagaagcaaagcttcatgatgaatcaagattgattcaaagatgttttgatgataacaaagatgataacaaaggtgatgacaaaaagctcaaagaacacttcaagactcaaaaggaaaagttgaagaaatcttcaagattcaagaggaaagttgaattcaagaatcaagaatcaagattcaaggatcaaacctcaagaatcaagatcaagattcaagattcaagaatcaagagaagacttaatcaagataagtatgaaaatgttttttcaaaaactgagtag

SEQ ID NO: 29751 - DNA, 1899 bp, Glycine max
  Peptide Sequence Number=SeqID_121436
atggaggccctgaagagacattgtggtggagaaacaccttctcattctccatgcattaccgatttcgagttgctgagggatgatgtcctaaagtatcattcgttgataacgtcttccttgagtgttggtgccttgtggcatcaacttgagttgacaaaacttggtgatgcctataagatgaccttagtggcctgtggagaagatgagtactcttttatgtgtctttccattaattgtccccactatttctatgtttaccagtgtatgtttgaagtgttgcatttgacccttcccttgaatgactttcaatgtgctttgctgaggcgcttgaacgtggtcccctcgcaactacatcctaatagttgggcggtggtgagggctttcaagattttatgcccattcttcaacattagctctagtgttcgaataatgggtgactttgagtggtggcctttagtgaagcaagtcagacctgttgatagtgacgtgccccctcccccattcagtgtcaatgaaccctctagaggggctgccaagaggaaaataagtgaagagaatggaggaactggactacgcaagaacccttatgcatcggccactttcgctcttgaccctgccgcatttgctcctatttcttctattgcactgccgctacttagtgtaggactaacaacgaaaagtgtcataacaagcatgcctcctccttcctctattgtgccacctttaactctcactatcccaaattccgggatgccttcttcctcttcttgtccaattgtttggcctgagaagaggatgcacgcaggcttcgtggccccctttgaagaaaaattgattcgttctatttgggtgcaaaattcgaataatgttgcgaaggtttcccttcagaggaggaagtttccaagtggagggccattgtcaggacaatatggcgagtggagcgtgccaaggtggaaaaagctattgttgcctttgctgaggctgtcaagtcgaatcaccaactgtagtccagggtcgacgatgtttttatcaagtaaggtggaatactctgctaaggagagggaaacactagatgccacggtgacaaattctgcaagagtgattgttgatcttcaattgagggattatgagcttgcggcttctaacctccaggccatgctgaatgagggtgaaggaggactattcacagaggatctcgatttgaacctctttgacctattcaaagaagtgaaggacaaacaacttcttgatgaggatgggattgttgttgtggaggaatctgatggaggagaggaggatgatgaggctgataatatccgtgaagcacgattcttaagcatggagaggctcaccaaggatgaaccttggcctttggagattcgaccaggaacatgttcatcttgggtgtggcaagactcaccaaggatagaccttgggtttgacgagcttctagagattcaactaggaagacgtctttggagattcgaccaggaacatgttcgtcctaggcttgccatgaccttgaatgggccttcccaattaggtcctagctttcttgctcgtggaattttccttgcctctcctcagactcaccatactcggtcaccagtctcaaaggtgcggggccggactttggtgttgtatcttcttgaggcatggagcctggtagcttcttccttgattgctgcaatctcttggacttcttctcttatatcaaggatcatggcatctattccatatgtaagacaaaaggagtctccttggttgttgtttggggcgaatagtggtgatgacaaaaaagctcaaaagtcaagaacacttcatgataacaaagatgatgatctcaagaatcaaagaataagttcaagatgttcaagattgaatcaagaacacttcaag

SEQ ID NO: 29752 - DNA, 292 bp, Glycine max
  Peptide Sequence Number=SeqID_121437
ttcgtgggttcgttgtgaacggttaagtgcggtgaaggtgaaggtaccggtgttgagcgttgcggtgatcagcggcggcaaacaaggtacgcagaagatggacgaagatgagtggatgtatgaaataatgtcggaacaagcggatatggattatgaaaatgaagaagcatgtggtgcgaatgaaccacatgttgattgttccgatgcgtttaatacttctcaggtgtttgagtgccgagaggatgttttgcggtgggctcgatccgttgctcatgaaaatggatttgtgggg

SEQ ID NO: 29753 - DNA, 190 bp, Glycine max
  Peptide Sequence Number=SeqID_121438
atggctggagcaggtggtggtggtgacgagtatcatcagttggacggagctcaacgtctgttactggatgcgatgaatgcacagatgcaacgtttgttggaccgtaccaatgaggaggtctatgggcgactaaaagctttggagaacgaagccaatcagaatgctagacgaaatatagatgggaatagag

SEQ ID NO: 29754 - DNA, 408 bp, Glycine max
  Peptide Sequence Number=SeqID_121439
atggctaatgattaccttcacaatctacctgtcaaacaaactaacattttcactaacgccactaattcatgggtcccaggagctctgcactgctgccatgtctacaacataatatgtgtctgcagcaccgtctcctctttaggtgcctcagatggtgtagcagcaggggtaatctatggagtctcctccgcggaggtgccggagagtattggaggtgcaggaatgggagctggtggtgctagtggagttggagcagggggagctgaagaagaaggagttgaagtgtctggtggtgctttgcgggtccccgaaaaagtgagggagtctggtactactcctctagctatgcacaaggcaatgacgagtgcaggaaaacctagtcgacaggagttggactgggccatctaa

SEQ ID NO: 29755 - DNA, 414 bp, Glycine max
  Peptide Sequence Number=SeqID_121440
atggaaagtagtatagttgatgcttcaactgcttcaagaaaacgtagaagagatgaagaggaggacgaagaacttgaacaagcatttttcattattgttagtgttgccactatgcttttggatgcaatgacttggtatcatgacaagtactttgttaaggaacctgctcgaaatttggaattagaaaggcatagcttcctcaatcgtctatacatgggaacagaaattgattgcattgaacaattaaggatcagtaaaaaggcatttttaagctttgtagaattttacaagagaaagggaaattggcaattcaagaatgtcttgcgagctataatgaaagtaagaaaagaatatttgaagttccatgactataatctagagggctcgatggaaaacaaatggagatggtttaag

SEQ ID NO: 29756 - DNA, 207 bp, Glycine max
  Peptide Sequence Number=SeqID_121441
atgtataaatgccccaggtgtggggtatcacggtataaagtgaaggatgataacgagtgcagcagtgatgaaagcacaaagaaagaccctccagcgaagatgacgcaaaaaaccttagatgacatgcacatcggagaaactacaatggaatgctttgccatctggttgattcctcctagtggaagaagattaatcgtttgtatttga

SEQ ID NO: 29757 - DNA, 690 bp, Glycine max
  Peptide Sequence Number=SeqID_121442
atgaaatcatattctcccgtatcgctacatgcaagggagtttcctgctgcaatcgcagttaagacagatctcaatggaaaagtcattactaatgacgaagataaggagattcctgatgctattaatacattaatttttacaatagctcaaaacttcattggagacccatctctgtggaaagacaggtctgcagaattgttgtcaaaccttaagtgtagaaccttagcagactttaggtggtacagagatactttcctaactagggtttacattagagaagataatcaacaatcattttggaaagaaaaatttctagccggtcttccaagatcattaggagacaaggttagagataaaatccatagtcaatcttccaatggtgatattccacatgagagcttaagctatggtcaattaatttcttatgtccaaaaggtagccttaaaaatttgtcaggatgacaaaattcagaggcaattagccaaagaaaaggctcaaccaaagaaagatttaggttctttctgcgaacaatttggtctaccggcctgtccaaaagaaaagaaaaaacaatcctctaggagagaaatccatgacagtaaaccagtcaataaaaagagatttccaagaaggagatactcacacaaaccttcaaccagtaaagaaatggaaaatcctagacaaaataaataa

SEQ ID NO: 29758 - DNA, 129 bp, Glycine max
  Peptide Sequence Number=SeqID_121443
atggataagaacttgaaggtagaagaagatgaggggaaggagaaggagggaaggagcacgaaattttgtgcctcaaatgagcccactaatccgagatcaagtccaagattctccactaagtgtgcttag

SEQ ID NO: 29759 - DNA, 174 bp, Glycine max
  Peptide Sequence Number=SeqID_121444
atgagcaagaggctccaagaggattgggctagagttgataaagaaggccttagggttctcatgaaccttaggcttctcaaggaagttttctcaaagaagcttctcaaggaagttttcttaagaaagcttctcaaggaagttttcttaagaaagcttctcaaggaagctacctag

SEQ ID NO: 29760 - DNA, 90 bp, Glycine max
  Peptide Sequence Number=SeqID_121445
atggataagagcttgaaggtaggagaagatgagtggagggaaagggagagaggggaacaaaattttgagagagagaagagggagaatgag

SEQ ID NO: 29761 - DNA, 267 bp, Glycine max
  Peptide Sequence Number=SeqID_121446
atgtctatatgcagtggaaagcctctaaagcgtaggacatcaaaggatcaatcttcgaaaaatgcagtgggcttagagtcttcctttcctgcaggagagactgatatgttggagaaggatgatgggatttctgccacaattattcgatcacatcctgaccgagactctgtcccatcaatgtctgactgtgatcaagcagtgcttcagtttgccaagacaaggaagttgtcaattgagcgtcctgacccacgaaagtatgtcctatag

SEQ ID NO: 29762 - DNA, 501 bp, Glycine max
  Peptide Sequence Number=SeqID_121447
atggcagaaccattgaagaaacgaaagggttcttcgagtagaagccaacagagctttgggtctcaggatactcgaattccaccatccatttcgtcctccacgttgttctcctttgaagagcaatcatttcagaactccggtcttattccgtttatgtctttaaaaattcttgtttatcctgagttagtgaaagttttttattcaaacttagaaattcaagaaggttccttgatttctgaggtatatgggattaagatggtcatagaccagtcccttttctttgaactcacccagttatccagtgatggtgtaccgtttgaaggtacacttgatgatgattggaagttcgatttttctgtttctgatgcccaccggttggtttgcatcagccaagcggatatgaccggaaggcttcttgccggctcattggcatttgattgtcgcatcctccactatcttaatgttcgcatttttcttccgagatcttcaaaccttgcacag

SEQ ID NO: 29763 - DNA, 678 bp, Glycine max
  Peptide Sequence Number=SeqID_121448
atgtgtaagatatcttttgttgcacactcggttggaggattagtggcacgatatgcaattgggaggctgtataggccacctgaaaaaggatctatggcagactcgtgcaatgaagaaagtaaggagagctctgtgggtacaataggtggtttggaggctatgaatttcattgctgttgccgcacctcatctaggatcaaggggaaataagcaggttccatttcttttgggggtacctgcttttgagaaggttgctagttgtgttattcatttcatttttagaagaacaggtcggcatcttttccttactgatgatgatgaaggaaaacctccattgcttaaacgcatggttcaagactacggtgatttgtatttcatgtctgcattgcgtgctttcaaacgccgatttgcatattcaaatgtggactatgatcgtatccgtcttatttgcttcttctttaaactaattctagatattgttggctggagaacatcatccattagacgtcagagtgaacttgcaaattggaaagataccaacaacgaaaaatatccacatgttgtatatgaagagcattgcaaggcttgttctgatgctgagcagtgtgactcaacagaaggtaacagctacgacaagatagaagatagacatctatctattaaaattatagtggtttag

SEQ ID NO: 29764 - DNA, 555 bp, Glycine max
  Peptide Sequence Number=SeqID_121449
atgtccagtattttcgggccagatgtcctggacatcgtatccgacatcgtggatcctgcagcttcaatgcttttagcaactccagtattttcgggcaggatgtcctggaattgtattcgacatcgtggatcctgcagcttcaatgcttttagcaattccagtattttcgggcaggatgtcctggacattgtatccgacatcgtgaatcctgcagcttcaattcttcatttgacatttcatcttgccttgtgcattgtacacgatgaattcggttataacagtgttgtatttcaatggaaggttctagaattgtacatagaaaaggatctggctggtggttcaatatttcattctgcaaattcccttacatcatgtggaaattatttatctaatgatgagacacaaccgccaacaaatatgaacaatttaaatcttgacgaagatgatgatcatgatgatgatgattatcttgtgtctaactcatacgttgaagtccccgatatgattccaccagtaagaattgttcacccagcagaaggtatgatttcctcttaa

SEQ ID NO: 29765 - DNA, 204 bp, Glycine max
  Peptide Sequence Number=SeqID_121450
atgtcaccacaaaggatttttcatgaggttgaaaaggagctttctctcaaaaatgaccatcagaaaatccaagatgaagtgcagcccagacaagaaatggaatcagatcaaagctacttgagcagcatggacagggttgaggacaaggaaaagtatgttaagttgatttgtcattctacatctcctttacattttgatttttaa

SEQ ID NO: 29766 - DNA, 180 bp, Glycine max
  Peptide Sequence Number=SeqID_121451
atggcgaaatcgccaatggggatggcgggttcttcagtgcagcaaactcgccagtttgactggcggtttgcttggggcttgcataatttcgtgatatttgccattgaatgcaagaataaaatcaaacgtggagttacacagggtgaaatggtggagaaaaatgtcatttcaattaaataa

SEQ ID NO: 29767 - DNA, 1215 bp, Glycine max
  Peptide Sequence Number=SeqID_121452
atgctttttgtcgctttttccattctttcatttcatggagtttcagtaaatacgtttgatctaaaaaatgagagttatcctttaatttatggtggagatgcacccaatatcactggtggatacaatagttccatatcgaggttatgcctgcaagattctttggatgaggatttggtgaaaggaaagattgttttgtgtgatggttttcgaggtcctacatctgtgggattggtttctggagcagctggtattttactaagaagttcaaggtcaaaagatgtggcttatacatttgcattgccagcagttcaccttggcctaaattatggggcacttatacaatcttacataaatctaacaagtgatccaactgccactatatttaagagtaatgaaggcaaagactcatttgcaccttacatagcttcattctcatctagaggaccaaatgcaatcactccaaacattcttaagcctgatttagctgctccaggagttgacattttagcagcatggtcaccaattgtccctccttctaatgttaaaggtgataagagaatagcaaactataccatacaatctggaacttcaatggcatgccctcatgctactgcggcagctgcctatatcaaatcctttcatcctaattggtcacctgccgcaatcaaatcagcattaatgactactgctaccccaatgagtgttgcacttgaccctgaagccgaatttgcttatggtgcggggcaaattcatcccatcaaggcattgaatcctggcttagtatatgatgccagtgaaatcgattatgtcaactttctatgtgaacaaggttacgataccaaaaagctaagaagtattacaaatgataatagtagttgtacacaacccagtgatggaataggttgggatttaaatctcccatcttttgctgtagcagtgaacacctcaacatcttttagtggtgttgtttttcatagaaccgttacaaatgttggatttgctacatcaacatataaagctagagtaactataccttcatcttttttgaagttcaaagtggagccagatgttttgtccttctcatttgtgggtcaaaagaagtccttcacccttaggattgaagggaggcttaattttgatatagtttcttcttctttgatttgggatgatggaacttttatagtaaggagtcctattgtcatgtttgctgcataa

SEQ ID NO: 29768 - DNA, 681 bp, Glycine max
  Peptide Sequence Number=SeqID_121453
atgtgtccttctcaaaccacaaaaaggagagagacaactttgtttatcattgatatgacaaaggctcatgtttctctccttagaactataaaatgggatgaggtaactcttcctgaaaaatggatcatggataaggctacaccttcaatccccaaacctgccccaaatagcttgaaaaagcatcatattcgaactggctatggtattatgtctgtcatagtctatggcgatcctgacaaaccagctttgatcacttatccaaatttggctctaaattatatgtcatgttttcaaggactatttttctgtccagaagcagcttctttactgcttcacaacttttgcatatatcatatcagtccgcctggacatgaggtttttttccctcggaaacttccacaagagttcttgaagttgggagcaaatgcaatttgtgccgaggatcctgttccttctcctgaagatttagcagatcaaataattgaggtcctaaagcttggtgcagtgatgtgtatgagagtgacagtcggtgtttatatccttactctttttgctattttcctttatgaattctccgatatgataacatacttagaaccacttgaagttcgtggaaacgttgaagttgcagaatcagagatagttcaagcttgcagaaaagtcagtgctaagctaatttag

SEQ ID NO: 29769 - DNA, 438 bp, Glycine max
  Peptide Sequence Number=SeqID_121454
atgtaccctctcttgttcttagtcacaataacccaagtagatgtaccctctacttgtaccacaaagggatgtaccctccaatgtgttaagacaaagttctcaggcggggaagaatcaaaagaattctcaaactgtgtcattttgaattctttgacaaggcagaagggagacacaaaagaattcaggtggttagtccttcgttcttttggaaaagggagaagagagacacaaaaggaattcagacggttagtccttggcgattctttttggcaaaaggagaagggaatgaaaaagatgaatagcacaagttttgttttcaaggtttggaaaaccaaaaaacttaagaaagcttttgcaaaggaagaagaagaagaagatgttcaaagagattcaaaggttgtaaaggattgtaacaattgttatgaatcaattgaatga

SEQ ID NO: 29770 - DNA, 282 bp, Glycine max
  Peptide Sequence Number=SeqID_121455
atggtgagtcgctctgagtcaggggttgagtggtattcaaagaattgggtaatcttgaatacccaactagaggggtcagagccatcgaatctgggtaccgcggatgaagaggagggtgaagggagtggttctagaattcgaggtttagggcctccagaacaaggaattgagaaattgcacttcattgctagcaggagacagcctctaacggccaaggaatcttggatagcttctagaacgttgttgacctggctgcaagctcagcttcaccttgctacgtaa

SEQ ID NO: 29771 - DNA, 153 bp, Glycine max
  Peptide Sequence Number=SeqID_121456
atggcatacatgagtgtcgcaacgtgcccttttgcgggcgagcgaggcgaggctcacgggtgcgctttccaaaggaggaaagatgtgcggagttgccaccaacgtttatttttggaaaacgtcggaaaaactgaaggaaaccggtcaaaataa

SEQ ID NO: 29772 - DNA, 417 bp, Glycine max
  Peptide Sequence Number=SeqID_121457
atgggtgagtttccaaaggaaaactcagatactttgtgggccatgccagttccaaaccatgtcaaatatgtctttagaggcatcctccatgttgggggagggaatgagaatagaagcaataagggagcaaatatggggagggggaaagaaagagttaagggtatcccaacaccaccccatgatcagagacgtgacattggtggtggttgcaatacaaatgatggtggcagtgatgatgtggtggtggctgcagcagcgatgatggtggtggtagccaatggaaatgacattagtggtggtggtggtcttgatgaaggtgatattagtggtggcgaagatgttggtggtggcggcagtgacgaaggtattgttagtaatggaggtggtcaaggttgtcagactcacgattctacgtaa

SEQ ID NO: 29773 - DNA, 515 bp, Glycine max
  Peptide Sequence Number=SeqID_121458
ggtggattgatgttattaaggatgttctctacctaacaatgttccagtgttctatgttgtctcctggactactaaaccccgatgtctcgcacatgtttagcctaatcctaatcaagcgtcgtcctcagatgtctcttggaagcttcttttacaacaatgaaaagagaaaaataaagactgaagaagtacaagtagtggggatgtcttctccacctctagaaatctcacaatcactcaagatctcatccaaagctccgcaagatggcttcctcatcaagctcagccatctctcagtatctccacagccaaaaccaaaagctaactttctaaaaagctcacctcctcttccaatttcttcttgctcagtgcggaggatagcaggcggtgcacttagaaaattaccactcactcagcacatctgtacaactcatccttcttccagattcttttctgggctcagccaacaatggtcgcgcttagcggggattgctcgatcagcggaggaattgacttag

SEQ ID NO: 29774 - DNA, 462 bp, Glycine max
  Peptide Sequence Number=SeqID_121459
atgaataattctggttggagacaagagttaaatccttacaatcaatatgaagaaaaaagagctcctgatcttgaaagtgtgtttgaaggattcatggcatatcatgctagctctaaagctaatcaaaattcaatgcaaaatcatgagattcattttggcaagagctattctttagaagattatcaaagggaaccagagttacaaccctactatcaaaatgaagcattaagaggtttcaatctggataatttgttgatgcaactcaaggatacaattgaatcaattcaacgagcatttaagagtgtagaaattcaggttggtaagctggtagaagatgtgactcaagttgtggtcagaagagaagaagtatttgtagagatcgaagctcaagaggaaagccctataaatgagcatgatttaagagaaaaagatgaggagaaaagtgaggagaaagtacaataa

SEQ ID NO: 29775 - DNA, 474 bp, Glycine max
  Peptide Sequence Number=SeqID_121460
atgaattttgctattagcttattcatcagaagcactgatgtgaaaataatatatagtaatgatattgctttggatatattaccccaagctgccggaaaaggacgtgcccttgcttttttacttgaaaaattgaaggttgatagacaaggaccacttaacactcttgtttgtggtgattcgggaaatgatgttgaactgttcactgtacctgaagtcagcaatgaacaggaagaattgcttcaatggtatgcaggaaatgcaagaggaaatccccaaataattcatgcaactgaaagatgcgcaactagcattatgaaagccattggtaacttctttctaggtccaaatgcatctccaagagggattagagattcaatgttcaataggaaaattctttgtcctagccatgaagtagtgatgttctacatattttgtgagagatgggggtgtgatgacgttgagaaacctgagtag

SEQ ID NO: 29776 - DNA, 573 bp, Glycine max
  Peptide Sequence Number=SeqID_121461
atggctaggaggcattggacacaactagcagagcccatgactaaatatgatcctaaagtagtcatggaggcattgcacctcctaggcacccagtggacccgaaaagtccaaaagagcactgggatttcctacattgattcaggtctctaccaattctatggaataccgatcacaccgacaaagctcatctggcctcccattaataggtcgtttattgaaaaatattacatgccaaggcaggtacaacagctggggcaagatcagcagcaacaatcagcaacagacgcactaccgctgcctccacatcagccaccatccttggagtccatctcagctcaaatgcagaggatggaactccaaatgcacacatacatgcggcatttggctgatcagcaggcaacaaatcataggggccagatgcaagccactgttgcatggcctggagacaggcctaattttcaggaagaggtaggacctgcagatgctcaaggagctacccaaggagacgaagatggagctaagaatgatggagacatggcatatctgcttgattacttcattagaggaggctga

SEQ ID NO: 29777 - DNA, 210 bp, Glycine max
  Peptide Sequence Number=SeqID_121462
atgaagttgggcatgattagagttagaaagtggccacctgtggtggaaacacgagatagtgcatccaccgtggcattaccggaaccaggtaatgccgctagttttaccgcggtagtgattgcatgtagttctcagacattcatggatgccctctacattcgtgagaaaaaaaccttgctgaagaaagcaatgggatgcgactgttattag

SEQ ID NO: 29778 - DNA, 372 bp, Glycine max
  Peptide Sequence Number=SeqID_121463
atggcttgccaacaggataagagcaaggaatatgctatctgtaaatcaagcatagtcttggagaaccgatccacaagagatgtaccctctcttgttctcagtcaaacccaagtagatgtaccctctacttgtaccacaaaggatgtaccctccaatgtgttaagacaaagatctcaggcagttaaacctttgatactttgtgaggggatacaaaagaattctcaggcgggagaagggagacacaaaagaattcaggcggttattcctttgttcttttggaaaagggagaagagagacacaaaaagaattcaggcggttagtccttggcgaattctttttggcaaagggagaagagatgaaaagaatgaatag

SEQ ID NO: 29779 - DNA, 325 bp, Glycine max
  Peptide Sequence Number=SeqID_121464
atggccttcttcatgttctcatttatacatttcattccaaaattcagagattcatgcaaagattattactcacagctagtcgttcactcacagtttaagttcacaaactcaccacttcctcagcagtccatccagttagaaaagtcagaaccatcgtctatgttgcaagatggtgaatcaggaggagcagcggcttcatcagctgagtcatcggggatgattatcagaggtggtgccggaggagacaatgtctcaagttctggagaagtaggtggatctactacaggaggttgtggctcagctgatgtcggcttagtcctagctg

SEQ ID NO: 29780 - DNA, 453 bp, Glycine max
  Peptide Sequence Number=SeqID_121465
atggcttccaagaaaagaaaagcccctgctacaccttcccaagccagatatgacagatccaggttcacttctcctgaggcctgggaaaggtactcaaacattgcggtgcctaggaagattttgcctgaaaggaatgtcattctccattacactgagttcgatgaatttactaaagaaatcgagcacagaaactggcacaaggagttggcgaactttatggatggcagtattgatgtagccatcttaaaggagttttacgcgaacctctatgaccccggggataaatcacctaaacaggtgagggtgagaggtcatttggtgaaattcgatgcagacaccttgaacacattcctgaagaccccagtgatacttgaggagggggagaactttccagtatactccagattctgtcgttcgaagccagagccacaggaactggcagctcgattatga

SEQ ID NO: 29781 - DNA, 180 bp, Glycine max
  Peptide Sequence Number=SeqID_121466
atggtaggcgcatgtagcgttaggattgtaccatcagggaaatggaggttgataaacccttctcgagctcactactgccattggttactgagtaagtacggtagtaggttggcatacggcattgggattgggggaatggattttgtgggtgatgttggggaggtctctgcggttggttag

SEQ ID NO: 29782 - DNA, 657 bp, Glycine max
  Peptide Sequence Number=SeqID_121467
atgatgttgggcttagcgccaccgtcgcgcttaacagtgcaagggatagcttggctaaaaaagctagagggtctaaatggggaagagacagaagtgcctgaggaaagtgaagaggtgcaagtcttgaaggatgagttggaaaagacaaaagtaacaaaggagaagttgaaggtggtagtcactagagttaggaaagaatgtgataggctaaaagatatcaacatgttcgcggctgaagtgctagagcaagaaatgaagaaagctagaaaggaagagtggagtagaaacaagttccgaggggctttgttaggcagcagtaatgagctcaaacttagaaaagtcgagaaagacaaatcaaggatggagaacgtaatgttaaaagatgagttaaggaattgtcaggagtcaaagggaagtttgaaagagcagttgagcaagatggaaaagaacatggtgataatcattgatcaatataaagagaaggtgaacctagctactggttgggggcaggtgctgagggatgaacagacaaaggcatcatctttgcaagttgaaagggaggcaagggaagaggtgatagagttattgcattggtctcactctaaatggaagtcaagagcttccaaggctgctagccagagccaagacggtggctga

SEQ ID NO: 29783 - DNA, 640 bp, Glycine max
  Peptide Sequence Number=SeqID_121468
atggccattaactggacacttaggagtctgatgtgtaatgccacgtgtaatggtttgtttagacgacgtgtgggtgcgacgtttggtgttcatccttgtcgttgtggtccacgcatttttggggttagggtttggtgcgattggaggaagattttggtgttacagcttgtggtcccaaaagtgaagatcttggtcaagaaaggccaatcatggggtaatttcattagcaaccccattttgaagtatgttggtggagacaaaacgctgttgcttgacatagatgaggacaagtggtacttcttcgaattggttggcattttgtttcaaagtttcaaagaggggaggacggtttgggaagaggttttgattgatcaaaaagaagaatctacttcaaccgatatgcccttaggcacggcaatacataacatagaaatcacactcggaaagggtggacaattagctagagcagcaggtgctgtagcgaaactaattgcaaaagaggggaaatcggccacattaaaattaccttctggggaggtccgtttgatatccaaaaactgctcggcaacagtcggacaagtgggaaatgttggagtaaaccagaaaaatttaggtagagccggatctaaatgttggctag

SEQ ID NO: 29784 - DNA, 789 bp, Glycine max
  Peptide Sequence Number=SeqID_121469
atgtcgagatgcttatgcgacatggataaacatggtattcttgtgtctgtgcttgctgaaagtggttctgctgttgctgtagctcaaaatggtgaaatcaatttagatagagaagtgaagactagagaatcttcagaagggtcaccggagcaaagtaaccctacaaagatactagctacatccaatgcctttgatgctgctacccacaatgtcggctctcacttgcagggaaatttcatcgaaccatcatctgtttcactgtttaaagagtttatgacgaagttcagatcatctttgagaagtcatagcaatctttctctgctccttattactattgtcgctctgattttcttcattcagcagtttagcatacttgtgttattggccagacctcaacacatacatatgaacactcctgtagacatcatgaacaggatgaacaatgaggtcactagaagtccttcagacatagcgtggctggagaaaagaattcatcacctcaaagatgaaatgtacatggttgagagtaggcttgaaaggatgcggaccttcatcgatgtcatcgtcaaccatcatgggaccttcatcgatgtcatcgtcaaccataatgggtttgaactttttcttgaaaacagacttgcaatggcagctcgcgtggctagtggaatagatcttggtccaccaagggcattgctacgtgcacccagcgtaattgctggtacatcttgcaatttcgtgcttttttcattttatccttccgtaaaaggatatggatcagctaatccgtaa

SEQ ID NO: 29785 - DNA, 249 bp, Glycine max
  Peptide Sequence Number=SeqID_121470
atggcttccacggttgttgccgccgctgccaggagtgacgtgccgccgcggcagccggtggtggatccttcgccgtcgtcgtcccccgacaacgccgctaatcggagcgattccttcaattcctcgcccaaccacttctccgatgctgaaattcagttacaaactccagacgtattgaagagtgaagagtatcgacaattgttccgtcttccacaggaggaagtgagtgatgttccacctttaagatag

SEQ ID NO: 29786 - DNA, 381 bp, Glycine max
  Peptide Sequence Number=SeqID_121471
atggcagcggaatggagaaggaagagagagaggagatgccacttcaaggagaagatgagtctagaagaagctcaccaccataggaggccatggataagagcttggaggaagaaggagatgaatgaagggagaggaagagaagagcacgaaattttgtgctctaaaagagctctgaaatctgaaagacacaatagaaggcatggaaggaagttgaagaactggagagtttcgctcagcgcgttgccctcgcttagtgcgcctccatcgctcagtgcgccaccctcgcatagcgtgataagccacatgggaagtcagacgtcacgtgcatgtgcgcttatgatatggtgcgcgcttagcacgtggccacttatccctcactag

SEQ ID NO: 29787 - DNA, 495 bp, Glycine max
  Peptide Sequence Number=SeqID_121472
atggcttctgaaattgtaaatcgagttgactatgttgatgatattgagtttatggaagatgaggaagaagccagggttgaacctaaaccaaatgcaaaggagaacagaagggacaatgatgaaaaagagagtaaaaaagttaaggtttgcacttctatagcttggaaatattttactaaaattggtgtggtagatggtaaagaaaaggcagaatgtaatgcatgtgggcaacaatatgtaattggtgggagtaaagtaggtacttcacatttattgcgtcatgttaagctcttgtgtaaaaagaaagctaaatttcatgatgtgggtggaatgataattgatcatgccggaaagttaagatatagggaagttgaccaaaagcatgctcttgagcttctaacaatgtgtattgttcgacatggttttccatttaactttgttgaatataaatgggttagggaattactttcatatataaattctgatgttaagcat

SEQ ID NO: 29788 - DNA, 540 bp, Glycine max
  Peptide Sequence Number=SeqID_121473
atggcatctaagaagaggaaagcaccctctactcctacccaagccagatttgatagatccaaattctcatcccaagaggcttgggagagatacactgacattgtggtacctagaaagatcttgcctgaaaggaatgtcattattcatcacactgagttcgatgaatttactgaagaactcgagcgtagaaactggcacaaggagttgacaaactttgtggagggtagtattgatgtggccatcgtaaaggagttttatctgaacctctatgacccagaggataaacaacctaaacaggtgaaggtgagaggtcatttggtgaaatttgatgcagacaccttgaactcattcctgaagaccctagtgatacttgaggaaggggagaactttccaatatactccaggttctgtcgctcgaagccaaaaccacaggaattggtagctcgattatgcatccctggaaggggattcgagttaaatgctaatggactgccactaaagatcttacggaagaatctaaccatgctcgctcagacatag

SEQ ID NO: 29789 - DNA, 273 bp, Glycine max
  Peptide Sequence Number=SeqID_121474
atgtcgtcacgcacgcgttgtatgttggtctcgtcttttgtcatgggaagtcggaaggtccatatcaccttcttaactgcacacatggggcactgcacccccaaatgcgcaagtattcttgagtcattcatctttgtgaaatgttgtcgaagtattggcgatcgaaattgccattccttggattatagggttgaaccaagctcatgctttcttgaaaaggttcatcaagtcaaggtcaagtatgaaagtaaccaacttgcaaattggaagtaa

SEQ ID NO: 29790 - DNA, 138 bp, Glycine max
  Peptide Sequence Number=SeqID_121475
atggatacctcagagccctacactggggcaatgaaaggcaccatgcataaacctcaagcgaacctaggggtcatgacgaaagacaacgattggtacttcaaagccctacattggggcaataaggggcaccgtgcatga

SEQ ID NO: 29791 - DNA, 243 bp, Glycine max
  Peptide Sequence Number=SeqID_121476
atggcgcctactaggcaccctttggactcggagaagtccaacggggccctagggtttccggctatgatcacgggcctctgccagttttacgaagtgcatgtcgcccccagcaaggcagccaaccaccgtggacaagtgcaaatacatgagtgtctctaccggttcagcctcaaccagcaggggcagggttccaccccttttgtatgccctaccccggagtattttggggctgaggtcgcatga

SEQ ID NO: 29792 - DNA, 454 bp, Glycine max
  Peptide Sequence Number=SeqID_121477
atggtcgacagcggtggtgtactagaatgtcttcgtgtttgcccgaaagttccactatgcattgaaggccactcatttggggaatatctttttgtattgggcctcaacaaggctgatatagtcctaggagtccaatggttgaagcagttaggccccgtgcttactgattacaccaccctgatgatgacgttaattaggcaagctttgaaaagtgttgtttttcaccttctcgctaagccaatctgcaagcttagcgagagtcccctaagcgcaactcatgggctaagcgcaaggaagactctggaagaagatgagctgtacaggaggcttcctggttatggaaagctaaatcctctattggatcttccctggtcattcaatagtggaaactggtctgactctaaagtccttgatagtacagggctaagttgtcgtactatcacgaggaatcagg

SEQ ID NO: 29793 - DNA, 420 bp, Glycine max
  Peptide Sequence Number=SeqID_121478
atgcaggaagagtcaggaaactggcgacccatggttggacaaaattatgtgtgtctaccagtatcacgacatgtcattgtgttaaggctgagcattagggagccagtagaagatgattttggtggattcaagggttcatcagcttcgactagacctttgtctctgtggaccgctgactcctcggcagaaagtcatttaaccagatcacgtaggcgtgagggcaccagggaaagtgcgtggctagtgcaacaacttgcggcaacgacaagggttgcagagcttggacctcgcgatgaagttcaaagggaaaggggtggtgttagtgttgggggtgatgttagggaaggcagagtgggtgccttattgatggaagcttgcttgtggggcttctatggaggctggatctttgagcttcaatga

SEQ ID NO: 29794 - DNA, 192 bp, Glycine max
  Peptide Sequence Number=SeqID_121479
atggtgaattcatggacatgggaatcccttgtatcgaaagtcttcctagtgggcatagtaggggctaccattggatacttgtggactgaaaatgacttccgcttgagggggaggctatcatatggaagagactcacacttgaggggcaaattgttggagtacaagtgtgatgtgaagtttggcattggatag

SEQ ID NO: 29795 - DNA, 213 bp, Glycine max
  Peptide Sequence Number=SeqID_121480
atgtctcctagggggagatccatcctagaagtaatcttctccccacatacgtcagatacgagatcatcacagaaaaatgatgatctcggactcattcatcgttggatcgtcgtgaaatttgagtaccatgttcgcaacccaattcctaaaattctcgccgttgggaatttcaaaatcatgtctaagcttagaggaaaaactttcgcattgtag

SEQ ID NO: 29796 - DNA, 1095 bp, Glycine max
  Peptide Sequence Number=SeqID_121481
atggttagaacacgaggtctacgtcgtgtggtaggcacaggtagaggcagagaccttagtcaggatgtggctgaggatgttcctcgacgtcgtaggcccactggctcagcacataggcaacgagttacccagagagtcgaggatttggctgaggatgtgcctcatgcgtctgatggtagcccagagaggacaggagccgccgatggtgctgaaacagatcgagtggctagtgatgggataactgctgatgatgagtggttccctggtgggccacgcgatccatctgttttgataggatttgctgatcatgtggcacacaacatatggagtggcagggagcgacctgatctcaagttggtctcccatggtaggaaagtagataaatttgggagaccgactgctgagatcaaaggtatgattgcggccaccggattggatccattgatcaggtgttctgtgatcaccactgatcctagactcatatccgcctttgttgagaggtggcatagggagacgagcagcttccacctcccagtaggggaggtgatgatcactctagacgatgtttcgtcactgctgcacattccgattactagcgcgctgcattcatttgagccgctggttacatctgacgcagtcgccctgttgacggagctacttgaggtcaccgcagacgaggctacagctgagacacgtcaggcaggtgggcctcatgttcggttgtcctggcttcgggacatgtaccagagcattcagagacctgggccaggcaggggcattctctttgtgacgccgacagaggacactgttgagtcgagacctgcgcctccccctctcactcatgatgatgacttcgtcgagccacctatcgccgaggttccagtcgcgtcagatccccttatgcattctgtggttgattgcacagcatgtgtcaggatgggaaggattgctgagcatttggagcgcgccatcaacctcaggatggtgactgcagggactgacttatatgatatcatggatctttgcctgaggatagctagagatgacgacccagatgacagtcttaggctgcgacaaagaccctgcatagattag

SEQ ID NO: 29797 - DNA, 291 bp, Glycine max
  Peptide Sequence Number=SeqID_121482
atggaggacgacgcccgcggagaagaagaacaactccaacctggacgcggggagaagaagaagaactcgttgctagatgcgtggagctctggtcgcggaagaagaagaactcgaaggtggaagaagcttttggtcgcggaagaagaagaagaaatcgaaggaggaagaagaagcgcttttggtcgcggaagaagaatttcaaacagaaacattttgatcgctggtttgaagagattgagaattaagtcaatattggagtccaagcgggagagaaatgtgaaaagagaatga

SEQ ID NO: 29798 - DNA, 345 bp, Glycine max
  Peptide Sequence Number=SeqID_121483
atgcgtgcgtttcttctgtgcatcaaatgcatagtcgatgcgcttggatcgtgtggagatcctgttcttctgtgtgaacatcttgacgcaattcttgaaggcgtgccagaggagtatggtctagtgatttcagtggtcgaaaataagtttgaaccactttcgattggagaagtagaggcgttgctgctcgcacatgaggcacacatgaaaaagtttcagaagcgctttactgattcaccatcgattaatgttgctcgagccaaacacatctctcacgctgaaggaactagtgtttcaaagcaatttttcaaacaccttcggttcagaacaaaatcagtgaactaa

SEQ ID NO: 29799 - DNA, 1176 bp, Glycine max
  Peptide Sequence Number=SeqID_121484
atgtctaagctgttaggcaacacttgtttcaggtttaaatttgacgatgagcgagtaacaaaagaagaatccaagagggctttggaagaacagtatggtggtgaagaagagaaagaacaagacgaaaaagagctgaagaggaaggagaaggctgaggctcacttgtacaccaccataaaggttgcttgtgatgaagatctacgtgaacagattggaaataatatacactttgatcttgtggattatgataaagtacgaagttttcgtgttcaaataaacatgccttttatggttttcaaggttggactgctaagagaagtttccactaaagcaaataatgcagcgctgaagttatttttggaactagaaatggggcaggatttgcggcctattcctcctccagagaagtcaaaagagaatctcttgcttttccttaaactttatgagccttcaaatgagaagcttcggtatgttgggcggctttttgtgaatagtagtgggaagccagaagatatactggtaaaactaaatgaaatggccggatatgatcctgatcaagatatagacatgtttgaggagatcaagtttgtgcctaatgtcatgtgtgaacgggttgacaagaaatccacattccgtgagagtcagcagcttgaggatggtgatattatttgcttccaaaagtcctccccccaaactggaagcggagagcgatatcgctatccagatgttccttctttcttggaatatgtgcataaccgtttggttgttcgctttaggactttggagaaaccaaaggaggatgaatttagtcttgagctgtcaaagcttgactcctatgacaatgttgttgaagaagttgctcaacatattggtttgcatgatccttctaaaattagactcacatctcataactgctactcccagcaacctaaagcacagtctatcaagttccgaggaatggaacatttgacagacatgctaattcactctaatcagacttctgatattctatactatgaagtattggatatccctctgccagaattgcaatgcctaaaaactcttaaaattactttccatcatgctaccaaggatgaagttgtgattcatactattagattaccgagacatagtactgtgtcagatgtaattaatgatcttaaatcaaaggtatga

SEQ ID NO: 29800 - DNA, 372 bp, Glycine max
  Peptide Sequence Number=SeqID_121485
atgcagagcctacagagcttaggtctgcagcctatcatgagcctggacgagttcattagacaggtggctcggccaggagtccaaccttctcctttgggagggagtgaggccttcgcagcccaagagcctgtgccagaggaggatgagcccatcccttctgagtcatttgttgatgagactgatccagctagtgctcatgaggaggtagcatcaccagaacccgttcctcagtcatctctagctccagttcttgatgatccacaaccatctgcaccagcatcggtggttgatcagtccattgttcaggatccaccatctgcactggtgttagacctaaatgagcatgtagaggaccacccacaggatgattga

SEQ ID NO: 29801 - DNA, 240 bp, Glycine max
  Peptide Sequence Number=SeqID_121486
atgggggggtcagctgtttctgcaactggtgaatcaggaggagcaactgcttcatctgatgatgcgtcagaaatgacaatcagagaaggagatgggggaactacttcaagttcaggcgaagaaggtggatgcaccattggatattgtgggttagctggctctgaattgacctgcataggtgtgggctcaagcggagcagcctcgttgggtctcacgaatggaagttgggcttcaggctag

SEQ ID NO: 29802 - DNA, 309 bp, Glycine max
  Peptide Sequence Number=SeqID_121487
atgacccctactcatgatgccctgctatattataacgggaggtggaacatgccacacaagcatgactttgttggttactcgttcacaagaaaaaatccaaaagaatttcacattccttccggatgtaccatcgataaactgaaggatctcatcatgcaagttgtacctcatgagattccaccttacggtattcatgaatcacaaacgctcaaagcaaatgatgatgtgctaaatgtcttagtacagtttaactactggaaacaatttggaccaatagaaattttagttgtttttagtaaacatgattga

SEQ ID NO: 29803 - DNA, 324 bp, Glycine max
  Peptide Sequence Number=SeqID_121488
atggctataggcgtatcacgaggccctttcgtctcgcgcgtttcgctgatgacgctgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 29804 - DNA, 303 bp, Glycine max
  Peptide Sequence Number=SeqID_121489
atgaagaaacaacaatggaagagaaggagaagaggtgagaggaggcgccatgcactagggaataagcaatggaagaaggagctttgccaccaagaatgtgccttggataagaagcttggagaggatgcttcaatggaggaaaagaaagggagaaggggggagcacgaaattgaaggaataaaagagggagagaagtggaactttgaagtgtgtctcataagactttcattcatcaaagttacaacaagtgttacacgtgcttctatttatagactaggtagcttccttgagaagcttccttga

SEQ ID NO: 29805 - DNA, 292 bp, Glycine max
  Peptide Sequence Number=SeqID_121490
gcagtaagggaagtgcttacggattatttggcccagcaaccctccaggttatcggcgatgcaccccgagttcccagatgaagatatcatggcctgggcagtccttgtatccccggatgatcagtgtattcctttcacggctaggctagtgtcataccctaatttcgtccggggacctttgcttgatgacatgcaacttttgtttggtcctggcccacttgggccctccagaagattcctccagaaggctgttgcttctggaggaagcaaccctgctcgcctgggcgagcagg

SEQ ID NO: 29806 - DNA, 339 bp, Glycine max
  Peptide Sequence Number=SeqID_121491
ggagttgtgggaccggtgaaacctgcagataggtcagatcatgatgtcgatgatcccctatatctgatgacattgaccatctcacaactttttctaaagtcgttgcaagttatgtgggatgctatcgtgtttgggttgtttgatgacaacttccccttgccagacaactacctgaaaggaattattaacagtgctttgaaaggatttgacgataatccacaaagtaaatccaaagctgctgctaggtggattgttgttaaaacaaaaaggaaggaccgagtgcggatattatgtcatgcacttgatgtcaactataatcttaggaattttcaagaataa

SEQ ID NO: 29807 - DNA, 276 bp, Glycine max
  Peptide Sequence Number=SeqID_121492
atgtcaggatttacacgcaattctcctcaaatttcagccagcccgcatcaattagaccttgcaccttacgcttcagagccctaccatgctcaatggaatgccccggggcttctccgtgacaagcacacgttgcgtttgagtcatattctcggagaaatggaggttgatgaaccttggatagggttatggctaccattgaattatcatgtggtgttcgtcatgggaagtgcggtagacagactttgtggtagatttagggatggcctttgtggataa

SEQ ID NO: 29808 - DNA, 706 bp, Glycine max
  Peptide Sequence Number=SeqID_121493
gtcgactctagaggatccccctgccaaacgagtccagcattggccaaagaaagggaagctttcagcaggaaagctaagtgtgaagtatgccattctgcacaggattggagctgcaaactgggttcccaccaatcatacttccactgttgccacaggtttgggtaaatttctgtatgctgttggaaccaaatccaaatttaattttggaaactatatctttgatcaaactgttaagcattcagaatcttttgctatcaaattacccattgccttccctactgtattgtgtggcattatgttgagtcagcatcccaatatgttaaactacactgactctgtgatgaagagagaatctcctctatccctgcattacaaactgtttgaagggacacatgtcccagacattgtctcgacatctgtctcgacatcagggaaagctgctgcttcaggtgctgtgtccaaggatgctctgattgctgaactcaaggacacatgcaaggtgctggaagcaaccatcaaagccaccacagagaagaagatggagctagaactgctgatcaaaaggctctcagagagtggcattgatgatgaagaagcagctgaggaagaaggagaagcagctgaagaagaagaagaagctgctgaggaagaggaagatgcagcagaagagacagaatccgatgatgattctgaagccaccccatga

SEQ ID NO: 29809 - DNA, 262 bp, Glycine max
  Peptide Sequence Number=SeqID_121494
acttatcaaggtaatccttgtggcgtctaacttggagctatctgacttatcttccttcaccggaagtggcgtctaccctgacttatcttcctttaccggaagtggcgtctacctagacttatcttccttcatcggaagtggcgtctaccctgacttatcttccttcaccggaagtggcgtcatcaaaaccttcgtagcctgtatcaaacaatccgctcctactcaggtttacatcatctggtatcagagcttcggctcttga

SEQ ID NO: 29810 - DNA, 603 bp, Glycine max
  Peptide Sequence Number=SeqID_121495
atgctccaacctcgaatcgttggtgaagaacattatgagactgcgcaaagagttaaacaaactttacaacgttacaaagaacttcaagacattatagctatccttggcttggacgaattatccgaagaagatcgcttaaccgtagcaagagcacgaaaaattgagcgtttcttatcacaaccttttttcgtagcagaagtttttaccggttcgccggggaaatatgttagtctagcagaaacaattagagggtttaaattgattctttctggagaattagatggtcttcctgaacaagccttttatttggtagtgaaggaaatcattttatctactaatagcggacaaattggagtattaccaaatcatgcgcctattgccacagccgtagatataggtattttgagaatacgtcttcttaaagaccaatggttaacgatggctctgatgggcggttttgctagaataaacaataatgagatcactgttttagtaaatgatgcggaaaagggtagtgacattgatccacaagaagcacagcaaactcttgaaatagcagaagctaatttgaataaaggcggaaggcaagagacaaacaattga

SEQ ID NO: 29811 - DNA, 718 bp, Glycine max
  Peptide Sequence Number=SeqID_121496
atggggacaaggggttgcatcagctacaatcccgttcttgctataagacaacttggctatcctatgagaggagcaccactagaggaagagatcgtgcatgtccgcaaggcatgggaggtgttgcaaaagaaagacaaggaactcagaggcagtaacaatgggcccatcggtggctaccgtgagtggttgaaagcccacgtgcaaggtttggattggctcccaagtctgagagccactaaaagggaggaagatgaggcaccggaggaagacgaaggggagaatgccgaactgagagatgtaaatatagctaccaccgaggctttggaacaagagaccaaaagggcccgtagggaagaacatagccgaaacaagttccgaggggctctgtggggcagtaacagcgaacttaaactccaaagagaagaaagggaccaatcacggaccaacatgttagccatcatcagcaagtaccaagaggaactaagtctagccacggcccacgagcatagggtggcggacgagtatgcccaagtgtacgcggaaaaggaaactagaggaagggtgatcgactcattacaccaagaggcaaccatgtggatggaccgatttgctcttaccttgagggggagtcaagaacttccccgattgctaaccaaggccaaagcgatggcggacacctacttcgctcccaaggagattcacgggcttctcagctatt

SEQ ID NO: 29812 - DNA, 678 bp, Glycine max
  Peptide Sequence Number=SeqID_121497
atgcagaatattaaagtagcagtagatgcagttatatttggatactttgataagaaggatcttcaggttcttttgataaaaagaaaaattgatcctttcaaaggaggatgggcattaccgggcggattggttcttgatgatgaaaatcttgatgatgctgtaaaaagggaactgtatgaagaggctggcataaagcccgattttctggaacaactttatacttttggtaatgtgggtagggatcccaggaacagagtcgtttctatagcttatttaggcctggtaaacccttcttactatgaactatttgcagattccgatgccgaagacgcacaatggttcagtgttaatcagcttccaaagcttgcttttgatcataaaggaatactggatattgcgttaaaaagacttcgtacgaaaattcaataccagccgattggtttcaatcttcttaatgaggaatttccgttttctgatctggaaaacctctataaaacaatcattggccaggaaatagaccgtagaaatttccgtaaaaagatcatgagctatggtcttctcaatgaaaccaacaaccttaaaaaagaggggagcggaagaccgggaaaactatttacttttaatcaggagaaatataaggaacttgaggagcaaggattttattttgaaatcaaatag

SEQ ID NO: 29813 - DNA, 504 bp, Glycine max
  Peptide Sequence Number=SeqID_121498
atggccagggcattagaaacggaaaccagggagaaactccagcagcaggcagatgaagccatttatgagagaagaaactttgccgtggagcaggaaagaaagatcaaagaatctgagctgaatacagagatagcagttgaggaaaaacaaaaacagatcgaagaaaaaagaatggaaacagagatccagcaggaggaaaataacaagatccttagagaaatgaagattgctgctgatatttccgttgaaaatcaaagaaaacagctgatagagcaaaagacagaaaatgacagaaaagaagctgaaacccagggctatgtattggaaacctcattgaaaccatataaagaaatggattggagggttctaagtgctttaagtggaaaccaggatgcaagatccaatattgcactggcttttagagaacttgctgaaaatgcagggaaaataggaaacttaaatataagcccggatttattggaaaatctcttaaaacagcattaa

SEQ ID NO: 29814 - DNA, 344 bp, Glycine max
  Peptide Sequence Number=SeqID_121499
atgaaaccagaatacgcaattattattaagaacaaaacgagattggaagctttgattgagcggttcaatacaaaggcacaggcccggttttatatcgaaagttcagggggtgattttcaagaatatgttactgaacatgaaaagttctatcagtcatttcttgaagtccagacaaaactgtccaaaataattaaaaataaagtggtagaaagagaatttgtaccctcctttattttctctcaaaagaatttaattgtggtggttgggcaggatggattggtagggaatgtagcaaaatactcaaaaaatatacctatcgtagcaattaaccctgaccaggaaag

SEQ ID NO: 29815 - DNA, 243 bp, Glycine max
  Peptide Sequence Number=SeqID_121500
atgatgacaaaggtgatgacaaaaagctcaaagatcaatcaaagaacaactcaagtgaatcaagaacaattcaagagttcaagaaaagaatcaagaagaattcaagactcaagaagaaagcctagaatcaagaatcaagattcaaggttcaagatctcaagaatcaagatcaagattcaagactcagattcaagaatgaagaaagactcaatcaagatagtattaaaagttttcaaactttga

SEQ ID NO: 29816 - DNA, 390 bp, Glycine max
  Peptide Sequence Number=SeqID_121501
atgttccatccagcgaccacaataccgatctccccctacggaaggatcgcgcccacaagacaccccgtggactcagagaaacccaacaaggccctagggtttccagctcaggttacgggcctctgtcagtcctacagggtgcccgtgcccccagcaaggtcatgccatcgtgacatagggatcacgcccgcaagacacccagtggacccggagaagcccaacagggtcttggggtttctagctctgattacgggcctttgtcagttctacgaagcgcccgtcacccctaacaaggtcattaggccccccattaaccgggctttcatcaagaagtactgtgcccccaggcaggcgcagggcgagacaccacaacagcctggggatggctga

SEQ ID NO: 29817 - DNA, 341 bp, Glycine max
  Peptide Sequence Number=SeqID_121502
atgaacctgtacagacgcttcagcgcacggtggagtggatactacccatgcctacaccatatcgtctagtggagccagtccaagtgatcgaggtgacgtcatccgaggaagaccctgaggaggatctggaggagctacctcctgagcctgccgtggatgcccttgaatttctagagtggtggggtattgcccaaaccaagcttgagtcatcccgaccacccgggcatagtcggtcagtgagaacctgtgatgtacctaaacaggcgagctcctggcagtcaacagataaaaggaacaaagaccacaaagcaaggaggcttgtggtggctggccagctgtga

SEQ ID NO: 29818 - DNA, 243 bp, Glycine max
  Peptide Sequence Number=SeqID_121503
atgtcaggactcatacgcgattctcctcaaatttcagtcagcccgcatcaattagactttgcaccttacgcttcagggccctacaatgctcagtggaatgccccggggctcctccatgataagcacaccgaaattgcagtatcaaggatagcctttatggataaatgggtggtgggtaatgagaatggctggtattggctgagtaatgatgatgttgagctggtggggaacttggccgtgtag

SEQ ID NO: 29819 - DNA, 255 bp, Glycine max
  Peptide Sequence Number=SeqID_121504
atgccatttcagatcctgtcaaacaccgctgccagcatcaccgatttaaagcgtgatcccatgggaacagtgcgttcagcggaaggggaaaccattgctatcttaaaccgcaacgagcccgctttttactgcgttccaccggctgtttaccaatatctgatggaattagcagaagatgcagaactgggtcgtatcgctgatgaacgcatttctgaattagcggatgcgaaagagatttcgctggatgacttataa

SEQ ID NO: 29820 - DNA, 867 bp, Glycine max
  Peptide Sequence Number=SeqID_121505
atggcgcatcccaccaatgaagcgtttcgcgtgatgtccgatgaggagcaaacgcgtctgctgcagagcaaaaccgattaccccgaactttacggtcatttaaaagatgtgccgctggcggtctcgcgggaaaccggcaaattgctgtatatgctggcgcgcagcagccgggcgcagcatatcgttgagtttggtacttcgtttggtctctccaccctgcacctggcggcggcggtgcgcgataacggcggcggccgcatcatcaccagcgagtttgagccgggcaaagtggcgctggcgcgcaatcattttgccgatgctggcgtcagtgatctgattgaaattcgcgtgggcgatgcgctggacacgctcagtcaggacctgccagccagcgttgatatgctggtgctggatggtgcgaaggcgatctatccggaaattttgcagctggtgcagccctggttgcgtccgggtgccctgattgtggccgatgatgccgatttcagcccggaatatctggaaatggtccacggcagccgcctctatacctcgctgccgtttgctgatggcgtcgaagttgctgcgatgaaggttaccgttccactgttagtgattgcttttgcttcggcgaaagcgggagcatttcaggcgaaaatcgatccgttaaagctggcgctgaaaccggctaacgcgctcgccagcaccgatcaggcgcagcctctggcgattgccgaagcacatgcgcgcctggcggcggcggttcgtcgccgcacagcccgctgcgcggcgacgcatcagtcaaaccatggctggaacggatccggcaactgtgcccagccgtctggccccagcgccatctcctcatcg

SEQ ID NO: 29821 - DNA, 2055 bp, Glycine max
  Peptide Sequence Number=SeqID_121506
atgaagtggttttcccgaagcgccgtactgttctctgccaaaacctgtctggccgcctttctggctttttatcttgcgctggaactcaacctggacaaacccgcctggtcactgaccaccgtgtatgttgcctcgcagctttattctgcttcgacggtgtccaaatcggtgtttcgtttttttggcaccgtgctgggcgggctgtttactctgttgatctatccggctacggtccagtcgccgatgctgtttagcctgtgtatttcactctgggttgccgtctgtctgtatctctcgctgcacgatcgcacgccaaaaagttacgtcttcatgctggccggctacagcgccgccattatgggctttcccgatgtgacctcgcccggcgccattacctatacggtgatttcccgcattgaggaaatcaccgtggcgattgtctgcagcagcctggtgcatcggctgatcttcccggtttcgatgcgccatctgctcgaacagagcgtcgggctgtggtatcagaacgcgcgtaaattgtgtagcgagctgatgacggcgatgcccgcggcaaaatcgctggagcgcgaggatattctggtgcagatggccaactatccgcttaacgtcgaaacgctgatcacccactgcgtctatgaaggggatgccgcgcggcggctggtgcggctggtcagcgtgcagtatcagcatctgtcgtaccttatcccgacgctcaccgccattgaatcgcggctgaatctgctggcacagcagcagatccgctttcccgattatgtcgcgacggcctttcagcaatttttacaatggctgaacggcgacgcgcaacagccggtgcgcgatcgcctcaccggcgctcaggagcagctgcagcaggcctggcgcgcagggcggcttaacagtgaagagagcattttgctcatcggcctgctggaacggttactcaattttgtccgtattgccgatgcttaccacagcgtcagcgagcgcgtcagtgactggacgccagcggtgaaaccgggcaaggcgtcacgcgcgcacaagcatgtcgataaagggctattactgctgtcgtgctttactgccttcatcgccacctttgccagctgcctgttctggatcggcagcggctggcgtgatggttcaaccgcgccgatgatggcggcggtgctgtgttcgttcttcgccgggctggatagccccatcgcgccaatgaagctgtttctgaagggcgtactgatctccatggcgatcagcctgatttacgtcacgctgctgatcccgcaggcggtgacgtttgaagcgctggtgatttgcctcgcgccgggattgtttgctttagggctggtgatcgccaatccgtccaccaacctgatcggtctcatcgtcgccacgcagatccccggtttgatcggcatgagccaccatttcaaacccgatttgcagcttatagtgaatgccatgatctcgacgctggtgggcattgccgttgcgctggtgctgacgctgctgattcgcaacaaacgcccggcgtggacggccacgcgtgcgctgcgtaaaggcattcgcgatctgctgcagtttattaccgcgctgcgcatgaacaccgcaacgctgacggcgcggcagcaatttgtcgcacgcacgctggacagggtaaacgtgattctgccgcgtaaacgcgtcgatccggcaccggagctggtggcgggcggtaatctgattgcggaggcctggctcggtgctaactgctatgactattacacccgtcatcggcacctgctgctggcgaatcagatagaaagcgcgaccatgtttcacgagctgagtcagtttcttaagcagcggctgaaaacgctgtacagcacgccatcgcctgcgctgctgcatgagcttgatgtgttactgctgcggctggaggcggcgacgcagcaggaaaatgcgctgtttgcgccgctgtttcatctgttcaatatccgtctgtcgctctttcctggcgcgcgctggccgcagccgctggcagagcaaaaccgcacatag

SEQ ID NO: 29822 - DNA, 342 bp, Glycine max
  Peptide Sequence Number=SeqID_121507
atgaaaaaatcgatcgttcctgaagaatttcagcactattaccatgactggcacttctctcccgttatcgaagccgatggcaccctgtatctttccggggtgacggcagcgcggaaagacaaaccgataagtacccaccctgaagaacaattccatgatgcgttttataagctgggtcaaagatgtgtatatcaaagccccctacccggcatggtctgccatcggcgtgtcagagttcattccggaaaacgccctggtggaaatgcggattgtggcgaaaagggtgcttcaggcggatgggcaaaaataaccgcaaccgccgcttacgtcacagggctgtga

SEQ ID NO: 29823 - DNA, 2394 bp, Glycine max
  Peptide Sequence Number=SeqID_121508
gcgcggccatcacgctggacggaaaactctttcataccctgacgccgcagctttcttcttattacggcattcaggttatttatcaggatttgtcgttatttcccaatctgtcagtcgccgaaaatatcgttattcaccgctatttaccgggcggtgatttctgggtacatcgcgagtcaatgcgcaaaaaagcgctggcggcgatgcaacgggtcggcgttgctctggatccggatcgtaaagttgaaaagctgtcgatcgctgaccgccagttagtggcaatatgccgtgccatcgctgctgacgccagtctggtgattatggatgaaccgacggcgtcactgacccgcagcgaggtgaatggtttgctgcgggtggtgaatgaactcaaagccgccggtatctgcgtggtgttcgtcagtcaccgtctcgatgaagtgatggaagtggccgatcgtatcagcgtgatgcgcgatggcaaactgccatctgccgcaccgggcgcccgccgatgtgacgccactgctggaaatcagccagctgagccgcaaagggcagtatcacaatatttcgctgtcgctgcgccagggagaaatcacgtcgattatcggcctgctcgccagccggacagcggagagatccgcatcaacggcaaggtggtgaaattccactctaaccgcgacgccattcgtcacggcatcgcctatgtgtcggaagaccggctgacacaggggctcatcatggatcaatccatttatgacaacacgctgctgcataccggcgccggattgatggatcaccgcaaagccgcggcggtagttaaagatctgatccgagacctgaacattaaagttccggacagcagtttaccggttaaaacgctctccggcggtaatgcacaacgtatcgccatcgccaaatgggtggcgacgcggccccatatcctgatcctcgattcaccaacggtaggggtggatatcgccaataaagaaggcatttaccgtattgcccgcgatctggcggaatccggcatggcggtgctgatgatttgcgatgaaatcccggaagcgtattacaacagccatcgcgtgctggtgatgcgcaaaggcgaactggtagcggagttcgcgccgcaccagagcagcgaagcgcagattgcggaggtgattaatggcgccagcagcagtgaatttatgacgctgggtaacctgacagacgtcgccaccagctatgccattctgggcattctggcctgtggtctgtttgtggtgctgattgccggcggcatcgacatctcctttcccgccgtcacctccatcggtcagtacgtgatggcgagctacatcattcatcacggcggcagctttccgctggcgtttgccatgtcgatggggattgggttgctgctcggcctggtcaacggttttctggtgtactggctgcgcgtgccggccatcattatcaccatcgcgacgctgaacctgttttacggtttgctggtgtatctgactaacggcacctggttgtacggtttccccgactggtttatgaacgggatcagctggttctcgttcaccgccgccgacggttacgactatggcctgaccctgccgctgctttgcctgctgggagtgatcatcgttaccggcgtcctgatgaatcgcacccgcgtgggccgccagatttacgccatgggcagcaaccgtgacgccgcatcgcgtctcggtctgaacatcctgcggctgcatttttacgtttacggttttatgggattgctggcgggtattgctgccgtgcatgaccggcgggcgcggctcgctaaccggcaccattctgggcgtgatgctgctggccttcctgcaaaatggcatgaccctgctgagcatttcatcttactggcatcaggtgttcagcggcgcgatcattctgttgctaatcattgtggccgttgccgtgctgttctcctttacgctgggtggcagtttttacagcgtcggcaatttccagtcgatctcctcgcagttaccgattctgggcatgctggcgctggggatgggcattaccatgctgaccggcgggatcaacctttcgatcattgccggtgccaacgcgtgttcgctggtgatggcggcgattctggtggcgcatccgaaccagccggaatatgtcgcgctggcgctgcttgcgggtctggcggtggcgctggtgattggggtgctcaatggcgcgctgatcgcctttatcggggtttcaccaattctggcgacgctcggcaccatgacgctgatcgccgggctgaatattctgctgaccaacggcgcggtcatttccggtttcccgccggtaattcagtacctcagcaacggcagcctgctgggtattccggtcgccctg

SEQ ID NO: 29824 - DNA, 282 bp, Glycine max
  Peptide Sequence Number=SeqID_121509
atgtctggacccataatcgatgaagtcacaggtgcaaggggagctgatgtacggatggctttgcttgaactggctgaaccttcagcaccttatatcccaggctacgctcaccttgcttttacagttgaagatcttgatacactgttgagcaaagcatcggactatggctggaagacgccgggtaaacctcagacagtgttgctcgccatcgacaatcagcgtactggccagatccagatccccaatcgcgaaggcagaggcggaattgagtttctcttttga

SEQ ID NO: 29825 - DNA, 328 bp, Glycine max
  Peptide Sequence Number=SeqID_121510
gatcctggcacgcagagacaaattatggtcattctgcaccctttgtcatccagaggcgacgggcccgatgacatgcggagacaaaatttggttattccgcacccctttgccattcagacacagtcgtgtccgatggcacgcagagacaaattatggtcattctgcacccttttgtcatccagaggcggtgggcccgatgactgcggagcaaaatttggtctatctgcatcctctttgtatcgaagacgaaaagcctgatagcacgcagagacacaaatttggtcattctgcgaacccttttgtcaatcaggcggcgaatgcccgttga

SEQ ID NO: 29826 - DNA, 390 bp, Glycine max
  Peptide Sequence Number=SeqID_121511
atgggtgaaatagaggaggtgcaaaaagagatgaaggccgacatggaggccatgaaagagcaaatgaccacaatgatgagtatgagaaaaatgatggaggtcaacatggttatagttgttgccgcaagtgctgccattgaggtggacccgactcacccatctagcatcaatcaagcaagttgtccagtcccggatatggtccagagcaagcatcccttaccactgtatggctttcctcccaactatacaccacccaatgttgcacacactcccgatgagaatgtcgacaacttcgcacccatacccattgagagccaaaaagccaatctgatcatgcacatgtctctcaacccatgggggaggatgaagcaccccaagaccacaatttag

SEQ ID NO: 29827 - DNA, 213 bp, Glycine max
  Peptide Sequence Number=SeqID_121512
atgtggctccaggatagagaaaaagataggctcttccttctgttgtcacaagtcttgttgactcagccaggagtggatgatgattcgacgttctctagagtcagtatccgtagcggggacagctcttgtttttcctgggctattgaatcaactgagaacggaataacagctgttagagtgagcgctgctagtcttagcaagtctgggacttaa

SEQ ID NO: 29828 - DNA, 309 bp, Glycine max
  Peptide Sequence Number=SeqID_121513
atgactagcaagtggattagtcctcacattcagactgtcctcttgaaacgccagccatcccgcatcaatcaagctttgtactttgtgcttgaaggccacacactactctatggaatgccccggaacaccaccgtgataggcgcaggttgtgttgggattgtaccaccgcggggctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaa

SEQ ID NO: 29829 - DNA, 423 bp, Glycine max
  Peptide Sequence Number=SeqID_121514
atggcgacaatagtggtgcaaaactattggagtaacctcacggctgaacaagctgaaaagctggcagcaaaagtaggaggtacaattgcgggaaaaatggcttttaattatatagcactcagtcagattctcattcttttctttgaaaaagctattgcgcgcttcattttctcccttggtattggatctattttttcaattggagctgcggcttcagattcggtttattcatcaaacgatctcaaggcacgcaatccgaaaatatataatgaattacgtagtaatggtgatctggatttactttactttcttcttaaagaatacctcgacccatatttagaggctattgaattacagagtgccagtccgactttatccaataatattttcaatgtttatgtcgatgggatcaggaatgtctag

SEQ ID NO: 29830 - DNA, 404 bp, Glycine max
  Peptide Sequence Number=SeqID_121515
ctcctaagcaacagtgccgtccaagcatttgcataggggagatcgacaaccaagttgacaccgcacacagccatgactcacacatgtgccgcctgagcatgcttaaacacaacctcactctagacgaaactgaactggagttgcacaaggctaaaccacatggtcagatcagagaaggggctgatgtgcgttcatgcgcagcaatgatcatgaatgagggacaaatgcgaataaatgatatgattgtccctatgctcgatcccttgatcagcttacagggaatagaagagaagactgccaagttgaaaggaagtgagaaggctctagttgcacggcatgaagctagtcatgctgtactaggtactgcagtaccaaaccttcttgctggacagccacatgttgag

SEQ ID NO: 29831 - DNA, 330 bp, Glycine max
  Peptide Sequence Number=SeqID_121516
atggtggtgagtattgtggaccatttgatgtctactgcaagtagcatggatcctgttgagaagaagattgttagaagccatgatgtgaaattcatggaagaccaaatcattgaagacattgataagaatatgaatactgatgttcagaatgatgttgatgtccaacaacctggagatgaggtagatgttcctgttgatgatgatgatgaagaggagcatgacatgtcacaagatgaaaatcttggtgatgctaccaaaccacctcaagttcaactcaggaggtccaatggggaaagacaaccttctaagaggtattctcctaatgagtaa

SEQ ID NO: 29832 - DNA, 63 bp, Glycine max
  Peptide Sequence Number=SeqID_121517
atgaggacattgaagttttatgaaagttttcaaagcataggaaccgaggacgttgagtcctaa

SEQ ID NO: 29833 - DNA, 393 bp, Glycine max
  Peptide Sequence Number=SeqID_121518
gttcaggatatggtcattcaacaacatggacctgatgtgtgggaatggactactgaccctacaggtcaatatacagcaaacaatgcatataaggtaataatgggaggagcaacagaaataacccaggaggaatgttttgtcaaattatggagcataaaggttccaagaaaaatagcaatctttgcaccgagactaattagaaatagacttccgacaagacagagtttgcagtggaggcaagtgcaggttgctgacacgtcatgccaattttgcagggacagtgaggatgatgcaattttcattctttggacctggcttaggaactttgagaaaggcttcacagaacattttaatcactggtgcagtagtattagacaagcttttctgtactag

SEQ ID NO: 29834 - DNA, 231 bp, Glycine max
  Peptide Sequence Number=SeqID_121519
atggcgggagaggaaaagcgcaacaagaaggaactcatccaacaccttcaaccagaactggaccagcagatccaagaaggagggaggcaactcgtccaacccatcaacacagtctccacatggaaagcagatgacatattgcttctgactgtccaaccagtgaatctgaaatcaatgaagaagaggtggaagaagagctttaggaggaagctatgcaagatgatatgctaa

SEQ ID NO: 29835 - DNA, 426 bp, Glycine max
  Peptide Sequence Number=SeqID_121520
atgagaaagcgccacgcttcccgaagggagaaaggcggacagggggaaacgcctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgcgcatgcaagcttggcactggccggcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 29836 - DNA, 286 bp, Glycine max
  Peptide Sequence Number=SeqID_121521
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggcaaagaggggtgtgaaatcccacattgcaacag

SEQ ID NO: 29837 - DNA, 261 bp, Glycine max
  Peptide Sequence Number=SeqID_121522
atgatgaaaaaggtgatgacaaaaagctcaaagatcaatcaaagaacaactcaagtgaatcaaagatcaatcaagaacaattcaagagttcaagataagaatcaagaagaattcaagactcaagaagaaagtctagagacaagaatcaagattcaaggttcaaagatctcaagaatcaagatcaagattcaagactcaagattcaagaataaagagaagactcaatcaagacaagtattaaaaagtttttcaaaactttga

SEQ ID NO: 29838 - DNA, 231 bp, Glycine max
  Peptide Sequence Number=SeqID_121523
atggcagaatcgtcaaagaaacgaaagggttcttccgcctctgcttcggcttcaagagctcatcgttccggagccactagcgcatccaaagcaccaattccaccctcattgtcttcttccccattgttttcttccgaagaacagcagaaacggtattcaaatcttttctcatctcattccattatcgaccctaagtttattgatatggattcttctctgatgaacctttga

SEQ ID NO: 29839 - DNA, 674 bp, Glycine max
  misc_feature (132)..(132): n is a, c, g, or t
  Peptide Sequence Number=SeqID_121524
cgccacgcttccccgaagggagaaaggcggacaggtatccggtaagcggcagggtcggaacaggagagcgcacgagggagcttccagggggaaacgcctgcctatggaaaaacgccagcaacgcggcctttntacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtactcatggtccttgggtgcaaatcgcaacacggttacaaggtgagtccaagagggttagtcttggcatgcaaggcagagaaactattcttgagaggggtgtgcgtgaggtgaagcaagaaacattaactgattctgagggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 29840 - DNA, 745 bp, Glycine max
  Peptide Sequence Number=SeqID_121525
aatcgacgggctttgtaaatcacacgcgggtattattgatggcctgcatatatcaggggactgcccagtggcgcggataaataaaatctcgatcacgctctgtgctttactgtttacatcactcactttcacgccagtggcaaacgcctctcagcaggcgcggcattctgctgtacaaaaaaaccatctggtgaaaaccacagaacgtaagaaaaaaaccaccgctaagaacgacaagaaaaaaacaccggctaacacgaaacaaaccgcttccagcaagacgaaaaccacctcttcccgcactgcccgcaccgccaaaagtaaagcctcacagaccgccgctaacctcgttactgaaaagtgcatcacgcgtaaaggccacaaagcgaaatgtacaaaggtcacgaaattagcagaagtgcataaagtgcgtgttcagaaagcgcaaaaaaccgcaatgaacaaactgatgggtcaaattggcaaaccttatcgctggggtggcacgtcgccccgtaccggttttgactgcagcggcctcgtctattacgcctataaagatctggtcaagttccgtataccccgtaccgccaatgagatgtaccacctgcgcgatgcctccccggttaaccgtggtgagctggaaaacggcgatctggtgttcttccgcactcagggccgcggcaccgctgaccacgtcggcgtttatgttggcaacggcaaaattcatccagtcgccgcgtag

SEQ ID NO: 29841 - DNA, 106 bp, Glycine max
  Peptide Sequence Number=SeqID_121526
cctgtcacccatcaggccccctaccaaccgagctttcatcaagaagtattgcgcccccaggcaggcgcagggtgagacaccacaacagcctggggatagtcggtag

SEQ ID NO: 29842 - DNA, 306 bp, Glycine max
  Peptide Sequence Number=SeqID_121527
atgaaactggccaaatacaggctaaaggcccaagtggagaaggacaaagcccccgagtggagaaggatgaaggcccaagtggagaaggatgaaggcccagaggcagagacactatcaagacaattaattacttatcaaggtaatccttgtggcgtctaccctgacttatcttccttcactggaagtggcgtctacccagacttatcttccttcaccggaagtggcgtctaccctgacttatcttccttcactgaaagtggcggcatccaaatctccgtagcctgtatcaaacgatccgcctcgtaa

SEQ ID NO: 29843 - DNA, 141 bp, Glycine max
  Peptide Sequence Number=SeqID_121528
atggaagaaagaaaatcaaagaggcgccacaaacaacaagttcttgctcttgtcatgggtcctcctatgccttgtattgggctcgggcttccatctggtcatgggcctggggctggtgattgtcatgggcttgggctttga

SEQ ID NO: 29844 - DNA, 195 bp, Glycine max
  Peptide Sequence Number=SeqID_121529
gtcgactctagaggatccccaacggttcctggccccccccctgatattggaggagggccaactgtgcgagcacaaccagagagggaggctatcacacagctactatgcataccggggcaagatttcacccgtgccgctgcaaaaagacgagtgcggatcatgcgcactaacatgaccactcttacacagatatag

SEQ ID NO: 29845 - DNA, 96 bp, Glycine max
  Peptide Sequence Number=SeqID_121530
atggcctctggtaagtttgaagctgattcccttgataatgcttcaatctccaagtccaaaggaactaaattgcctgtgggagatctatgcatttaa

SEQ ID NO: 29846 - DNA, 672 bp, Glycine max
  Peptide Sequence Number=SeqID_121531
atgggtgatcaagaggagacgcaggaacagatgaaagccgacatgtcggctctgaaagaacaaatggcctccatgatggaggccatgttaggtatgaaacagctcatggagaagaacgcggccactgccgccgctgtcagttcggctgccgaagcagacccgactcccttggcaactacgcaccatcctccctcaaacatagtaggacggggaagggacacactgggacacgatggcagccctcacctgggatacaaccgagcggcttacccttatggattgccgcccaactattcaccacccatcttgcaagaagatgcgggccacattgcttctcccgtccatgaaaaagaacctcctcagcagcccgacgaagtccataaagaccctcaagattatgctcggagggatgtcgagttttatcccccgatccccgaagggccggcaccaggcacgttgccccaacccaacatcgcagcatcgccaatagttttgtctatggaagggccgcccccggcaactgaagaaaggaggaagctcgatctccttgaggaaagattgagggctgtggaaggatttggggactatccgtttgcagacatgacggatctttgcttagtacccgatgttgtattcccccgagcttcaaagtgccgacttcgacaagtataa

SEQ ID NO: 29847 - DNA, 501 bp, Glycine max
  Peptide Sequence Number=SeqID_121532
atgccatgggatatatcaacggtggtatatccagtgatttttctccatttagcttccttagctcctgaaaatctcgataactcaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacagcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 29848 - DNA, 511 bp, Glycine max
  Peptide Sequence Number=SeqID_121533
gtgagaatttcagccctatctctccttcggggttcaacctccttaagcggtcagcgggcataattgaaaaaagaaaggcactctatgttctcgttctcggtgctccggtcaagggcttgacctctgatgtatggaagtacgtggttgaagtgaattcctcggaaatgcagccggagggcaatctctcttttgacccgcatatggctatggttcagatacagactaaagactttctttcgtgctttgatctcagtggaagtagacttttcaaaatcttccggatagtcaccgcgccattcatagccatcagggaaactgccctcttccctcaagatggtccgtcttgcttctgcttgatggaaactagggttcaagttcagacttttcgaaatcaagacatggcgggggcaggattcgaacctgcaatcttcagttatgagcctgacgagtaccaactactctaccccgcttcttccccttctctttcttttctttcacgattcccacctag

SEQ ID NO: 29849 - DNA, 192 bp, Glycine max
  Peptide Sequence Number=SeqID_121534
atgggggtgcaaatagcaaccaggccaacttgggccctccttgcttgcctgggcgagctgggtggcaagcttctcccccattttcttataaataaggggagaagtgaagagaaatttcgttcagccctcctggtttttgaccgttcttcgacgttcttcattcgttcttcatcgttcttcggtcttcaactg

SEQ ID NO: 29850 - DNA, 540 bp, Glycine max
  Peptide Sequence Number=SeqID_121535
atgattatgaggggccaagacatttatagtagccaagataaggctactacttcaccttcctctagtgaaagtgaaaaatcaaaaggggaagaatctagtgaagaaatctacccccaagaagaaggacaaccattagtggttaaagagaagtgtaaggaggtaagtgtctcctccaagaggttagctaagaaggaaactcattttacaataaagacaaacattgaagaaactttccctcttagacaacctccacattttctcttttgtaaaaagacacttgctagcattgccacacctctagggcttgagtttattcctcaagtaaagaagttgttggatgagggtttggttcgcaagagctttattccttgtgctttgttggtgcccaaaataggtattattaggcaccaagtccctaaaatatgtggtatgatgaatgttttgagtggtgcaaccctcttttgtaaaatcactcgtacacctaacatcttcatggtgttgagggaaggagcccagagtatgaagaacctcgggatttga

SEQ ID NO: 29851 - DNA, 387 bp, Glycine max
  Peptide Sequence Number=SeqID_121536
atggctgaaccttcgaagaagcgaaagggcactttgagtcagagtcaacggcattccgggtcacagaaaatgccaatcccttcctccattccctctggatcattgttttcatcagaagaacagtgtatacggtacacaaaactcttttcctctcgttccattatagacccaaaattcatagatatggatttcttctcaaatgagagttttgaatgctttcaagcatttgaaaactccaatcttattccattcatgtctctgaaattaccagtttattctgaactagtcaaagctttttattctaatttagaaatccatgaaggtaccctaatgtctaaagtttatgggattaagatggtcattgaccagtccctattctatgattaa

SEQ ID NO: 29852 - DNA, 472 bp, Glycine max
  Peptide Sequence Number=SeqID_121537
atggccaagttcgacccagacatagtcctcgagttttatgccaatgcttggcctatagaggagggcgtgcgagatatgcgatcctgggtgaagggtcagtggatcccgttcgatgcggatgctctcagtcaattcctgggatatcctttagtgctggaggagggccaggaatgcaagtatggccagaggaggaaccgggccgatgggtttaatgaggaggccatcgcccaattgctgtgtataccggggcaggattttgcctggactgctactggaagacgagtgcagatcatgcgcaccaacatgaccaccctgactcagatctggatgactttgctgctcagcaacatccagcccagcgatcataattacgacctccccctgctgaagtgtcagctggtgtacgccatcctgacacggatgagcattcacgtggctcagttaatcgctgatgccttctatctatttgcag

SEQ ID NO: 29853 - DNA, 294 bp, Glycine max
  Peptide Sequence Number=SeqID_121538
atgaccaaactggtctctgctgtcatgggcccccgcctctggatgacaaaagggtggcgtcacatgcctcagggtcagtatgacaaagattatggggcggccgacaaaagcaaagctcttgctctacacttaaaaagtctccatcggaaaatgctgacatctccggaaagggcgcagatgaccatattggtctctgcgcgtgaatcacacttggggtcactgaatgacgaggtgcggataaccgtaaggtgtctccgcgggctaccagctcttgagttatggcaacaaaaggcg

SEQ ID NO: 29854 - DNA, 213 bp, Glycine max
  Peptide Sequence Number=SeqID_121539
atgactacaggatcatcggtctactctacctcaattcaccatttcgaactttatacagaagtaatggaagcaatcgtccctaccgtcgataaaataagagcacctggctctgcccattcacaaggactcgattctcatgtccaaacatcacatgccagcagatgtggtcaccatcataggtactcaagatattgtgtctggagaggtggatag

SEQ ID NO: 29855 - DNA, 432 bp, Glycine max
  Peptide Sequence Number=SeqID_121540
atgccacctacgaggcaccctctagacccaaataagtctaacagggccctgggttttccggcattgatcacgggtctctgccagtcgttcggggttcctgtcacacctagtaaggtgattcgaccgccgatcacccgggctttcatagagaagtactgcacgcccagacagccggcggccaaccacagggcgcacgtgcagacccatgactgcctctaccagctcagccttagcctgcagagccagggtttcacttcttttccatgccctactccggatcagttcagggcagaggtcgcatggcccggggattggcctgaggcccaggcaggggaggcattggtagaggttcccggcgatgcagatgaggcccgcatggacgaggagatgaccgatttgctcgatttcttgggagggagcggagccacgtga

SEQ ID NO: 29856 - DNA, 811 bp, Glycine max
  Peptide Sequence Number=SeqID_121541
gtcgactctagaggatcccaccctcgcctttcatcatggcaaggaaagcccggtcgtcgccattttggccatgaaggaagaatcaagattctatcttcatgtgaaggatgtcccatgagaggagtgccatcagacgaaagcatcacgcctttcatcgcacgaggtttcagtgaccacaacgcgagggacagagagcttaggggaagcagtaatgggatcatcggcggctatcataagtggctgagagtccgaatacaaggactggattggctcccaaatctaaagactgtgagagacgatgaggttaaagcttcggaagaaagtgatgaggtacaagccctaaaggcagagcttgaaagagcctgggtagtcgaagagaagttcaagtccatagccatcaaaggcagcatagtgagctcaagctccgaagaggtgaaaggaatcatcacgggtcaaaggcatgatctgaaggacgagctaaaggtttgccttaggtcgaaaagaaatttgtcccaacagttaagcgagactgaagggaatatgtgggccatcatcgataagtgcaaagagaatctaaatctagcggtgactcacgagcaaaggctagaggatgagtacgccaagatatcagcagaaagggaagcaagggaaagggtaattgattcattgcaccaagaggcaacaatgtggacggaccgatttgctcttactttgaacaggagtcaagaacttcccccattgctagccaaggccaaagcagtggcggacacctactccgcccccgaggagatccacggactactcagctatt

SEQ ID NO: 29857 - DNA, 1083 bp, Glycine max
  Peptide Sequence Number=SeqID_121542
atgacccggccagctctggtcgacgcgctgggcgaactgggcgagggccacattgcactggtcgccaacgatggcgcggacctgaaggtcgcgccgacctcgctggctgcacgcgtgcgtggcccggcagcgatccggcgcctgctggcgcacctgcacggtgccagggatctggccgaagccaaggcgctgcaggccagcctgccggaaggcgattcgaccatcacccagggcggtgagcgcctgggcgagggctggttgcgtgtgtcgcgttccggcgcggcccagcagggcgcgctgctgcgcgaacgcgagatcaatgagctgcgcgagcagatcgagcagctgcaggaccgcgaagccgagctggaagagcagctgagcggcttccgcgagcagttgcaggccgccgaacagcagcgtgaagacgcgcagcgtgcgctgtaccaggcccatcgcgcggtctctgaactggcaggccagctgcagggccagcagggcaaggtggaggccgcgcgcacgcgcatcgaccgcatcgaaggtgagctgaagcagctgcaggacacgctggaagccaacaacgagcaggcgcgtgaggcgcgctcgcggttggagaacgcggtcagcagcatgggcgacctggaatcgacccggcagcggctggagggcgagcgccgccagctgaccgaggcccgcgacctggcgcgcgacgctgcacgtgcggtgcgcgagcggtcgcactcgctggccctgaccctggaatcgcagcgggcgcagctggcctcactgagccaggcgttggagcgcatgggtacccagcgcgggcagttggattcgcgcctgggcgaactgcattcgcagctggatgagggcgattcgccggtcgaatcgctgcaggccgaacatcagaacgcattggaagagcgcgtgcgcgccgaccgcgtgctgaccgaggcgcgcacgttgctggacggcatcgatgccgaactgcgcaactacgaacagacccgccaccagcgcgacgaacaggcgctggcccagcgcgaacgcatttcgcagcgcaagctggaccagcaggcgctg

SEQ ID NO: 29858 - DNA, 279 bp, Glycine max
  Peptide Sequence Number=SeqID_121543
atgctccactcggctcggggggatatagctcagttggtagagctccgctcttgcaattgggtcgttgcgattacgggttggatgtctaattgtccaggcggtttgaaaaaggatcttagagtgtctagggttgtgccaggagggtctcttaatgccttcctttttcttctcatcggagttatttcacaaagacttgccatggtaaagaagaaaggggaacaagcacacttggagagcgcagtacaacggatagttgtatgctgcgttcgggaaggatga

SEQ ID NO: 29859 - DNA, 210 bp, Glycine max
  Peptide Sequence Number=SeqID_121544
atgggggtgcaaatagcaaccaggcccacttgggccctccagaagattcctccagaaggctgttgcttctggaggaagcaaccctgctcgcctgggcgagctggaaaatccaagccgaggcgcttccataacgtttccgtcagtgatttcgcgaaggttttcatccgttcttcaccgttcttcatccgttcttcgttcttcaacgtgtaa

SEQ ID NO: 29860 - DNA, 258 bp, Glycine max
  Peptide Sequence Number=SeqID_121545
gggggtaggattgcatcagggctgccgtcggcagtggaaggaagagaaaagaacaatctcatcgaagagagattgagagtggttgaatggttcggtgattatccctttgccaatatgaccaacttatgtttggtgtcggatgtcgtcatccctcccaagttcaaggtggagagacttggcggctctagtggcacctcctatgctggaaagggagatgattgccatgatagtagacactctgctggtgttttactatga

SEQ ID NO: 29861 - DNA, 822 bp, Glycine max
  Peptide Sequence Number=SeqID_121546
atgggatcaagtcaaaagccttcgcttaaaaagaagttctatcaagtcaaaattaagagcttagaggtcactagtttacaagagttagggcaattaatgggtcaacttcaacggcaagccttccgcaaagcctatggtaagatttgggacctagctagggtagaagtctccacagagtccattgcctccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaaggtggtgaaaatctcagcacaagagttggaccgtgtaaagcaaaacaggaatggggtagtcggagtaccaaggaaatgtttggagggagtcctctttccaaatgtggatgggttggtggacctggtagcgatcgacatttttctcgcctatcataaccacaaggaaagtccggttgtcgctatgctagccgacctatatgacaccttcgaccgaagatgtgaagaaagcaatgcaaggattgtttgctgtactccagctctctatgtggggctggtttcacacctttttctccaagaaggtaggcccgtctatccgctacaaggttaccgctcgtgcgtcgaaaaaggaaaggcgaattgggaccaactcttggctagcatgggggggcgtctgttaattggttccctcgctagaaggaaggaagaatcaagattctatcttcatgcgaaagatgttcaaatgttcccttga

SEQ ID NO: 29862 - DNA, 402 bp, Glycine max
  Peptide Sequence Number=SeqID_121547
acacttgttagcactgccacacctcttaggcttgaggttattcctcaagtaaaggagttattggatgagggtttagttcataagagcttaaatccttgtgcttttttggtgcccaaaatagtcatgcacccaacatctggcgagattcatgtacatagggactcattaggtaggcttgttcttatttttggttttaatacaaacataggtgctcatatgggacaccttagtgatcaaggggttctcatgaatcctaagagaataaaggtcattcctgagtggcccactccaccaagtgttgagggaagaagcccaaagtttcaagaacctctggatttgaggtcaaatccttttcaagggggagggaatgatgctatcctaccccctaagggcattggatag

SEQ ID NO: 29863 - DNA, 318 bp, Glycine max
  Peptide Sequence Number=SeqID_121548
atgatcttcttagggagtctgtatcgacaaaatcagttccttctttatgaatctgaccaccacactcctcgtgacattggtataagaagccacttcgacccatttggtgaaataatctatcgccacgagaatgaagcgatgaccgttcgaagctttgggttcgatggccccaatgacatctatcccccacatggaaaaaggccaaggggcggacatgacgttcagaggatggggcggaacattgacattgtctgcgtacgcttgacatttattgatggaagcttgcttgtggggcttctatggaggctggatctttga

SEQ ID NO: 29864 - DNA, 113 bp, Glycine max
  Peptide Sequence Number=SeqID_121549
ggggtgggggtgggggtgttggaaagtcgtttcaattgctcgacttaattgcagccttagcagagttggttgctaaggtcttggaaatgactacttacaaatgggattcttaa

SEQ ID NO: 29865 - DNA, 210 bp, Glycine max
  Peptide Sequence Number=SeqID_121550
atggaagaaggagtttcaccaccaagatcagccttggataagaagcttagagaggatgcttcaatggaggaaaagaaagagggagagaaagagagaggggggagcacgaaattgaaggaagaaaaagggagagaagtagcttccttgagaagctttcttgagaaaacttccttgagaagcttctttgagaaaacttccttgagaatctag

SEQ ID NO: 29866 - DNA, 306 bp, Glycine max
  Peptide Sequence Number=SeqID_121551
atgggcttcaatcggaggtatagtcctcaagcctacccttatggcttgcctccagacttcactccccataccactccagacaacttgagccaagcccctaccttcgaggggcaactccctcctcatgccgactaccctctggaggaagatgataaaggggatgctcatttaggccctctgcttcccccaagggaaccgaccccccatgagttgccccagccaaacataatccaccatgcctcggtctcaatccgcacccatctagaggaacccgttcccccaaaagacaagggaaagatcgtctga

SEQ ID NO: 29867 - DNA, 511 bp, Glycine max
  Peptide Sequence Number=SeqID_121552
cgtgagctatgagaaagcgccacgctcccgaagggagaaaggcggacaggtatccggtagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcaagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 29868 - DNA, 612 bp, Glycine max
  Peptide Sequence Number=SeqID_121553
atggataatgaaaagggcgtgcaggaacagatgaaagccgatctatcggccttaaaagatcaaatggcttccatctcggaggtcatgctaaaactccagaaaactatagaggataaagccacgtcaaccgcctccaatacagctaggaaagcggagccagtgctacaacccgccttaaatctgggccgagacagaaacacgacagtgtttggtcggaggtatagtccgcaagcttacccctatggcttgcctctggacttcactccccgtgccgccccggaagatttgagccaagcccctaccttcgaggggcaactcccaccttatgccgactatcccgtgcaagacgatgaggaaggagatacccatctcggccccctgctccacctcaaagatccatccccccatgaactaccccaaccaaacatagtccgccacgtcccatcttcacccgcacccgtaatcgaatccattcccttcgcagaggataagggaaagattgatgcgcttgaggagaggctgagagcggtagagggcctcggcaattacccattctcggatctagcggacctatgtctcgtgcccaacatcgtcatccctcccaagttcaaa

SEQ ID NO: 29869 - DNA, 338 bp, Glycine max
  Peptide Sequence Number=SeqID_121554
atgggtgaagtagaggaggtgcaaaaccacaagaaggctgacatggaggccatgaaagagcaaatggccacaatgatggaggccatgatgagcatgaagaagataatggaagccaatgcggttgtagttgccgctaccagggctattgctacggtgaacccgatgcccccatctgatctcaacaaaatgaatcatccaacctcagatatggtgggcgaagatttgggaagtacggacgaccccatgatgtgcaaattcaaaaccagcacactttcccaccatatggcttgcctcccaactatacgccacccaatgtggcgtacactcccaatgagaat

SEQ ID NO: 29870 - DNA, 282 bp, Glycine max
  Peptide Sequence Number=SeqID_121555
atgaaacaaacatcaagatctgcttttatagctcgttcacaacaacccgtgcctgacatcaagaaagcgaccattgaagagttatttaaccttgagaaaatctttgagaaagaccatttgaagagttacatctccttgattttttattcagaacgtgtcactgatacactggtaattggtaatcaattaccagagagtaaaaactctggtaacttagaaaattttgagaaaatcttttgtttaagggaaaaagaatcaaaattctcaactgtgctattttga

SEQ ID NO: 29871 - DNA, 438 bp, Glycine max
  Peptide Sequence Number=SeqID_121556
atggtctggggaagtagtccccttgtactgtcaaagtccgacaccttgaacttgggaggggtgatgatattgggtactaggaacaactcttctaggggtatatcgctaactgcttgcccttcagtgcatatgggagcaagtggtgttgtcattggaagtgcggtagacagactttgtggtagatttagggatggcgcatttgtggataactgggtggtgggtaaggagaaagtttgttattggctgagtaaagatattgttgggttgagtgggaaacttggccgtacaggatggcagtcacagcatgggtttctcctctcatcctcaccctctttatttgccccagttttctcagtcgtcctagtagggtcaaatttgcctcttttcggacccacattgatcctttcactggcgaagaccaaatctgcaaagctttga

SEQ ID NO: 29872 - DNA, 459 bp, Glycine max
  Peptide Sequence Number=SeqID_121557
atggaaacgtgtttgggagtagaggaattgttacagcaaatgatagatcaaggtcgactggaagttagcagtgaaggaagagaggagcagcatatatgcatgcagtccacggatgggagcagtgttacgaagcccaaacccttggtgatatacttcaccaagggcacagcttcgcaaaagcccggacaccccttagcaactaaacctgtcctttcccataccaaaatagccacgcagtcccatggagatatacacctccgaaggggaaggaagaagaagccaccgacgtcagctcgttgtcggctaagcggtcgggtgtttgcgcctccggacctaccagtccaacccgcgaacgtcaaggggaaaggaaaagtggtggaggaacaagatggtgaagcacctcacgcttcgaataaagatgttcccggcgaaaggtcttccggagaaaaaggatggtaa

SEQ ID NO: 29873 - DNA, 210 bp, Glycine max
  Peptide Sequence Number=SeqID_121558
atgacttctgaaactgtaaatcgagttgactctgttgatgatattgagtttatggaagatgaggaagaagccagggttgaacctaaaccaaatgcaaaggagaacaaaagtgacaatgatgaaaaaaagagtaaaaaagttaagagtcctgaatggctagttcacaactctattcggagtcatttctttctaatcactcataacctttaa

SEQ ID NO: 29874 - DNA, 204 bp, Glycine max
  Peptide Sequence Number=SeqID_121559
atgaagatgctcttgataccacatgatgtaactccttgtggagcttgtaggccttggatcttcttcatcaatggagtccttagcttcttgaagtttaatggcagtgaaatggagaaggagaaagatgattggagatgccacttcaaggagaagatgagtcaagaagaagctcaccaccataagaagccatggataagagcttga

SEQ ID NO: 29875 - DNA, 552 bp, Glycine max
  Peptide Sequence Number=SeqID_121560
atggcatcattggtggattggctcaccaagttaaaagtcgtcagcgaagaaagttttgaagcaccggaagaggacgaagaagtccaagctcttaaaagcgagttaggaaaggcgaaacttgccaaggagaagttcaagttggccgctacacacattcggaaggagtgtaccggagcccttgaacaagagaccaagagggctcgcaaggaagagtatggccggaataaatttcgtggagctctgtggggtagcagtagtgaactcaagctacgaagggaggagagggaccagtcgcgagcacatagcatggttctgaaagaggagttagttgcttgttcaaggtccaaaagaagcttatctcagcgtttatgcgagacggagaccaacatgctagctatcatcgccaagtaccaagaagagcgggttggaaaccagttgactgttctacctcctatcccagccaagtgttggtcccaatctactcttttttttcgacacatgagcgatggcttcggagtgcagacatggatgccttatgtcttgttggaataa

SEQ ID NO: 29876 - DNA, 153 bp, Glycine max
  Peptide Sequence Number=SeqID_121561
atgcatagccaggatgtatttgcgaatgaaaccacgcatccggtgtttcctgacgaaagccataaacccattaaacctgacccagatacaccttatcagcccattgaaccagaagagccagatgtgcaaccagaaattatcggagaccagtga

SEQ ID NO: 29877 - DNA, 399 bp, Glycine max
  Peptide Sequence Number=SeqID_121562
atgggggaatacgcaaaagatgaggaattgttgatacatttcttccaagaaagtcttactggggtagttgttacctggtacacttacttggaaccttcccgagtccatacttggaaggacctaatggttgcctttacacattatcggtactctactatgaaaagatggtgggctgcgcaccctcaaagctttgcagatttggtcttcgccagtgaaaggatcaatgtgggtccgaaaaaaggcaaatttgatcatcctactaggacgactgagaaaactggggcaaataaagagggtgagaaagagggagaaacccatgttgtgactgccattcctgccatccctaaatctaccacaaagtctgtctaccgcacttccaatgacgaacaccacctttag

SEQ ID NO: 29878 - DNA, 522 bp, Glycine max
  Peptide Sequence Number=SeqID_121563
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccagcccgtggatggggaaagtgttgtgtgtctggttgctctgatatccttgtaaatgatgctgagaaggtaaacatggattttctattcatgtag

SEQ ID NO: 29879 - DNA, 123 bp, Glycine max
  Peptide Sequence Number=SeqID_121564
atgtatatacgtgtatggaaatggccccgaggaaacttgcctcaaagagatccaggaaggataaagcggtcgaaggaactagttttgctcctgagtatgacaatcaccgctttaggagcgtga

SEQ ID NO: 29880 - DNA, 126 bp, Glycine max
  Peptide Sequence Number=SeqID_121565
atggggcgtggccaagtggtaaggcaacgggttttggtcccgctattcggagatatcatcgaaaacttacagcagcttgcaacaaaagctaaaatgataaaaagagttaaggtattactggcataa

SEQ ID NO: 29881 - DNA, 227 bp, Glycine max
  Peptide Sequence Number=SeqID_121566
gtggccttgttggtgcttgcacgcttagcgcaactctggaccgcttagcatgcattagtgaatttcggcttagcgcgcgtcttctcactcaacggatggactcaagtggtgcacttggtgggatgagccctcgctcagcgaacatgcacagctcatctttcttccagatttttcctcgtgctcagccaagggagtggtgcgctctagaggatccccgtgtctcctaa

SEQ ID NO: 29882 - DNA, 237 bp, Glycine max
  Peptide Sequence Number=SeqID_121567
atggggctccgaataagatttgatggtggaggatgcacgaacagcgctaggcaatcaattcgtggagctctggactcgatggcaatcaattcgtggagctctggactcgatggtggaggatgcatgaatggcaatcaattcatggggctccgaataagatttgattttggaggatacacgaacagcgctaggcaatcaattcgtagggctccggactcgatggtggaggatgcatga

SEQ ID NO: 29883 - DNA, 219 bp, Glycine max
  Peptide Sequence Number=SeqID_121568
atggacaggcagaaatttctaacagggagattgtcataccctaatttcgtccgaggacctttgcttgatgacatgcgacctttctttggtccttgtgagaaggctgttgcttctggaggaagcaacctggctcgcctgggcgagctgggcggcaagcacctcccctattttgctataaataggggaggaagtgaagaagaaaagggttcagccccttag

SEQ ID NO: 29884 - DNA, 455 bp, Glycine max
  Peptide Sequence Number=SeqID_121569
atggcttcgaaaaagctttttgcgaagagatctaagagggacgccgcggctgaagggaccagtgctgcccccgagtttgatagccaccatttcaggagcgccgagcaccagcagcgcttcgaggccatcaaaggatggttgttccaccgagagagacgcgtccaactcagggacgatgagtacaccgattttcaggaggagatagctcgcagacattggacgtcgttggctactcacatggctaagtttgaccctgaggtagtcctggagttttacgctaatgcttggcctccagaggagggagtgtgggacatgcgttcatggttgaggggtcagtggattccttttgacgtagatgcctttagccaattcctaggtgacccgctagtgttggaggaaggccaggagtgcgagttcggtcagaggaggaacacggctgacgggtcgacgaggag

SEQ ID NO: 29885 - DNA, 210 bp, Glycine max
  Peptide Sequence Number=SeqID_121570
atgtggtggagcattgacattgtccgcgaacgcttgacacttatggcatttccttacaaggacgcagcaatcaccttccatggtgagccagtaataacctgccctcaggatcttcctggccatagcatgcccattggcgtgcattccaaacgaaccctcatggacttccttgatcatgtggttcgcctctttggcatcattgcatcgtag

SEQ ID NO: 29886 - DNA, 243 bp, Glycine max
  Peptide Sequence Number=SeqID_121571
atgtccaaatcatatggatttgggatgaccggccctctcgatgagtcgatctcttgctttctcataaggaggactacacatcctcgccttcagaggactgcacgtcctcaccttgagaggactacacgtcctcgccttcagaggactacacgtcctcaccatcagagggctacacgccctcacctccagaggactacatgtcctcgccttgagaggctacacgccctcacctttgggtactag

SEQ ID NO: 29887 - DNA, 276 bp, Glycine max
  Peptide Sequence Number=SeqID_121572
atggtaaggacgtgtagtcctctcaaggtgagggcgtgtagccctctcaaggcgaggacatgtagtcctctagaggtgagggcgtgtagccctctgatggtgaggacgtgtagtcctctcaaggtgagggcgtgcagccctctgatggcgaggacgttacccaaggtgagggcgtgtagccctctcaaggcgaggacgtgtagtcctctgaaggtgagggcgtgcagccctctgatggcgaggacgtgtagtcctctcactggtgagggtaactag

SEQ ID NO: 29888 - DNA, 117 bp, Glycine max
  Peptide Sequence Number=SeqID_121573
ggcttgctctatggacctggggttggtcaaggcactgctgcagggcaagctgtagaagggattgcacgacaaccggaggcagagggaaaaatacgagggaatcttccaattgattga

SEQ ID NO: 29889 - DNA, 720 bp, Glycine max
  Peptide Sequence Number=SeqID_121574
atgagcgataaaaaaggaagcacttcaaaccatggcttgaatttgaacatacccccaccaagggttgccaatcagatacctgattcaccaactcgattacccatagcaccaccaacatcaccatcaagctcatgtgtgtccagcgaactaagccaagatgacaacagtagcaacaacaacaacaacaacaaccgcggctgcactcggagccctgaagacatttccatggtgctagtagggtgttctcgctgccttatgtatatgatggtcaatgagggtgaacccaatggtgccgatgtcgactatggcagtggtggtggcaatattgatgacaattgtgtttttggtgaggatggtagtcgttgcataggtggtgatcatagtagtagtgtcggtgcatatggttatggtggtggcggtagcggtgccgatggtggtggtggcaatagcgatagcggtgctgatgataatgttggtggtggtagaggtgccggtgctggtggaagcattgttgcacaatctgtgaagttccgtaacatcccggaagccaaagcagggatgattacgggtgtgcaaatagcaatcaggcccacttgggccttccaaaaagttccaccagaaggcggtgccttctggaggatgagatgggtggcaagctcctccctcttttcccctatagataggggaaggagggcagaaggaaaatgttcaaccctcctg

SEQ ID NO: 29890 - DNA, 300 bp, Glycine max
  Peptide Sequence Number=SeqID_121575
atggtggtggtggtggtgtccatgtcggtgatggcaatggttgtagcaatattaacgacgatagtggttgtggcgacaatggtagtggttgcattggtggtgattgtggtagcaatattgatggtagttgtggtggtggtggttgcaataaaaatgaaaatggtcaaatctttggcgcttgacacgaggtcactactatgcaaagaaagagtggggaccacaaacactttctgcaacatatcttcagaggagtatagtttgccggtgtttcatattgctcagagctcactttcaatgtaa

SEQ ID NO: 29891 - DNA, 90 bp, Glycine max
  Peptide Sequence Number=SeqID_121576
atgggtgccaagtatctcgaagtggtcaagcaaaggttgcatgccatcaaacaatggtccgtggacgaaattaggggctccataatgtag

SEQ ID NO: 29892 - DNA, 485 bp, Glycine max
  Peptide Sequence Number=SeqID_121577
gagggtgttctcttctcatgtggaagctacccaaacatcccgttgataggaacgaggggttgcattaactacaatcccgcgcttgctataagacagttagggtaccccatgaggggagcatcgatggaagaaagcctgtctcctttccttgtgagagattttggcgcgcagaacttcaaggttatacaaagagtccataaggcgtgggaaaacccgttaaggaaagataaagaacttaggggtatttgtaatggcatcattggagacgtccggaaagagtgtgccgggttactagaagaaaatgcagctaccgcaaaagcccttgaacaagaaaccaagagggctcgcaaggaagagcatggccgtgacaaattccgtggagcactgtggggcagcaacagtgagctcaagcttcgaagggaagagagagaccgatcacgagcacatagcatggttttaaaagaagagttagccgtttgctcaag

SEQ ID NO: 29893 - DNA, 154 bp, Glycine max
  Peptide Sequence Number=SeqID_121578
gccccctactaatcaagctttcatcaagaagtactacgcccccaggctagcgcagggcgaaacaccccaacagcctggggatggcctgcagcgggaaacagacgcaccgccaccacctctagaattcacctcagctcatccacaaaaaggttag

SEQ ID NO: 29894 - DNA, 456 bp, Glycine max
  Peptide Sequence Number=SeqID_121579
atggctccgattatagtggaagagttgagaaagtttctagtggctgattcattggaagaagtgaacagaaaattggacaaattctacatggtcctcatcctgagaagcttacattcagactttgatcatgtgcgtgatcaagtccttgccggggaccaagttccatcaatgaattccctcgtcactagacttcttcgcgtgcctcatgtattgaaggatgaaaaccctgctgatgttgtggaaacatcagccatggttgcacctcataggagaagaggaggccgcaagaatagagagggccacagtggaaagggtggacgtcctcattgcacctactgcaagaggatgggtcacacccaagagaattgttattcgttgcatggctttcctgacaaggtagtgcaggtttctaggctagagaaatcagagtctaggttctatgatgaggagtattag

SEQ ID NO: 29895 - DNA, 99 bp, Glycine max
  Peptide Sequence Number=SeqID_121580
atggatgaatggaatgggtttgaaagaacaaggttgaagatgaaatggtggaaggaaagaatcactctttctagcgagggcaacacacaaaggatgtga

SEQ ID NO: 29896 - DNA, 231 bp, Glycine max
  Peptide Sequence Number=SeqID_121581
atgggggtgcaaatagcaaccaggcccacttgggccctccagaagattcctccagaaggctgttgcttctggaggaagcaacctggctcgcctgggcgagctgggcgaaaatctcagctgaggcgcttccgaaacgtttccgtaacgctttccgtgaaggaatttcgtgaaggtttcgaccgttcttcgacgttcttcattcgttcttcatcgttcttcgatcttcaacgg

SEQ ID NO: 29897 - DNA, 408 bp, Glycine max
  Peptide Sequence Number=SeqID_121582
atgaaacaggccaaatacagtctaaaggcccaagtggagaaggacgaaggccaagtggagaaggacaaagcccccgagtggagaaggatgaaggcccaagtggagaaggatgaaggcccagaggcagagacactatcaagactattaattgttgctgaaggcccaagtaatccttatggcatctacccagacttatcttccttaaccagaagtggcgtctacccagacttatcttccttcaccggaagcggcgtctacccagacttatcttccttcaccggaagtggcgtctaccctgacttatcttccttcactggaagtggcgtcatcaaaaccttcgtagcctgtatcaaacgttccgctcctactcaggttcacatcatctggtatcagagcttcggctcttga

SEQ ID NO: 29898 - DNA, 600 bp, Glycine max
  Peptide Sequence Number=SeqID_121583
atgagtgcttctagtcctagtcaagctaaagaacaagatgatgataccaaacctttatggacctatgttacaaagataaaaagtgtagctggtggtggaaattatgagataaaatgcaatatttgtgattttacctttaatgggtcttacactagagtgagggcgcacttgttgaagatgacaggaaagggagttagagtttgtcaaaaggtaacagttgccaaacttatagatttgaagaagatagacaagaaggctacattgagggtggagaggtcaaaaacaaaatctgtgtcattgcctccagtttctactcaacaccaaatggatacaaacactcttggtgttgatccaaaaaagagaaagacatcatctgtagaaaatgcctttaatttgcaagctagagagacacttgatcatgaaattgctaggatgttttactcttcggggctgccttttcatttagcaagaaatcctcattataggaaggcatttgcctatgctgccaacaatcagatcagtggttaccaacctccaggttataataaattaaggacaacattacttcaaaacgagagaagacatctggggatcctctag

SEQ ID NO: 29899 - DNA, 466 bp, Glycine max
  Peptide Sequence Number=SeqID_121584
acttatcaaggtaatccttgtggcatctactctgacttatcttccttcactggaagtggcgtctaccctgacttatcttccttcactggaagtggcgtcatccaaactctgtaacatgtatcaagcgatccgccccgcaggcacaaggcgaggcaccacagcagcctgggtgactgccaacagcgggcaacagacgcactgccaccacctccagagttcaccaaagctcatccacaaaaaggctagagcgttgcctgcaacacatgtccgaccagaaggcgaccaagtccaaagccaaagctcctcacgaagcggtccaggaagggcaccattgaatagggttccagtgcgaccccacaagccaacacaggctttgacaaacaccgattctagagcatggaacatcagtagcgttttgaggccatcaagggatggtcattcctcagacagagacaggggcagctga

SEQ ID NO: 29900 - DNA, 347 bp, Glycine max
  Peptide Sequence Number=SeqID_121585
atattccaacgttcaagcgttcggcacgacctagcatcggtcggaattcacctccactccttatttcaccaaacccgttgaactctctaaagaacgattcgaagaacggagaagaacgtcgaagaacgtgtcgagacaccttcgcgaaatgcgagactcgcgggatgcgtgttccacgaaaggaatacgcgcggagtcgccaccaacgtttatttgaggaaaacgtcggaaaaaccggaaaaaacgcgatctacgaacttttaagtgaaaggttcgggagttgtatgtgcgcacggggaaaggtattagcaccccacacgtccgtcccaagggacgacagcctttaa

SEQ ID NO: 29901 - DNA, 357 bp, Glycine max
  Peptide Sequence Number=SeqID_121586
gggggcgagcctatggaaaaacgccagcaacgcggccttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctgatagaatgcaagcgtgtatggccgaactcggtgttccactcaccaaggaaaccggttttcaccaggtga

SEQ ID NO: 29902 - DNA, 198 bp, Glycine max
  Peptide Sequence Number=SeqID_121587
atggggcactgctttacgaccccttaccgaactcgtgctagagctagagtaatgggtgaagtagaggagatcaagagaagatttctgaggctctcgacatggaggccattaagagaaaatggccatcaatatggaggccatgatcgtgaagaagataatggaagccaatgctgcttgccgctgaccattgttgctaag

SEQ ID NO: 29903 - DNA, 497 bp, Glycine max
  Peptide Sequence Number=SeqID_121588
acttggctttggtgaaagagttttgtgcaaacttatatagctctgagggcccttcaccaaagcaatccagagttagaggccacctagtgaagattgatgctggtagcatcaacacattcttagagacacctgtggtattggcagagggtgagactttgcccacatactccagatactataggctgcccacagattacagagagattgaggctgccttatgcatactaggccgagggttcatcttgaacacagagggccatcctaggaagattctcaagaaggatttgactactctagctcaggtgtggagggttctctcatactccaacctagcccccacatcatatacctctgatttgacagtggacagagctagggcgagggcgaggccacttgagcttctttccacatttgcagctcctactccagcatccacatcagtagcttcttctgtcccagctcagacagattctcagtgctttgaagccatgctttag

SEQ ID NO: 29904 - DNA, 259 bp, Glycine max
  Peptide Sequence Number=SeqID_121589
catgcaacagggacaggcagatatcctcatagctaggttccctgaccctaactatggtgttaaaatgggttcctctcagtgtgggttttcaatggagaacaatgatggtttgtggtggctaatggaggataccaaatttcgagaagatctaacggttaacgaaggctgggcagcgtttttaccgaggcagcttcatgtagctttctccagaagcttcattaagaggcttcctccagaagcttcatcgtggcttctttga

SEQ ID NO: 29905 - DNA, 260 bp, Glycine max
  Peptide Sequence Number=SeqID_121590
atgaggggcatcgtgcatgagcctcaagtgaacctaggggcaaatcaaaagttctcacccatcgagtacctatcgccttcagaggactacatgtcctcaccttcaaaggactacatgtcctcaccttcagaggacttcatgtcctcgccttcagaggacttcacatcctcgcctccagaggactacatgccctcgccttcagaggattacacgtcctcgccttcagagggccacacgccctcgccttcagaggactacat

SEQ ID NO: 29906 - DNA, 237 bp, Glycine max
  Peptide Sequence Number=SeqID_121591
atggcacgaaaaggaaatccgatttcgaagaccactggaagacacccgggaccagagcatgtcgtgaaagaagcacactgggcgtgcttcgaccgtgtctccggggcacagttgaatgtagatatcatgaacgcgaggtgcaggataccaggccgagaaacccgggcaaccaccccctatgtgccgatcgctagcgcatccagggccccggcgcccagctccgctggagaggcctag

SEQ ID NO: 29907 - DNA, 362 bp, Glycine max
  Peptide Sequence Number=SeqID_121592
cattgatcacggctctctgccagtcattcggggttcctgtcacacctagtaaggtgattcgaccgccgatcacccgggccttcattgagaagtgttgcacggctagacaggcgcagggtgatgcaccgcaggccgcagacgcaccgccaccgcctcatcaggctgatccagttgggtcatttggcatggagcggtatttacagcacttggttcgccatcaggcagccaaccacagggggcaggtgcagattcatgagtgtctctaccagctcagcctcagtcagcaaagccagggtttcgctccttttgcatgccctactccagatcagttcagggcagaggtcacatggcccggagattag

SEQ ID NO: 29908 - DNA, 135 bp, Glycine max
  Peptide Sequence Number=SeqID_121593
gaaaatgaggtaggagcttgccacccagctcgcccaggcgagctaggttgcttcctccagaaggcaccgtcttctggagaacttcctggaaggcccaagtgggcctggttgctatttgcaccccctgtttactaa

SEQ ID NO: 29909 - DNA, 252 bp, Glycine max
  Peptide Sequence Number=SeqID_121594
atgaatgctttgagtggtgcaacactcttttgtaaaatcactcgtacacccaacatcttcatgatttgtgtacatagggactcattaggtagtgatcaaggggttcccatgaaccctaagagaataaaggtcattcctgagtggcccactccaccaagtgtaagaaaaatttggggattccatgacttaacaaacttttacaaaaaggtgttgagaaaaaaagcccagattttcaagaacctcgggatttga

SEQ ID NO: 29910 - DNA, 434 bp, Glycine max
  Peptide Sequence Number=SeqID_121595
ggtcaattgaaggaggtgaagatcctatgcgactttgctcccatacctactgaagagttgtactaccctagtacccaagagtacagccccggggactacttgccccaagaaccatctaaagatgcattatcgggagtagggggcatacgcaaaaggtgcaggttaattgttgatacattcctgtcagaaagtcttatgagggagaattgttacctggtactaattcttggaacttcccaagagatccattcacatggggctaatgttaaggctgttgttaggtgtcgtcggataatggcttcgatcaggatttcgcaagaatggtgggtgcaagccattggtctgtttgctagtgaaaggatcgatgtgggtctgaaaacaggcaaatttagtcatcctgcttggacgatgagaaaactggggcaaatgaagag

SEQ ID NO: 29911 - DNA, 217 bp, Glycine max
  Peptide Sequence Number=SeqID_121596
atgggtgtgcaaggctatgaccatctggaaagcaagaatggtggccttcctcaaatcctggatagcagaacctggaaagctgtcatcatcaaggctgggaacatcccaagattgagagcttcgacaagaacatcttcaactgatagaacacttgcagatcgtggcaagctgagagcatgggaggaccatgaaagaggagatcactctgagcttaaag

SEQ ID NO: 29912 - DNA, 996 bp, Glycine max
  Peptide Sequence Number=SeqID_121597
atggagagaagtatgatagatgctgccagtggtggagcccttggagacatgacccctgctgaagccagaaatttaattgagaagatggcctccaactcccagcagtttagcgccagaaatgatgccatagtcattagaggagtgcatgaggtagctacaaacccatctgcatcatctgaaactaagaagcttgaaggcaaactggatgcgttggtcaacttggtaacccagctggccttgaatcagaaatctgtacctgtcgcaaggacctttgcccttccatgcagcaacctggagcaattgagcaacctgaagcttatgctgcaaatatttacaatagacctcctcaacctcaacagcaaaatcaccacagcagaacattatgacctttccagcaccagatacaaccctggatggaggaatcaccctactctcagatggtccagccctcagcaacaacaacagcagcctgctccttccttccaaaatgctgctggcccaagcagaccatacattcctccaccaatccaacaacaacaacaaccccagaaacaaccaacagttgaggcccctccacaaccttccctcgaagaacttgtgaggcaaatgactaagcaaaacatgcagtttcaacaagagaccagagcttccattcagagcttgactaatcagatgggacaattagctacacaattgaatcaacaacagtcccaaaattttgacaagctaccttctcaagttgtccaaaatcccaaaaatgtcagtgccatttcattgaggtcgggaaagcagtgtcaaggacctcaacccgtagcactttcctcatctgcaaatgaacctgccaaacttcactctactccagaaaaaggtgatgacaaaaatttacctaacaatttctgtgcagaagcagcacattccccctcttccattccctccaagagcagtttccaacaaaaaaatggaagaggcagagaaagagatcttggaaacgtttag

SEQ ID NO: 29913 - DNA, 324 bp, Glycine max
  Peptide Sequence Number=SeqID_121598
atggcgacgtttgcccgcgtctggcaggaggcaccggcgcagccgcagtggtggagctatcccggttgttcgccgcggcttgaaaacagcgctgctggcctgagattcagcggagacaatagtggattgtggccggtggggcgttatctggcgctgctgcttggcgagctgccgcgtctgctggacaacgcgcagggttatggccccaacggtaaagggtttattacccacgtcgatttcccacgtgatgttagcgcggcgtggcaatgcttgcgtgaagatacgctattgagcgaggcgctgaacgccagaacgctggggtag

SEQ ID NO: 29914 - DNA, 471 bp, Glycine max
  Peptide Sequence Number=SeqID_121599
ttgggcaccgtaacccagcttccggttcatcccgcatcgccagttctgcttaccaaaaatggcccacttggagctctcgattccatggcgcggctcaacagagcagccgcaccgtcctacctatttaaaggaaacttcggagggaaccagctactagacggttcgattagtctttcgcccctatacccaagtcagacgaacgatttgcacgtatgctctcactcgaacccttcacagaagatcagggtcggtcggcggtgcaacccacagggggatcccaccaatcagcttccttgcgccttacgggccgacgccaggagcgcgcagtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcacc

SEQ ID NO: 29915 - DNA, 492 bp, Glycine max
  Peptide Sequence Number=SeqID_121600
atgtacaaagataattggacccaaccttggcccatgggctcagaaatctaccctaaggttcatgagaaccctagggccttcttcagcagctctagcccaatcttcttggagcctcttgctcatggttctattgattggtcccttcctagggaggattgcatcaatatgttgataattataaaccaatataaggataaggtaaacctggctgctagtcatgggcagatgctggaagatgaacaggcaaaggtattggctctgcatattgaaagggaagcgaaagaaagggtgatagagttattgcatggggaagctatgaaatggatgaatagattcgatctcactctgaatgaaagtcaagagcttccaaggttgttatctagagccaaggtagtggctgacacgtactcagctcccaatgaagttcacggtcttttcgattactaccaacacatggtcgaactaatgacccacataattcaaagtcactaa

SEQ ID NO: 29916 - DNA, 117 bp, Glycine max
  Peptide Sequence Number=SeqID_121601
atggataagagcttgaaagtaggagaagatgagtggaaggagaaggagagaaggagcacgaaattctgtgcctcaaatgagcccactaatccaagattctccactaagtgtgcatag

SEQ ID NO: 29917 - DNA, 117 bp, Glycine max
  Peptide Sequence Number=SeqID_121602
atggatattcgcctcacacagcttgaagaggatgtggatgatgcaaatgggcttttcaagcttaaattcaagacaatgattcaagaatacaagccacaacatcaagatgatcactag

SEQ ID NO: 29918 - DNA, 138 bp, Glycine max
  Peptide Sequence Number=SeqID_121603
gtcgactctagaggatccccgcccgaggcccaagcaggagaggcacccccagaagctcccggcgatggagaagaggcccacgaggacgaggagatggccgatttgcttgacttcttgggagggagtggagatacgtga

SEQ ID NO: 29919 - DNA, 648 bp, Glycine max
  Peptide Sequence Number=SeqID_121604
atgtcacgaaactttacggattatgcaaccatcccctcttcgacttctggaatgttacggaactttacggattgcgcaataatatttcctttcgactccagacatgttgcgaaacttcacagattgcttaacgacgggtgtcaagttcctcgaagcggtcaagcgaagggatacacatcctcgcctacagagggttgcacgtcctcgccttcagaaagttgcatgccctcgtctttagagggatacgtgtcctcaacttcaaaggtctgcacgccctcgcctcacaaggctacacaccctcgccttcagaggactgcacgtccctgcacctttcagagggcttcaagccctcgccttccagaactgacagtccttaccttgagaggactacacgtcctcgccttcagaggactacacgatcctcaccttcagagggctacatgtcctcgccttcagaggacttcacgtcctccccttcaaaggacttcacgtcttggccttaagagaacggcacgtccttgccttcagaggactgcacgccctcaccttcagaggactacacgtccttaccatcagttgactacatgtcctcgccttgagagggctacacgtcctcgccttcaaaggactgcacgccctcgcctttga

SEQ ID NO: 29920 - DNA, 408 bp, Glycine max
  Peptide Sequence Number=SeqID_121605
atggacataaacttggggtacctcatctcccaccagatctctctgattgcacagcatgatacatctagacttggattccttgccttgatcacaactctatgcaaggccagaggagttcagtcagactctagatccttggaaagcttgagccctgccattaacttggcatatattaagaacaactattggaatcttgatgatccaatagtgacatttagagggcaaaggaaggccaggggtaagagatcagaggcccctgctacttcatcaccagagacaccagctccttcttcttccacaactccattacctcccactcagactccatttattcctcctacatctgcacagataccacttccagctcctatatctgcaagaccatcagattttatatttacaccatag

SEQ ID NO: 29921 - DNA, 213 bp, Glycine max
  Peptide Sequence Number=SeqID_121606
atgcaagactcgcgggtgcgctttccaaaggaggaaagatgcgcggagtcgccaccaacgtttatttgtggaaaacgtcggaaaaaccgaagggaatcggtcaaaatgaaaattctaagttcgggagttgtatttacgtttgaggaaggtcgacaaaagcggggcttttgctcctacgtaccctccatcgaagaggaaatcaaacctacgtag

SEQ ID NO: 29922 - DNA, 375 bp, Glycine max
  Peptide Sequence Number=SeqID_121607
atgaggggcaccgtgcatgagcctcaagcgaacctaggggcagatcaaaaatttcttacctctaatgtccgatcttttgaatttggaaagaatgtccctctcaatgagtcaatctcttgctttctcataagggtgtacccttgggtagtagtaccctcgccgttagaggactacacatccttgccttcagaaggatgcacgccctcgccatcaaaaggctgcacgccctcgcattcaaagagttgcatgtcctcgcctttagaggacttcacatcctcatcttcagagggctgcacgcccccgccttcagagggctgcacgccctcgcgggctacacgccctcaccttcagaggactacacatcctcgcctttag

SEQ ID NO: 29923 - DNA, 303 bp, Glycine max
  Peptide Sequence Number=SeqID_121608
atgtatgcattccttgagccacagtcgttggtttgttcaaaggatagacgcagcgaatgcgaacaatatcttgaaagatggcttaaggaatctgaccgagaggtgtacattggaccttacttccatcatgtaatgacaaaattgaagaagaccttgtctcctgaaactaaggcagttgcaccaaagtggattgaagtaaagtggtttgctaatgacacaccgttggacatcggcatcatcaccacaattcgaaagaaatgggcaacattttttttaaagacaacaataagtcaaaacggctaa

SEQ ID NO: 29924 - DNA, 521 bp, Glycine max
  Peptide Sequence Number=SeqID_121609
atgtccatcgacaagaccctactcaagcgtggcctcaagcgggtggcggcaaaggtgctgtccatcaactggttcgcaccggttcccgatcgcctgaagctgctggttgcccgtcgggcggggtgctgtgactggcactggtatgcgcgcttcatcctgcgttcgcccggggcggccgctgaaggtcccagtcacttcctgtcctttggcaatgccgaagggaagtcaccgagcccgctgttcgacccggcctggtactgcgcacgtttcggcctcagggcgtccccgcttgatgccctgatgcagtacctctgcatcggcgaccgcctcggcctggcacccagcccgtggttcgatccgcgctactgccggcgcaccgcaccgtcgtccagcggcctgcggccggtgctcggccagtacctggtggattaccgcagctcgggaacgccacacccgttgttcgaccaagactggtacctcaaccagtacccggacgtgcgcgacagcgcgccaatccgttg

SEQ ID NO: 29925 - DNA, 699 bp, Glycine max
  Peptide Sequence Number=SeqID_121610
atggcagaaccatcaaagaagcgcaaaggttcttcgagtagaagccaatggcacttcgaggctcaagatactccaattccttcctccatttcctcctcctcattgttctcatcggaagaacaatgtacatggtacactaacctcttctcctctcattctatcattgaccctaagttcatagatatggatttcttttctgatgagagtttcaaatgcattcaagcatttcataactcaaatctcattccctttatgtctttaaaactacctgtgtattctgaattggtaaaagccttttattctaaccttgaaattcaagaaagtaccttgatttttgaggtctatgggataaagatggtcattgaccgatccctcttctatgatttgacccaattgtctagtgacggtgtaccatttgaaggtgcactagatgatgattggaagtttgatttttctgtgcattatgcccgccggttggtttgcaccaatcaagcggatatgaccggaaggctgcttgtcgattcattggctcttgaaagccgcatcctccattatctaattgttctcatcttactccccagatcttcaaaccttgcacaggtttctgacgaagatctgatagtcatgtgggcctttcatactggccgacaaattgattgggtacatctagtccggtatcgcatgcataaggcattgtga

SEQ ID NO: 29926 - DNA, 417 bp, Glycine max
  Peptide Sequence Number=SeqID_121611
atgtcggctcggcggctcctcactagaatcttactccctacaccctgccactgtcattctgctcccacgaacaaggttcgtgatcatcacagaatgatgcatgcacctgactcaacactcagatgcaatgtggtgcgtaccaacaacaaccaaacctcaggaaatagcctaagcgtgtccacacgacactcgcacttagggaactgtgctgagtttgtcgagatcacggccaaaactagtgccaaagaccctgaaaggtcagtgcacagtgccccccacgatcatacacaacatccaacgtatgaacgtggccaaaagctagtgccaaagaccctggaagaaaaatcagcatgcaatagggacaggcaaatatcctcacagctaggttccctgaccctagctatggtgttaaaatga

SEQ ID NO: 29927 - DNA, 309 bp, Glycine max
  Peptide Sequence Number=SeqID_121612
atgaggaaatgtgcaaaatactcaaaatgggggaaaaatggtcactttggggacattttccagcccctgggcccattaggaaacttagaggtgaagaagcaagcacctcacctgggtgagctgctatgcaacctctgtagaagcaagcttcatgagatgaaccaagcaattttgatgatgccaaaagccaaagtgagtgattcaagattgattcaagacttcaagatcaagcatcaagaatccaatccaagattcaagattcaagagaagaaatcaagaagcaacaagtcaaaacttcctataagataa

SEQ ID NO: 29928 - DNA, 104 bp, Glycine max
  Peptide Sequence Number=SeqID_121613
ttgtccatccgctaagcgcaacccttgcgataaacgcaatgtcttcacgcactaagcctgagcttgctcgcactaagcactttgacccttcatcagttggctag

SEQ ID NO: 29929 - DNA, 497 bp, Glycine max
  Peptide Sequence Number=SeqID_121614
atgggtgaccaagaggagacacaggaacagatgaaagccgacatgtcggttttgaaagaacaaatggcttctatgatggaggccatactaggaatgaggcaactcatggaaaagaacgtggccaccactgccgctgtcagttcggctgccgaagcagatccgactctcctagccaccgcgcaccatcctcccccaaatacgctaggacaaggaaggaacacactggggcacaacaacaaccctcatttgggatacaaccgagcggcttacccttatggattgccgcctaattacacgccgccattcatgcaagatgatgcgggtcatatctcttctcccatccttgaaagggagcctcctcaacagcccgacgaggtccacgaagatcatcaagagtatgcccaaggggatgtcgagttctaccccccgattcccgtcgagggaccggcacccaacactttggctcagcacaacctcactgcacaaccgataatctt

SEQ ID NO: 29930 - DNA, 534 bp, Glycine max
  Peptide Sequence Number=SeqID_121615
atgcgcgccgcccgggacgccggcatcgcatcctcacgtatcgcacggggttcgtgccgcagggggcgggcgccgatctgcccgccacggctgaccgtcaacgaggtgatcgccgagccgatcctgatccgggagcggaaggtgaattcgagggcgctctcgatccgtgtggcgacgctgctcgacgagctgcacctgccgctcggcaccgccgcgaagttcccttacgagctcagcgcgggaatgcgacagcgtgtggcgatcgcccgctccttcgtcctcgagccccgggtgctcatcgccgacgaggtgctcgccaacctcgacctcgaggtgcgtccggtcgtcttcgatgcgatcacgcgacggcggaaggagcagtcgatggcggctctgctcgtcacgaacgacgccgatttcatccgggaactcaacgccgagacgctcatgcttcgcgcgggtcacgtcgtcgcccgcggtgtcggcaaggacctgctctgggtgcccaacgcggagtcggattcccgccgctga

SEQ ID NO: 29931 - DNA, 426 bp, Glycine max
  Peptide Sequence Number=SeqID_121616
atgaagccttggaatgagaaaccaagaaggcccgaaaggaagaacacgtgccagcaaagttttgaggggctttatagggcagcaatattaagcgagactgaagggaatatgtgggccatcatcaatgagtgcaaagagaagctaaatctagcagcgactcacgagcaaaggctagaggatgagtacgccaagatatcagcagaaagggaagtaagggaaagggtaattgattcattgcaccaagaggcaacaatgtggacggaccgatttgctcttactttgaacaggagtccagaacttcccccattgctagccaaggccaaagcagtggtggacacctactccgcccccaaggagatccatggacttctcagctattgtcagcatatgatagacttaatggaccatatgattagaaaccgctag

SEQ ID NO: 29932 - DNA, 159 bp, Glycine max
  Peptide Sequence Number=SeqID_121617
atgggacaccttagtgatcaatgggttcccatgaaccctaagagaataaaggtcattcctgagtggcccactccaccaagtgtaagaaaaatttggggcttccatttacaaaaggtgttgcagaaaaaaacccagagtttcaagaaccttgggatttga

SEQ ID NO: 29933 - DNA, 300 bp, Glycine max
  Peptide Sequence Number=SeqID_121618
atgcttcagtcatacagtgctcaatggaatgccccagggccttcctctatgatatcacaatgttgcccgttcaagccgtatcctcagcaaaaaggaggtttccaccgcaggaaacctagcaggggtggtttagcattggttgtgatgagaggctttgtggctctcaatgagttagggagcggagctttgtggataattgggtggtggggaaggagaaggaatggcagtcacagcatgggtttctccctcattctcaccctcttcatttgccccagtttttttattcatcaagcaggatga

SEQ ID NO: 29934 - DNA, 117 bp, Glycine max
  Peptide Sequence Number=SeqID_121619
atgtggaccaccacgggggagaagcttgccgcccagctcgcccaggcgagcaaggttgcttcctcgaaaagcaacagccttctggaggaatcttctggaaggtccaagtgggcctga

SEQ ID NO: 29935 - DNA, 315 bp, Glycine max
  Peptide Sequence Number=SeqID_121620
atggaaaacgccagcaacgcggctttttacggttctggccttttgctggcttttgctcacatgttctttctgcgttatcccctgattctgtggataaccgtattaccgcctttgagtgagctgataccgctcgccgcagccgaacgaccgagcgcagcgagaaacagctatgaccatgattacgaattcgagctcggtaccctcattagtgatcaaggcatccatttctataacagatccatgtatgccttgctcaaaaagtatggggttatgcacaaaatttccacaccttaccacccccaaactaatgggtag

SEQ ID NO: 29936 - DNA, 711 bp, Glycine max
  Peptide Sequence Number=SeqID_121621
atgtgtcatcctccagaaaaagtgaagaccaagggtgctctaaaaaaaccgcttgccaaacaacaaaagtcaacaaaacgcaatccgtcttactgggagtatgttgatgcgttacactctatacaaaatagtaattccttagtgaaacgtagtgcatcatcatctcaggacccaatacagagacgaaatattccaatgttgaatcaatttcatccttgcatccagtattctattgaaaacattattgatgtcaaagcatatggtaattatggttattgtgcaatagttgcattattgggtatgagtgaagaatcgtggtcattggtgaggaaccatcgactagctggtccgaagagttaccatggacaagtggatgaatattacggatatgggatacgtcattgtttcacgatacaacgtgatcgttgtttctctttcacgacaacaaagcatgacattttttctcttagaagtcagtcgccaccagattcttctgtgcatcgtgtaatatgcattggtcatgcgtatggaaatcattttgtacaaattttgttacgagaccactgtcctttaccaccagtggcgttgctatggagtacacattgtcattttaaggcaaagcagtggcccactccgtacatatctagaatgcagtgttacacaactttgtgtaggctgaataccgaatttgttgatttaggtgaaccatga

SEQ ID NO: 29937 - DNA, 231 bp, Glycine max
  Peptide Sequence Number=SeqID_121622
atggcctttagagggctacacgccctcaccttcatagggctacacgtccttgccttcagaggaaaacacgtcctaggcttcacagagctacaggccctcgccttcagagggctacacgccctcgcctttagaggactacacgtcctcgcctttagagggctacacgccctcgccttcaaaggactgcatgtcctcacctttagagggctacatgccctcgccttcagatga

SEQ ID NO: 29938 - DNA, 222 bp, Glycine max
  Peptide Sequence Number=SeqID_121623
atgaacttatcaaaaagaaaaggaaacgctttatggcgcccttaccaaactcgtgctagagctagagtaatgggtgaagcagagaaggtgcaagagaagatgaaggccaaaaatggaggccataaaagagcaaatggccacaatgatgaaggccatgatgagcgtgaagaagataatggaagccaatgtggttgcaattgccgctaccagcgctgtcgctaa

SEQ ID NO: 29939 - DNA, 230 bp, Glycine max
  Peptide Sequence Number=SeqID_121624
gacacactttacggtgcccttaccgaacttgtgctagagctagagtaatgggtgaagtagaggagatacaagagaagatgaaggccgacatggaggccattaaagagaaaatggccacaatgatggaggccatgatgagcgtgaagaagatattggaagccaatgcggttgcaattgccgctccagcgtcgtctaaggtgaacccgacgtcccctcttcgaggcatctaa

SEQ ID NO: 29940 - DNA, 759 bp, Glycine max
  Peptide Sequence Number=SeqID_121625
atgggcgactatcttctccaactccgggggaagtcccacatctttgtcctcttcactctccgtctactccgtttcttgcttcaaatcgatggtcgggtcccaggtattagtaccttcgagggactcgtcgtcggatctggcgttttaagcgaaacaaggagggcatggtcgtaccaaatcgacccattcggagagtcatcctcgcatatcgcaacgacttggcctttgtgtcctagtctcgtgcttataaagcttctattgatgtggcaaggcgggcccccttcgatttttcgtcccaattgcgagccttggcttccgctcttccttctcgcaacacttttccttatgctggttctgccgccgttgtttttgcctaaacccatttcgggctcgttaccattccccaacatcacccgggctaccatcattgctgtatcggacaggcaaggttacccagagaaggaatctacggaggcaatgcttactacctcaaaagattggaaggctgtttctaacgactcttccgcggcttccacatatggcatagaggacgagcaacttaccaagatgtcttcctcccccaacacgataaccaaatgcccctctactacgaatttcaatttttggtggagtgtagagggaacgactcccaccgagtggatccacgggcatcccaaaagacagctggaggtcaatctctcccctaacttctcgacgggtgccgtcgaaggcacgaaccaccatggaacttggctttag

SEQ ID NO: 29941 - DNA, 189 bp, Glycine max
  Peptide Sequence Number=SeqID_121626
atgaggactcgtagccctctaaaggcgagggcgtgcagccctctgcaggcgaggacatatagtcctctaaaggtgataggtactagtacccaagggtccacctttatgagaaagcaagagatcgactcatcgagagggcagacgcatgcaacctttgttgtgaaatttggtaatgctgaccgcacatga

SEQ ID NO: 29942 - DNA, 312 bp, Glycine max
  Peptide Sequence Number=SeqID_121627
atgtctcctccacctctaaaacctcacaatcactcacaaactcagctcaaactcgcaggacaacttcctcttcaagctttgttctctgtaggtggccttgttggtgcttgcgcgcttagtgcaactctggctcgcttagcgcgcattagtgaatttcggcttagcgcttgtcttttcgctcagcggatggactcaagcgatgcacttagcgggattagaccatgctcagaattcatgcacagctcatccttcttccagattcttcctcacgctcagccgaaggagtgttgcgctcagcggatggctcgctaa

SEQ ID NO: 29943 - DNA, 267 bp, Glycine max
  Peptide Sequence Number=SeqID_121628
atgaattccattggacccaaaaatgatacattggaagaatcatctgagtcttccaatatcaataggttgattgttccgctcctgtatcttccaaaaggaaaaaagatctctgagagctatttcctggatccgaaagagagtactcgggttctcccaataactaaaaagtatatcatgcctgaatctaactggggaattcgagatctcttcaaagagaaagatatcaaatatctggagttcctttaccattcgtatattataggatga

SEQ ID NO: 29944 - DNA, 414 bp, Glycine max
  Peptide Sequence Number=SeqID_121629
atgattatgaggggccaagacatttatagtagccaagatgaggcttctacttcaccttcctctagtgaaagtgaagaagcaaaaggggaagaatctagtaaagagatctatccccaagaagaaggacaacttttaatggttaaggaggagtgtaaggaggtaagtgtctcctccaagagcttagctaagaaggaaagtcattttgaaataaagacaaatattaaagaaatttaccctcttagacaacctccacattttctcctttataaaagacacttgttagcattgtcacacctcttagggcttgagtttattcctcaagtaaaggagttgttggatgagggtttggtttgcaagagcttaaattcacttgctttgttggtgcgcaaaatagtgatcaaggggttcccataa

SEQ ID NO: 29945 - DNA, 375 bp, Glycine max
  Peptide Sequence Number=SeqID_121630
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggggcaaagaggaaaatgatgaaaatgaaaagaaagatggagaagatggagacgaggatgaaaatgcacaagaggaggatgaagaagatattagtgatgatgattataatcaggttccactataa

SEQ ID NO: 29946 - DNA, 717 bp, Glycine max
  Peptide Sequence Number=SeqID_121631
atgggggagacacatgaaattccccaccacaatcaagccgacttcgggccttgcctcggatatgccactgaagggaaagcagttggactacacgtcctcacctttagaggactacaagtcctcgccttcagaggactacacgttctcagcatcagagggctacatgccctcgccttcaaaggactagacgtcctcgccttcagaggactgcacgtcctttccttcagaggattgcacatcctcgcctttagaggactacacgtcctcgcctttagagggctgcacgccctcgccttcagagggctgcacgccctcgccttcagaggactacacgccctcgcctttagagggctacatgtcctcgccttcagagggctacacgtcctcacctacaaagggatgcacgccctcaccttcagaggactacacgtccttgccttaagagggctgcacgccctcgcctttagaggactacatgccctcaccatcagagggctccacgccctcgcctttagagaactacacgtcctcgcctttagaggactacacgtcctcgccttgagagggctgcacgccttcacctttagaggtctacatgcgcttgccttcagagggctgcacgccctcgcctttagagggctacatgtcctcgccttcagaggactccacgtcctcgccttcaaaggactacacgcctttgtcttcagagggctatag

SEQ ID NO: 29947 - DNA, 468 bp, Glycine max
  Peptide Sequence Number=SeqID_121632
atgggaactggtctgattctaaagtccttgacagtatctcctataggaactttagttcctttggacttagaaatagaagctacactaagaaggaacagggctgagaggagaaggaaactgttacaagacagaacagttgcgtccattcttgaggaggagacttatttttctgattcattatcacctgactcaccatcatcaagggaatccgctaatcaacattctctagctacgaccatggcagatgagcatgatcagaggactacccttgaggactattcaagtggctcagtaccacaatttttcactagcattgcacatcctgaagtgcaagcgcacaacatcacctacccacattctttgatccatctgatacaagggaatttatttcaaggattacctaatgaagatccctatgcacacttggcaacatttatagagatttgcaatactgttaagattgtcgat

SEQ ID NO: 29948 - DNA, 432 bp, Glycine max
  Peptide Sequence Number=SeqID_121633
atggaggtccctactgctcataaggacctgatttgggaggatattcaggcggaatttgatatcccagaggcttctgacagtaggacgaaaaggaagttactacagaccgtgggggagagatggaggcagtttaaatctaacctcacaaggaaatgggcccttgcagccgatcaggatggtgtcgaggacactgatgtgcgcaagaaggcacagaccatccagaagcagaatactgccccccacgttttgtctcgtgggggttatgattatttggagcagaagctcctggctgagaagacgaagaagaagctggaggaagctgcacagtctggaagcattgatggcgtcatcgaccctccatccccggtcagacgccacgtgaagtggaagatggcccgcacgaagaagacaggggagatgacgactgaggcc

SEQ ID NO: 29949 - DNA, 180 bp, Glycine max
  Peptide Sequence Number=SeqID_121634
atggaagatgcacccgtgagccctcgcgtcgccctcccgcaaaaggttaggttgcgacagttggcgactccactgggaacttttttaacacccacgggtttgagtaaaaaggggccttacacccgggttcatggaaatctaaggagtggaggtggatctatggtcatgctaggtctctga

SEQ ID NO: 29950 - DNA, 600 bp, Glycine max
  Peptide Sequence Number=SeqID_121635
atgactggaaggcttcttgccggatcattggcttttgaaagctgcacccttcactatctcattgtgcgtattctacttccaagatcttcaaaccttgcacaagtttctgaagaagatcttattgttatgtgggcttttcatatcggccgacaaattgattgggcacacttagtccgatatcacatgcataaggcattgcgattaaatgctccattgccatatccacacctagtcactcttttccttcaacactttaacatccctcttgattctgaaccttatgttccaatcaagagatccttcttgatcggtgctgctatgattgcatcttttggttaccgcaaagagcatgagggtgctcaacccattgatgatgaaggaaacttactagttggagaatattcctctcttcttcaaaggattttggacaggttcgatggtcttcaaacctatgttggtgaaaggtttgatgctttggaattacaagtgggcatgcaattcgatgagatggactcacggatcaccaaggatgaaggagatgtcacttacatccacacatgctttgatctaccaccaccaccaccatcggggatcctctag

SEQ ID NO: 29951 - DNA, 252 bp, Glycine max
  Peptide Sequence Number=SeqID_121636
atgaatatcgaagcatccattcatgctacctttgatgaatctaatgctatcttgtcaagaaagaatatgctagatgatattgcagattctttagaacatatgaatattgatgaacaagattccaaaggaaatgataaaggaaacaatgaagatcctccagaagaagtcaaatccaatgatgaacttccaagggaatggaaagcttcaagagatcatcccctcgacaacattattggtgatatctcaaaaggg

SEQ ID NO: 29952 - DNA, 336 bp, Glycine max
  Peptide Sequence Number=SeqID_121637
atgccttccaagattattttgatgatgccaaagaatcaagagttaagcaaattccaaagtttcaagaatcaagattcaagattcaagattcaagaatcaaggttcaagaatcaagattcaagaatcaagagaagactcaatcaagataagggttgttatactgagaacaagagagggtatatctgttgtggatcagttcaagtggagggtacatccacttggttattcaaagagaacaagggagggtacatcccttgtagatctttggcttataaaggattttacaaggttgaaagaaatatcaagaaccgcaggttggttggggactggatgtag

SEQ ID NO: 29953 - DNA, 291 bp, Glycine max
  Peptide Sequence Number=SeqID_121638
atggagatgccaccgcagaacaaatttgttggttgcgcgttcacaggaaaaaatcctaagaaatttcaaattccttcaacatgtaccatcgatgaactgaagaatttaatcaagcaagttgcacctaaagggatcccccctcttggaattcacgaatcacaaacggtaagacgattgtttttccgccaaccagctcggtttgagtattcagatacggttataaaatatgaaataaatgagctgatcaccaacgaagaactgctgaagacgaggtcagtgggacatcgctaa

SEQ ID NO: 29954 - DNA, 219 bp, Glycine max
  Peptide Sequence Number=SeqID_121639
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggatggatgaagatgagtggatgtatgaaataatgtctgaacgagcggatatggattatgaaaatgcataa

SEQ ID NO: 29955 - DNA, 84 bp, Glycine max
  Peptide Sequence Number=SeqID_121640
cattcggaatagatggactctctctaggactcctatttattgacgggattatcactacgttagctacagttagcggctcagccg

SEQ ID NO: 29956 - DNA, 339 bp, Glycine max
  Peptide Sequence Number=SeqID_121641
atggaagactcacccgtgagcctcgcctcactcacccgcaaaaggaaattgaagctacattgcgaaggaacagggccgagaggagaaggaaacttctgcaagacagaacagttgcatccattcttgaggaggaaactcatttccccgacttattatcaccggattcaccatcatcaagggaatctgccactcaattacctgaagccattaccatggcagaagagcatgatcagaggattacccttggggattattcaagtatctcagcaccacaattttttaccagcattgcacgtcctgaagtgcaagctaacaacatcaactatccacattccttaa

SEQ ID NO: 29957 - DNA, 618 bp, Glycine max
  Peptide Sequence Number=SeqID_121642
atgaccaccctgactcagatatggatgactttgctgctcagcaacatcctgcccagcgatcataattccgacctccccctgccgaagtgtcagctggtgtacgccatcctgacgcggatgagcattcatgtggctcagttaatcgttgatgccatctatatatttgcaggtatggcgcctaccaggcaccctctggacccagataagtccaacagggccctgggatttcccgccttgatcacaagactctgccagtcgttcggcgtccccgtcgcacctagcaaggcccagggggatgctccgcaggccgcagacgcgccgccacctcatcaggccggtccagccggatcgtttgatacagagcggtatttgcggcatttggttcgccagcaggcggccaaccaccgggcacatagccagggctttacttcttttccgtgccctactccggaccagttcagggcagaggtcgcatggcctggagattggcctgaggcccgggcaggagaggcgccagcagaggcaccagcagaggctcccgacgaggcagatgaggcccgcgaggacaaggagatgaccgatttacttgatttcttaggagggagcggggccacatga

SEQ ID NO: 29958 - DNA, 138 bp, Glycine max
  Peptide Sequence Number=SeqID_121643
atgcctaaagtttggacctcccagaagatatggagtggagctgatattgaagaggaggaaccaatagatttgaggtcaaatcctcttcaagggggagggaatgatgcaatcctccctaagaaagggaccagtcactag

SEQ ID NO: 29959 - DNA, 693 bp, Glycine max
  Peptide Sequence Number=SeqID_121644
atgggggaatacgcaaaagatgaggaattgctaatacattccttccaagaaaagtcttactgggatatcagtacaattttgatatggttccggataggatgcaactacagaacatttgcaaaaagggggacggatctttcaaagaacacgcccaaaaggtggagggatctggcggcccagagtgggctcatgatgagcgtgaagaagataatggaagcctcaaatgcggttgcaattgccgctaccagcgttgttgctaagtcaataacaaacctcctcctatacccattgagagccaacccaactgttatcatgcacatgtctcttaaacggggggggaccatccctgaaattcaaccacaaagtctagccgacttcgagccttgcctcggatatgccacggaagggcaagcagttggtggtatacccctacaaaaccctttggaaggccctcagtatcacccacaactacacctcttgcattccacgacaagtaaaaaccctcatgctatggcagaaatgggaaagttggatcatctagaggaaaggctcagggccattgaaggaggtgaagattatgcctttgctaacctaaaagagttgttcctagaacccaatatcatcacccctcccaagttcaaggtgctggaccttgacaagtacaagggactacttgtcccaagaaccatctaa

SEQ ID NO: 29960 - DNA, 213 bp, Glycine max
  Peptide Sequence Number=SeqID_121645
atgttcttaacttcttactgtgggggttcgtcggccttctcggtcgcaggatcgacatggaccagcggtctctctgccctaactggtctagtcaccaatgatcttagccgtgtggcgtttcttgtgcgcttcaaggtagatggcgactgtgatgctgcaccagtcgaaggaggaagaggaggagagctgggtggtgtagccatttgcctgtaa

SEQ ID NO: 29961 - DNA, 234 bp, Glycine max
  Peptide Sequence Number=SeqID_121646
atgactgaagcacgtcaaaaggaggtacggaaagtaaatgaaacgagaatagaagtacacgaagcaaatgaggaccaccacggcaaaataggggaggagcttgccacccagctcgcccaagcgagccaggttgcatcctccaggagcaaccaccttctggaggaagaatctggaaggcccaactttcggaaagttacggaaactgacggattgcgtaacaatacttccttttga

SEQ ID NO: 29962 - DNA, 156 bp, Glycine max
  Peptide Sequence Number=SeqID_121647
atggaggttaaagaattgatttgggaagattggatgagaggaagtgtgattttgaaatctgcacttatgcaggggatttttgcgcatttggatgtggaaattgttgtgcaccagcccgaccaccacctagtaccacatgtgatgggtaccccataa

SEQ ID NO: 29963 - DNA, 349 bp, Glycine max
  Peptide Sequence Number=SeqID_121648
gtcgactctagaggatccccattttattcgaccggaaatggtgcatctagatcgattcctaaggctggtaatgccgaatcaaggataaggcaatacaaaaagagacaaagaaagacctctcaaaagccggtgcttaggcagacccagctgggaagtaaactaggttttgctattccttctcgagcttctatttcatcccttaaaggagattcgggaaaagatagaataggaagacgtgtttccagaacaaacaagatacgggttgagagggggaagttagcaaagttagacaagattggaatgggcataggaacatgtattgatgtaccagatcggctaatgctcccag

SEQ ID NO: 29964 - DNA, 195 bp, Glycine max
  Peptide Sequence Number=SeqID_121649
atggtgaggacgtgtagtcctctcaaggcgaggacgtgtagtcctctcaacgtacccaaggtgagggtgtgtagccctctcaaggcgaggacgtgtagtcctctgatggtgagggcgtgcagccctctgatggtgaggacgcgtagtcctctcaaggcgaggacgtgtagtcctctcaacggtgagggtaactag

SEQ ID NO: 29965 - DNA, 628 bp, Glycine max
  Peptide Sequence Number=SeqID_121650
atgaaaacacggtgcccggatgggctattcttatatcctgagaattctgctcctggtcaactcccaagaacagtggatgtaattgcagaagacgaccttgttgattcttgcaagcctggagatcgagtggcaattgtggggatatataaggctcttgcaaggaaaaggactgttctcatagccaacaatgtttctcttctcaacaaagaggataatgcaccaatctacagtgttgaagatgtcaaaaacattaaagagatagctacaagagatgatgcatttgatctgctaagtggttcacttgcaccttctatatatgggcattcttggataaagaaagcagtggttttgttgatgcttagtggggtggagaagaatttaaagaatggcactcacttgcgagggttagagttttctcttgatctcctttctttactcaatcccacaaaatttttagggaacattgtggttgaacatgattatgctgagtgcactggatctgctattcaagctttagttttgtttaagaagctatatccaaggcatcgggagacagagataaagaattccattgccaatgcagttcatggtatggaagttggggagtttgctacatttatggcacttg

SEQ ID NO: 29966 - DNA, 135 bp, Glycine max
  Peptide Sequence Number=SeqID_121651
atgataaatgtaggaatgatatgtccattatggtgccatgaagagatgcatgatgcgatcaaggaacaagccaatggactaccagcgacaatgcatcaccaaaagaggaaaacactagatgaggcttcactgtaa

SEQ ID NO: 29967 - DNA, 191 bp, Glycine max
  Peptide Sequence Number=SeqID_121652
gtggagctgatattgaggaggatgaatcgacagatttgaggtcaaatcctcttcaagggagagggaatgatgcaatcctccctaagaagggactagttacaagagccatgagcaagatgctccaagaggattgggctagagctgttgaagaaggcctgagggttctcatgaacctcagggtagatttttga

SEQ ID NO: 29968 - DNA, 189 bp, Glycine max
  Peptide Sequence Number=SeqID_121653
atgtccgccagggtccagcctatagccttcttatgcttcttgagaactgacaacaacttctcctcttgctcattagcaagggaggcagatataatcactggaaaactcttgttatcatccaatggtagaaggagatggtttctcagcctttacctcataaagaaagtcagaggtatgtgtacttcctga

SEQ ID NO: 29969 - DNA, 318 bp, Glycine max
  Peptide Sequence Number=SeqID_121654
atggtttatgatggcaatgataaaatccagaatgctaccaaccagaaagatgagattaaagaatatatagactgcagatcatggcaccttagaaagaaaggatacactattggaaggcttatatgggtcccaccaacgataggagaattgttttatttgaggatgatgcttactgcctacaaaggagcaacttcatttaaggatattagaactgttacaaatattcaataccctatatatagagaaacatgctttgtcatggggtttttacaagatgctagagaattcgttgaagcaatcaaagaggcaaaggactag

SEQ ID NO: 29970 - DNA, 215 bp, Glycine max
  Peptide Sequence Number=SeqID_121655
ccataaacatcgcaccaaagttgtcacataacaactttaatggcctagaaatagagtccacaactctaaggccagacatgaaactcttcaaccatacaccatgcgaggtagcctcaaaacaggaaacgaactcagcctccatagtggaagtagcagttaaggtttgtttggcacttctccaagatacagctccaccggctaacataaaaatataa

SEQ ID NO: 29971 - DNA, 246 bp, Glycine max
  Peptide Sequence Number=SeqID_121656
atgggcagaaatgtctccgcattgattggtaaatctgttcctcaaattcctgaaaaatgcaaagatccaggccccttgcagtcaagtgatgtggtaattcatttagctaatagaagtgttgcctaccttgttggtttcatagaagatgtcttcgttagagttggtgaactgattttccctgttgatttttatattttgaatatggaagatggattttctaggcagaccctttatgaaaactgctag

SEQ ID NO: 29972 - DNA, 423 bp, Glycine max
  Peptide Sequence Number=SeqID_121657
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtggaaatgaacccatcttggcagcaaggaaaactcagggagttctgcaagcagaaaggaattcatgttagtgcttggtcagctcttggtgcttataagatattttggggctctggagctgtcatggagaatccaatcctccaagacatagcaaaggcaaaagggaagggtaccgagctcgaattcgtaatcatggtcatagctgtttcctgtgtgaaattgttatccgctcacaattccacacaacatacgagccggaagcataaagtgtaa

SEQ ID NO: 29973 - DNA, 195 bp, Glycine max
  Peptide Sequence Number=SeqID_121658
atggcaggtggagccgtagcaaagtggttgatccaaatgaataagttcacagggggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 29974 - DNA, 267 bp, Glycine max
  Peptide Sequence Number=SeqID_121659
atggtagccataaccccagccaaggttcatcaacctcaatttctccgagaatacgattcgaacgcaatgtgtgcttgtcacggagaagccccggggcattccattgagcattgtagggctctgaagcgtaagtgggtgcaagccattggtctgtttgctcaagcgacctgtgctcctgagtttggacttccaagaccgttcaatcagagattactcgtcttgcgcgttggtggggttgccgtaaaacaacaaatggggatcctctag

SEQ ID NO: 29975 - DNA, 297 bp, Glycine max
  Peptide Sequence Number=SeqID_121660
atgggcatgagaacgatgctcaacggtagccccatcgtttattcctccacaacaacaaaacgcaccacttgcctacagccggatagagtcatgcgacagtttggaatgcaacaacctattccgggcccagtaatgcaacccaacaacatacatgacttgaccttaaagggaaaagaaggaagaaattggatgcgactaatgcaacccacgcttaatgaatggaatagtcgctatgaaaggagagtagagcaaacaccgccacaaacagggacccttagtctgaactctgatatatga

SEQ ID NO: 29976 - DNA, 228 bp, Glycine max
  Peptide Sequence Number=SeqID_121661
atgatgacaatgatagtagacacattaccagtattttactatggaaaatggtgggttacacaccttcaagctttgcggatttgggtcttcgccggcgaaatgatcaaagtgagtctaaaaagaggcaaatctgatcatcttgctttgattaatgcaaagaaaattggggcaaatgaagagggtgaagatgaaggagaagcccgtgctgtgactgccattccaatatag

SEQ ID NO: 29977 - DNA, 276 bp, Glycine max
  Peptide Sequence Number=SeqID_121662
ggtgaaatcgccgaaacactacattttatgttgtcgcctattgggagaagggtttgtacttttgaagatttactgtcatgtatcgaaaagatcactcttttgtctaaggaagaggataggatacttgaggcacatgaagatgcttccccttctcagccacaatttgaacatcaacagtttaatatactacggcaaagtgtggagactcgaggcttagcgcgacgtcgggaaactgttgatgcagcaacatatagtttgcctccgatgccagaatga

SEQ ID NO: 29978 - DNA, 518 bp, Glycine max
  Peptide Sequence Number=SeqID_121663
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgaatccaacccg

SEQ ID NO: 29979 - DNA, 327 bp, Glycine max
  Peptide Sequence Number=SeqID_121664
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtgagggttggaggtcttattgtaattgataatgtcctttggcatggaaaagtctctgacccgctggtaaatgaccctgggtaccgagctcgaattcgtaatcatggtcatagctgtttcctgtgtgaaattgttatccgctcacaattccacacaacatacgagccggaagcataa

SEQ ID NO: 29980 - DNA, 647 bp, Glycine max
  Peptide Sequence Number=SeqID_121665
atggcgcctgatgcggtattttctccttacgcatctgtgcggtatttcacaccgcatatgacaagctgtgaccgtctccgggagctgcatgtgtcagaggttttcaccgtcatcaccgaaacgcgcgagacgaaagggcctcgtgatacgcctatttttatagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcgggcaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaac

SEQ ID NO: 29981 - DNA, 243 bp, Glycine max
  Peptide Sequence Number=SeqID_121666
atggtagccataacccctgcaaggtttcctcaacctccatttttcctaggatacgacttgaacgcaacatgtgcatatcatggaggagccctgggacattccattgagcactgtatgaccctgaagcataaggtgcaaagtctaattgatgtaggctggctgaaatacgaggagaatcgcttgttgaatcctaacactaacaagcgataccacacatggggcaattttgaaagctgttgttag

SEQ ID NO: 29982 - DNA, 252 bp, Glycine max
  Peptide Sequence Number=SeqID_121667
atggttaccttacgaaatccagcacactacgtcaatggtcagtctgtccaaacgcctacgatatgtggaaacgggcagtgccttgccaaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 29983 - DNA, 192 bp, Glycine max
  Peptide Sequence Number=SeqID_121668
atgaggggcaccgtgcatgagcctcaaggtggacctttgggtactagtacccccgtcttccgggggctacacgccctcaacatcagagggttgcacgtcctcaccttcagaggactatacgtcctcacctttagaggactacacgtcctcaccttcagagcgctacacgccctcaccttggggatcctctag

SEQ ID NO: 29984 - DNA, 159 bp, Glycine max
  Peptide Sequence Number=SeqID_121669
atgccgatatccccctacggaaggatcgcacccataagacacccagtggacccggaggagcccaatagggccctagggtttccagctctgggatcgcgcccgcaagacacccagtggacccgaagaagtccaacagggtcctggggtttccagctttga

SEQ ID NO: 29985 - DNA, 171 bp, Glycine max
  Peptide Sequence Number=SeqID_121670
atggagaagaaggggagaagaagaagaaaggggctaaacgacgctagggcctgtgtgcggaaggctgaggaagtaaaaatatttttccaatcaaaccaagaactagagacaataaaatctcgttttcagtgttttcagttgaaaccagaaacctcattttgggtaaaatga

SEQ ID NO: 29986 - DNA, 468 bp, Glycine max
  Peptide Sequence Number=SeqID_121671
atgccagatgtagaggctgacgtatttccggatgacccgatggcaccaactgatgtagaggacactggggtagacattcatgtagacacaggtgcacaagctgctgaggatgagcatgagggatttccgggtggtccgagcgacccatccgtgctgacccagtatgcggatcacgttgcttgcagcgtatggacgggagaggagcatcctgagttgaagttatcctctcacgggaggaaggtccatagtttgtctgatcgcgtagacactggcgatcagggacttttgtcctcgtttgtcgagcgatggcactgggagacgtctagtttccatctccctgtgggagaggtgacaatcacgctggacgatgtctcgtcgcttttgcatatgcccgtggttggcaacttgcacgcctttcaacccttgcacgtggatgatgcagttcagatgctggtggacttattgatg

SEQ ID NO: 29987 - DNA, 624 bp, Glycine max
  Peptide Sequence Number=SeqID_121672
atggccacagctaccgctatcagttcagctgtcgaagcagacccgactctcctagtcaccacgcaccatcctcccccaaatacagtaggacgaggaaggaacacactgaggcacaacagctacccccatttgggatacaaccgagcggcttacccttatggattgtcgccagtcatgcaagatgatgcgggtcatatctcttctcccatccttgaaggggagcctcctcgacagcctgacgaggcacacgaagatcatcaagagtatgcccaaggggatgttgagttctaccccccgatccccgttgagggaccgacacccaacactttgcctcaacccaacctcacaacacaaccaataatcttgtccacagaaggaccacccttggcgaccgaagaaagaaggaaacccgatctcctcgaggagagattgagggctgttgaaggctttggtgactatccgttcgcggacatgacagatctttgtttggtaccagatgttgttatcccccaaaattcaaagtgctgtactttgacaagtataatgggacgacttgtcccaagaaccatctcaagatgtattgtcgtaagatgggcgcgcactctagggatgagaagctattaa

SEQ ID NO: 29988 - DNA, 222 bp, Glycine max
  Peptide Sequence Number=SeqID_121673
atgacgtatgaacatggcccaaagcaagtgccaaagaccctggaaggtcagtgcacttcgccccccacggacatacacaacatccaacgtatgaacgtggcccaaatcaagtgccaaagaccctcgaagggacagacaattatcctcatagctagattccctgaccctaactatggtgttaaaacggtaaattttataataaactcccctcacctattgtga

SEQ ID NO: 29989 - DNA, 522 bp, Glycine max
  Peptide Sequence Number=SeqID_121674
atgcctctatcagcagcagtcgacaacttgacggttacatcacactgctgcagtgctggatttacgagcactctccctcagtcgcggagtccactgctgatcaggactacgacgaggattccccgcgtgcattttggatacacacagaccattcctgctccgcctgtcgattcatgggtgtcatatgatgatatacacgacaggtggatgcactactcggatcatatcgttccagcaggtgagccccgagtcgtccctcagcccccacagacaaatatccctcatgtgccggagccaggagcaccgtcgacatctgcgaggcccgctgtggaggagcctagacatgcagtggaagtttgccattggattgctgagaggttggagcgccatctgagcctaggggtggtcacgccaggctcatcgacacatgaggtgatcgaagaatgcctcaggatggccaggagtgtgacacaggaccaactagcatatattaggtttcgacgcaggcggcacacggattag

SEQ ID NO: 29990 - DNA, 120 bp, Glycine max
  Peptide Sequence Number=SeqID_121675
atgagtgctctcatggagacggagctcacaaccgaccaaaacggtgctgcttaccaacacccacttcctattcccgaggacaaagttcttgtccctgggtttaggagtggcttgaaatga

SEQ ID NO: 29991 - DNA, 1323 bp, Glycine max
  Peptide Sequence Number=SeqID_121676
atggaagtagatttgcctgtcctctacaaggtcatcgcatgtgtttggaaaaaagacaaagtaaattgggaagagctcctggcaagtgtgacggggtcgtccattcgttggttctcacggtggaaaaaaggggtgacaggagtattgtgcttatgtgaagaatttctaaatgtccctttgatggggacgaggggttgcattaactataaccctgtgttggccataagacagttagggtatcctatgaaaggattcagtgaagctaatacggagatacttcagaagatccataaggcatggaataaagtggaaaggaaagataaggagcttagaggaataagcaacggtgtcataggtggttatcacaaatggctgaaatctagagtgcaagggattgcttggctaaaaaagctagagggtctgaatgggaaagagatagaggtgtctgaggaaagcgaagaggtgcaagtcttgaaggctgagttggaaaagacaaaagtggcgaaggagaagctgaaggtgttagtcactagagttaggaaagaatgtgataggatgaaggatatcaacatgtccacggttgatgcgctagataacgagctcaagcttagaaaggccgagagagacaaatcaatgatggagaacataatgttgaaggatgagttaaggaattgtcgggaatcaaaggacatcttgaaagggcagttgagcaagacaaaaaagaatatgttgataatcattgatcaatataaagagaaggcaagggaagaagtgataaagttattgcatgaagaaggcatgaagtggatggacaggttcgctttcactctaaatgaaagtcaagagcttccaaagctgctagctaaagctaaggcgatgaatgatgtatattccactcccgatgaaactgcgctttatgacacccttaccagacatgtcaaggcaaggataatgagtgacatagagcaagtacaagagcaaatgaaggatgatatgaaggccatgaaggagcagatgacaacaatgatagaagcgatgatgagcatgaggaagatgatggaggtcaacgttgttacaactgttgttgccagtactgctactgagatggacccgattcaccgcccgatctcaatcaataagtatacttttccaccatacggtttgcctcctgattatacaccacttactgttgtatacactcctggtgagaatatcgctccccaagaccatactctggcctgtttcggggtttatccgagatataccactgaaggacatgcattttctggtgtccccatgctaaacgctccggggggaccttag

SEQ ID NO: 29992 - DNA, 666 bp, Glycine max
  Peptide Sequence Number=SeqID_121677
atggctggtatgggatccatgagcaacacgtgggatcagatgttggtatattgttcattcaagccacgcaagaattgcatagctcggtcttcaagctttctttgtgcaataatggcgaaagcggagcaagaacacctgatgttacaggtgcaggctggatcaggtctgaagttttcaatctcatcccaaattacgcgcaacctagtaaagtattctgtcaccgagagggctccttgctttaatgtcgatgcttcttgctgtaaatcggagattcttagaagatctcccagcgagtatctcgacttcaggtctctccagatgtcttcggctttgtccatccagagcacgctttgtcttatagaagcagcaacggagtgcactatccaggataccaccatattattgcatcgtcgccaagctccgtacgttctgtccgttttaagtggttccggcgcgcttccgtccacgaattctagcttgtttttggcactaagtgcacactggggagacaagagcagcagctggattttcgcttgtatgaagatacaaatagctctcgacattgttgaatgcagtttcgttcatgatgaacagcaaacgcttggaagaaagaaggataggaagatagtgagtgcgcagcagagctcctcatttgaagagctctga

SEQ ID NO: 29993 - DNA, 654 bp, Glycine max
  Peptide Sequence Number=SeqID_121678
attatggttagaaccacgggtttggatcgggctttagacagggttataggaagagtcctaaggaaagaacgggaagttgcagctgttgctaaggatgttcagcatgtggatcatgcagatgacgaggtccatgaacagcccgaagaagcaattgttgatgatgtagttactgatcccgagggtttttcaggcaaaccccacgacacatcagttttgatggagtatgtttatcatgtggcagcaaaagtttggaatggaaaggaatgttctgagctgaagttatcctcccgtggaaggaaggttgagaaatttggcaggcttgctccaaagatcgaaggcttagtggttgtgacaggattacgtcctctgatcgtatgttcgctgaacacgagtgatcgaggatttatgtctactttcgtggagaggtggcataaggaaactagtagttttcatctatcagtaggagaggtgactaccactttggatgatgtggcatcgttgttgcatctgcctattgcaggcacgttccatagctttgagcctcttcatgtggatgatgtcgtgtttctcttagtcgaattgcttgaagtcagtgctaaagaggcaagagctgagacagtacaatgtcatgggtcatatgtgcgactatcatag

SEQ ID NO: 29994 - DNA, 1716 bp, Glycine max
  Peptide Sequence Number=SeqID_121679
atgaagaaccccacactccgagaaagaagaggaggatcaatgcagaggcgcaacaacacggttgttccattgggcatgctcagaaggtttctcggcgcatcagtgttctcaatagttgtcacttctttcttctttgttcatgttcacgtttctccttcaccttctgatcacaagttcaatgataagatcctctcgtttcgtgacccgcaaagctggactcgagaactcgttccgcctcatctatccaaggctccactctctgttcccaagttgaaggattcaagaaaggattcagactacgagaaactgtggaagcctccatcaaatcatgggttcataccctgtacaaagcctactcctaattactcaatccttaaatcaagtgtaactgttcatccagctcctggaaggtcacgtggttacctttctgttcatacaaatggagggctaaaccaaatgcgtactgggatatgtgatatggtagctatagctcgtatcataaatgccactcttgtaatcccggaacttgataaaaagtcattttggcatgatactagcaatttctctgatatctttgatgaagagtcgtttattagttctctagctaatgatataaaaatcattaagaagcttcccaaaaaactggttaatgcaaccaaaattgtcatgcaattcagaagctggtctggcatggattactatgagaatgagattgctgccttgtgggataatttcaaagtaattcgagcttccaaatctgattctcggttagcaaataacaacctgcctccagagattcagaagcttcgctgccgtgcatgttatgatgctcttcgtttctctccacacattgaaaaaatgggaaaaatattggtggagaggatgaggtcattcggcccttatattgcattacatttacgttatgagaaggatatgcttgcatttagtgggtgcacacatgaattatctgcagttgaggctaaagagctatggattatcagacagaatactacttattggaaaagaaagtatattaatcctatagaagagaggtccaaaggtttttgccccttaactccaaaggaagttggaatttttcttactgctcttggatacccatcaaacacaccaatatatattgctgctggggagatatatgggggtgagtcccatatgactgacctgcaatcccgctatccattgttaatgagcaaggaaaagttagcatccattgaggagcttgaacccttttctagtcattcgtctcaaatggctgctcttgactatattgtatcagttgaaagtgatgtatttgtacattcttaccctggaaacatggcaaaggctgttgaaggccatcgtcgttttcttgggagtggaagaacaatatctcctgataggaaagcgcttgttcgtctgtttgataaactggcaaatggatcaatgactgaggggaaaacattgtctaataaaatcattgatctccacaaaaaacggtatgtgatagaagaagcattaattatatgtgaagcttggcttcagaaagagaaaaggacccgtttctggaacaaagggcttggacaggtaggccaagataaagcaaaagctttttcctttaacagatctatattggtgaaagaattgccgcatgcatcttccctttaccaacgtttcaacactaatcagctggaaggtgctaaaaggctgttggcatag

SEQ ID NO: 29995 - DNA, 299 bp, Glycine max
  Peptide Sequence Number=SeqID_121680
atggtgttcaatctttccaatcttaccaaatatgggacttcatctcacacttgtattctaacagttgctctactctcgaggatgcagcaacaagtatcgatggcgcttaactcggagcccaaattcgaagatttgttggcacatcaaggacttctgaaggtgttacgcgactcaaagcctgagaagatgaaggatttggattgggaggggttgcaagaaaaggttgtggcaaccatacgcttgtgtttggcagacgaggtcctctattacgcaatggagttgacgtctccagaagggta

SEQ ID NO: 29996 - DNA, 3762 bp, Glycine max
  Peptide Sequence Number=SeqID_121681
atgctccatcacccattcctttacgcttccaaaatcgccactcagtccacactcttccctccggtttcttccgccggaaacagcgccggccgttcttcgttagccggaaattcgtccgcccgtgacgtgaggtcgttgaggtttatgaagcaagcatcgggaagcaaatcgaacaatgaacttggagtttttagcgagacaatggaccgcgccaggcataggacaaccactgtttatggtggtcgtgctcaagaaggggttcttgaggaagaaacctccaaggtgatagagagcagaccatcatggaaagtttttccaggccaggcatttccattgggagtatcagaagttgacaattgcatgaattttgctattttttcacaacatgcaacagctgtcacactttgtttagtacttcctgagaggggaagtattgacgcattggatggtggcatgatagaaatggttttggatcctgatttgaacaaaactggggacatttggcacatatgtattgaggatcttccacgtagcaatgttctgtatggatatcgcatagatggacctggagaccggggtaaggggcatcgatttgacagcagcattgtgcttgttgatccttatgcaaaactagtcgaaggtcgaagatattttggggatattagcttgaagttgtctaagtttctcggcacatatgattttgacagcttgcctttcgactggggagaaaattacaagcttccaaatatttctgagaaagatcttgttatatatgagatgaatgtccgtgcatttacaagtgatgaatctagtggtttggatagcaacattcgtggcagctacctcggtgtgattgaaaagttatctccttccccaaccactagaagggaactgattttaatgttagaggagtctaaaaacggaagagcgagagagaatgagagcgagagagagagacagagtgagagagacagcgtgagagagagtgagagagacaaagcgagacatagtcaaagagagctccttcagaatgtgaaggagagagagtggaggagtgagagagtgggtagaccgagagagagagtccgatcacatcgagagagaaaggcggagcaaagagttgatcatgggtggcgtacgttgaataatcgaaggaccaattggaatggcatcaatggaagaagtgcagaacgctggaatgcaaggatggaggaaccgaataacgataactctaatcatggagactgggtaatagtatcacgcaagaggaaaaacaaagtggaggatagtagaggtagaaagcaagggaacaactaccaaaggaaagagaagcagatgacatggagaaataaggctgacgttacgaccttctatttctccagattccctgaagggataatggagaaagatatgtggcagattttccagaaatgggggaaggtatgggaggttttcattccccgaaccaaaaacaaacttggccataggttcggttttgttaggttcaaagaggtgatggatgaacaggggttagaaagatgtctggataataacatttttatagatggccagaaggtgttcgtcaatagaccgaagtttgacagggggaaggtgccttgcacgcacgtatacggcaatgctactcgtcgtatggaggctgatcaacaggtgcacaaagatgctcaggtggacaagacaaccagtgttaaaaaaggaggtcctcgttcatatgcagaggtagttaaggagctccaacctggccacacgagaaccaagtatatgggggagggtgttcatcgcgctgtaagggataactatcggccagtgaccttgagctcgaataaggagaagtatgagtggctttacaagtcctgggtaggaagattgaagaacagagccatgtttgaaagggtggaggaggagttgaaatgggtggtggaagataacgttaatccttgttactgggttgacgactgggttctcttccctaacatggacgactccagcgctgcttgtctcatacaacaagagatggataatggatccactcctctctcggagctccagaaatggtctccggaaatacgtcccactcacagactcacgtgggtgctcttatggggccttcctctgacggtatgggacgtggaatccatggcgaaggtgttaatggagttcggtgaggtggtggaagtggatgactttgtggaggataggacgaggatggacgtggcgcgcattttgttgcggacgaagatgggacctctgtttcaggcgacggtgtcggccaccattgatggagcacagtatgttcttcacgtcgcggaggatgcgcctagtctgggaatagtgaagaagcaaaatcgaagtgacctgtggttccccccttcccctttctcgacccagccaaacacccctgtaacggcgggtgacgacatcccaggggccaccttctgcgatgagttctccggcaacgtttccgacgaccccgtcggcggcttccctgaccacaggtccatgctcccatcgtccaatgctcgtagagaccactgggttcaatcccttggtcgaagcgttatggaccggtccgccataatcagagatgaactggcccaatcccaggttgacagagctcaaagtcaacattgtcctcatctggagaacgtgttggaaaaccccaatggccatatttccggaaatggactagctttaaatgcttctgtcgaaaaagctatgcaggagactaaccttatagaaaaaatccccaatttagactgtcatgcagacgaaggacagtgggttaacacccatggggaaatttcgggcctgacaaccaaagctaaacagggggagttcgaaaaagctttgcctcttaaggaatctctgcctcacaattccattttgaattccacgtatcccagaaggaattgtgctgactatggtcaaaatttaaacaagctacctgaggaaatggaccaacagatatgtggcccaactccctctgccacaaaggtctatgtgagaagaaaggaggtgttgagaagtaatcccaaggcccagcagagtgacaaatcaaaggagatgatgagaagtaataccaaggcccagcagactgaggaacctatagtggactccaacccagcttctaaaggtcaccctctgttttctgtatacgaggaccctataaagctgcaatgtgacatcctgaaggaaatgggcttgtcttatgaggaagaagatagcaaggcttggggaggggagtcaagtgggctgctgttagaaggctcattgtacagcaaaaagtggatcttgtctgcctccaagaaaccaagagggagaactttaataaaagtatttgccaggccatttggggagactccactggctgctggtggccttttatgtatgtggaataactccacctttgtggtagaaaggaagaagttgatatttgtcaatgtctatgctccttgtgatctggttgggaagaaagctttatgggatgagttgaggcagctgaaggcttctaatcctagtggaatgtggtgtttccttggggacttcaatagcattaggagttcccaagaaagaatcagcttatctcaaagaagggcagatccttatgacattgcagcctttaatcagtggattgatgatatggagcttcaggaaattaaatgcttgatagattcttggtctctcagaattggatatctctttggcctgagagctgccaaactgtccttcaaagaacctctctga

SEQ ID NO: 29997 - DNA, 273 bp, Glycine max
  Peptide Sequence Number=SeqID_121682
ggggtcggggacggcggagaagaggtcggagcggttttcgaaacgggggcgggagcgggtggaggaggggtggtgggtggtggagcggaagaagtagttggaggagaggctttgggggaggcagcctgtggcggagacggagaggatttgggggtggcggcgggggaggctgacggagatagagagagagcggaggtagccagtaacatgaagaaaaagaggaagagtgttttggccattgtgagagcaaagagaagaagaataaatgaataa

SEQ ID NO: 29998 - DNA, 552 bp, Glycine max
  Peptide Sequence Number=SeqID_121683
atggggatacctgtagaggtggatattgactggggaagtgtgataacggttgcgagaaggagatgcgaatgtggaagagctcactcgcactctgggtttgaagtaaacgtcgtaattggggaggactcacgaccaagaatgcatgtcggaatttcccttgagctcgacaaattggccttcgtgaatgaacttcatcgtgcgaccctgggtattgacttggactgccacgcaaatctgagagcactccacttcactaccattgccgacgaggaccctgagtgtcccatgggtcatcatctgcaatcaaaaggaagaagcgtgaggagcagcggtggtcgcggaggaggtggcttcgcgggggaagggagtaagggtaaaggcgagggaggtgagggagccgaaatggaaagcggggttgacggtgaagaaggaaaggatgggtggatgcgggtgctgcggaagagtcctgaaacttttcctcctacagaagggccaagccggcggcgtgaaccatcatcagtggctgcagagcttggacttcacggcgaatag

SEQ ID NO: 29999 - DNA, 1470 bp, Glycine max
  Peptide Sequence Number=SeqID_121684
atggacattatgaggagcgaaacaaggagcgcgctaagccggtgcaagacacagcagaggatccgaagcacgcgcttggcgggcgctgccgcgccaagcgcgctcatctacctggaagcacgcgctaagcgcgctattgtggcgctaagcgcgtgccagcagcagcgcgcagggtggcaccaagcgcgaggctgggccttagggccaccagtcctcatggcttctcgcaagcgccgtgccgtgcccacacccggggaagcgtccaactgggacacttcccgcttcacatctgagattgcttggcacaggtaccaagacaacattcagctccggaacatccttctggagaggaatgttgaactgggacccgggatgtttgacgagttcctccaggaacttaggaggcacagatgggaccaggtgctgactcaccttccggagaagcggatcgacgtggctctggtgaaagagttctattcgaacctttatgatccagaggaccacagtcccaggttctgcagggtgcgaggacaggtcgttcgttttgatgctgacaccattaacgacttcctcgacaccccagttatcttggaggtcggggaggagtatccagcatacaccagatacctcagcactcaccccgatcctgacaccatcgcggccacactgtgcactccaggggggcgctttgtccttaatgctgatggtctcccctggaagctcctgaggaaggacatgacgacacttgctcagacatggagtgtcctttcttactacgatcttgcgcccacttctcacacttctgatgttaatcttgacagggctcgcttgatctacggtttggtgagccgcatggacatggatgtgggcagctttatatcacagcagatcagccagattgcccagtccagtacctcgaggctcgggttcccagcgttgattacagcgctgtgtgacattcagggggtggtttctgataccctgatctttgagtcactcagccctgcgatcaacctagcctatgtgaagaagaactgctggaaccccgccgatccatcgatcacgttccctgggcctcgccgcacacgtaccagagcttcagcatcagcttccgaggcccctcttcctacccagtctccgtctcagccatcccagcgaccgcgacatctacctgcttccacctcagcatccatggacacgcatgggcagatgctgaggtcccttcacgttggacagcagctcatcatggagaatatgcacaggctgtccctacacctgcagatggaccccccgctcaccactccagaggcttatcgtcagcgagtcgcctggccaggagaccagccctccactgacaggggggaagagccttctggagctgctgaggatcctgcagtcgatgaggacctcattgctgacttagccaccgctgactggggcccatgggcagacttgggcggaggcagttga

SEQ ID NO: 30000 - DNA, 626 bp, Glycine max
  Peptide Sequence Number=SeqID_121685
ttggtccaggtggaagtccagatgagaatggagaaactacaattgatgctttgataatggatggggtgacaatggaagtaggagctgttgcaaccatgagatatgtaaagaatggaattaaagctgccagaaagcatcagaatttgctatttcaagtacggatcaagtacgagcttgagttcttgtggatcaagtacgaatcaacttcaacctatgcggatcatctatcactactgcggatcatctacaacctatgtggatcatctacattctaccctatcactaatgcggatcagatcaatgcatacgtggatcaactgaagaagaagggagctactgaagacgaagcgaagaggaagctgaagaagaaggtgtattgccatggtggttcgttcataattcgcattgagtttgtggttgtcgtcgtgatgggtgttacggtgcaacggcggaggatgactcacggcaaaaatagtgggacgatagcagacaccaatgaggagcacacacggattgatgaagatcaagcatggattgaagagaagatgagagaatttgagaggagaaatcctgtaagcatgaatgaatggtgtagacggattcccaagccgtatttcacattttaa

SEQ ID NO: 30001 - DNA, 861 bp, Glycine max
  Peptide Sequence Number=SeqID_121686
atgaatctccctcgagacgtggacgactacttcaaacaaaccctcgacgatacattagggattcccgtatcgtcgcgaaccctagaatccaagcttcaagcttcccaagagtcgcaatggcgcctccgcgaacacctcctttcccttttcccccaattgaagcggaaagaccaactcatcgaccgcttcaagtatgaagcgggaatgaacgcgcgagctctgaagaagttcgttgaggagaatcagagactggcgacggattgtgagaaattgttggctcgctgccatcagttggagaatgatcgcgccctgtatgataaagacagagaagcgttgatggagtttgggaacgacgctgacgaacgggcacgggaggctcaaacccgagttcttgatttggaacgggatttgctctttatggggaatgaattgaacaaatataagaatcagcatcaattgatatttgctttctccatgaaggtgaatccttctgtgtgcactcctggggaaaatattttacttgattctgttttagcaactcttactagtaaagatgatgattctacatatgcatttttgcaagtaaacagtgagaatgaggcctgtaaacagtttctgagtatgtggaactgcataaacccatcaactcggagtgttttgtcccttgttgctaaaatcaagtcacttgagaaggataaggagcatctaagaactaaccttcacaaagctgaggaggaggtcaaattactgtttgatgaaaacaatgtattggaaaaggagaacaaaaggttattgaggatatacaagaaaagaaaccatcccgattctggggggagcataccaacagctaggggtgggtaa

SEQ ID NO: 30002 - DNA, 237 bp, Glycine max
  Peptide Sequence Number=SeqID_121687
atggttatacattgcggcatccaagcaagacagatttgtctttatgcaccatggcacgtctccccgaagagcgcgtttcccgtaaaactgacatgtggcagacttgagacgcgccctgcgtacaggcgcgacgggacgcgccctacatacagacacgacgggtcgtgctggggacccaggtgcgacagatcgtgctggggacccaggcgcgacccagttgggtcacactttatttaa

SEQ ID NO: 30003 - DNA, 576 bp, Glycine max
  Peptide Sequence Number=SeqID_121688
atggcagcgcagttgatccatgatcgcgtcgtgatggagtgcctagagggtgtttgggagacccttgaaggcaatgagaggtgccaattccgtggtacagttcgactcactgctacttcgctagtacatccggagcaacccgcacgcacacttcagcaacctgtggagtggatactacctacgcctactccatatcgactagttgagcctgctcaattgatagaggtgtcatcctctaaagaggatcttgaagaggacccagaggagttatctcctgaacctgctatggatgcccctgacttaccagaggatgatgaggacccgctccctgatgtttcctacccatatgtcattccgccaaaggagggagagccaccacatcctcctgtacatctaccccttgggcagctactgacagagtatgtactaggatcgattctagatggcttcagatcccatgcaaagcttgctagacctttgctactaaagtccgaaaagatgaaaaacatttttcctatatcattgtcgggtttaagcttcataaactcttattcaacacaaccatcattgacgtaa

SEQ ID NO: 30004 - DNA, 216 bp, Glycine max
  Peptide Sequence Number=SeqID_121689
atggggtttcgcggtaacaggacaaaagaagtgggggatttgctaggggcacccagcagaattgctggggcggaagaattctttcatgggactccacggaagaaccttcttccgcaggaagaaccttcttccgtgggactcagccacatcctgggtaacccgttgcctacgtgcggaggcagtgggcctatgatggcgaggaacatcctgactaag

SEQ ID NO: 30005 - DNA, 1278 bp, Glycine max
  Peptide Sequence Number=SeqID_121690
atggggagcttgaaaggagacagtggacatgccaatggcgaaaatcttaccgaagctcttttgccaacacgagatgcacaacaacaacatcaaacagacgacgaggaacaaagatttggtgacaagctctggcttgaaaccaggaagttatggctcattgtggggccctctatattcagccgcctcgcgtcgttcaccatgaatgttgtcacccaagccttcgccggtcacttgggtgatgtcgaactcgctgccatttctatcgccaacaacgttcttgttggcttcaatttcggcctccttttggggatggcgagcgcgttggagacactgtgcgggcaagcgtttggggcgaagagataccacttgttggggatatacatgcagaggtcatggattgttctgttcatgtgctgtttcctgctgttgccgttttatgtttttgcaacgccgcttctgaaattcctaggacagccagatgacgtggcagagtggagcggggtggtggcagtgtggctcattcccctgcacttcagtttcgcgtttcagtttcctatgcagagattcctacagtgccagctcaagacagcagttattgcttgggtttctctgctgggtttggtggttaatgtggtcacaagctggctcttcatttatgtctgggattttggactttatggcgcagctatttctttggacatttcttggtgggttttggtttttggcatgtatgcttacattgcctatggtggctgccctttgacttggaatggtttctcccttgaagctttttctggactctgggaattcctcacactctcttccgcttctggggtcatgttatgcttagagaactggtactacaagatattgctacttatgactggccagttggagaatgccactatcgctgtcgatgccttgtctgtatgtatgaccatcaacgggtgggaaatgatgattcccctggctttcttcgcgggtactggggtaagggtggcgaacgagttaggcgcaggaaatggcaaagcagcaaaatttgcaacgcaagtatcagtggcacaatcaacaatcattgggcttatattttgcgttctgataatgatattccatgagcatatagcatacatattcaccaccagcacttccgtcctacaagccgttgacaacatgtcattactcttagctatcaccattcttctcaacagtgtacaacccgttttgtcagataaaaataatggattgttgcttgctttgcaacgtagatttgcaacgtag

SEQ ID NO: 30006 - DNA, 336 bp, Glycine max
  Peptide Sequence Number=SeqID_121691
atggaagaagaaaaagcagcgacgtactacgacaagctaactcgtaagggcaagagagctgcgaggttcaagcaaggtgtcggcttttcctcttcagcaccaaacgcgacgttccaaaaccctcttcctccttcctctccaaattcgtcaaagcctcctctgagtcgaagaagcaagcacagctccaatccatccacgacaatctcaagaaaaagccctcttttgagtctagggtttcaagcagggatagggatagcgatagaagtagaagatgaatcaggagcagagaaaaatgaaggaaaaggagcagaagcggagatagatacaaggaaatga

SEQ ID NO: 30007 - DNA, 78 bp, Glycine max
  Peptide Sequence Number=SeqID_121692
atggttttgttggttaaaggagtagttgtagttgtggacatgagggttgtggagacgatgattgtggttgaggaataa

SEQ ID NO: 30008 - DNA, 333 bp, Glycine max
  Peptide Sequence Number=SeqID_121693
atggcggtggctggcaacaaaggacaaaacggaacattcaaacctagaactcaagaggaagtttgtaagaggatgagagataagattcctgaaattactataaatgtcagaaacatcctaaagttggcaaccatgttaataaaagagtttgagaagttacaaggtatttttggtaaagatcgtgcaaatggtcgtggggccgagcgttgtgaagatgcaatggaaaatcaaattggtgagaaccaagttagtgatgatgatgagtggctacaccaacatgataattcaccttcttttattggaaatacttttgttggaccaccttctaaatga

SEQ ID NO: 30009 - DNA, 966 bp, Glycine max
  Peptide Sequence Number=SeqID_121694
atgagtggagagagaggagagagagacactgggtgggagagtgttaggaatagacgggaaaggagagagaagggtcctcgtctgagcattgatcggaaaaggaaccaagaccatcaccgctaccagcgagaacgtaacgacataacctccttttacttcactagattccctgaagagataacaaaaaaggacctgtggtggcatttcaagcaggtgggagatgtgagggagattttcatatctccaaaacgaaacaaaatgggaaagagatatgggttcgttagatttaaaggggtgcaggatgttcatcaggtggagaagaaacttgacagcatggtgtttggagggttaaaaatgttcgtaaacactcccaggtatgggagaccaaaacgtgaatactcacaagtagaggctaaaggaagaacagggggtaagtatcatctggaggggtccaaagaattagccttgacactgaaaacaggaaaaaaggagcacattcaacaagggtcgtacgcggaggtagtgaggagacacagttcaagggcagcacagaggggaatcctatctaacggggaacttaattgtaatagctcgaggtcatcagtgaaccttgagatacaggggataggacaacaatggctcaaaggggcttggatagggagactaaaaaatatggcaatgtttgagaggatagaggagtacctgtggtgggatattggagataacatatatccgaagtacatcggggatgacatggtgctactccatggtctcacagaacaaaaagctaagcgaatgttagaggaagataaagaagggtggggagaagttttcacgtccttagagccatggaacctacatattcgcgctggctctagactgacgtgggttcattgttgggggataccactgatggcgtgggacatgcagcatattaaaaaaatagtggcctccatcggtgaaatg

SEQ ID NO: 30010 - DNA, 795 bp, Glycine max
  Peptide Sequence Number=SeqID_121695
atggggataagtttatctaataatgagttggaaccgccaagaaatgtaagcaatttagatgatgatgaagatgaagatgatgattattattttgtgtctaattcatacgttgaagagtttttagatgaagatgatagtgttgatggtatatctgatacagatgataaagtcacccacatgattgaaccagttacaattgttcaactaagaaaaggtgtagaaggaattcaaaatccattttggaattatgttttgcattataacaatatcaattggagtcatcctaatgaggaggacaattacggtttggagatgccatcgagttttaatgttgggcaagaattatatgttggcatgattagagaagatccatcaataaaagtttctttgattcaagaaaggataaacaatgaattttcttataaggtttcgtacgaaaaagcatggatggcggaacaaaaagcgattgcaattgaatatgacgattgggaagagtcatatgcgaaactttcatcgtggccaaaacacatgccaaataattctcttggatcctattttcaaatactgcatgacgattttattgttgggaataaggtgagtcgtgaacaccgtaaagaggcttttaattattatgttgtttacacaaatgaccacatcttaaaagcttactccgcacaatggtggcctcttgggaatgaagcgacaattcctccttctgatgattcatggacacttatctcatctctgatccaagtacaattcgtgcgaaaggttggccaaaatcaacaaggataa

SEQ ID NO: 30011 - DNA, 1080 bp, Glycine max
  Peptide Sequence Number=SeqID_121696
atgggagcagtaaagaaattggtggtgaaggagcaagtggatatgctatgcctacaggaaactaagaaggaaatggtggacaaaactgttattggtagcggatttatttcactagaaggaacttggaaaggtgatgtcgatgatttcaactgtgtaaggagacaatcagaacgagtgggggctagccaaagagagcaaggaggggggatcatgacagaatttaatgactggatagtggacctagaagttgaggatatgccgagtgttggtcacaaatacacttggtataggctaaaatctgcctttcaagactctagactgcctggtttcaagataaaacttttaggaagacagtttgggaatgttggagagagagctcagtacaagggggaggatagagacctaactgaggaggaaatcaaactgaggaaggaattggaggaggaagtttgggtggcagcgcactcaaaagagtccattatgagtcaaaaagcaagaattaagtttgaagaatcatcatttgagagaccaaggctggatggtgtagaattcaagaccattaatcaggaggcaaatgcaaaattggtggccagatttgaggaggatgaggaattttggaacataatgaaaatagatgttttgcgtttctcggacgaatttcatgcaaatggacactttccaaaaggtagtaatgcatctttcttggctttgattccaaggcaaaaaggggtgtgggatcttgcgtcttttaaccgagcactactcggtaagtggcgttggaacctgtttcatcatactggcgaattatgggggatggataagggtagggaagctatttccatctttaataagatcatctttatcctactgaaaaccagaaggagtggggatgggtatgagaaagagaagaaggaagactatgtgactttccaatacaacagtgattacaaaaatctgttggaaaaggtggaaacacctgaggagttaatgtcacatgatgggaagcaccagaatcaggataccaagtctgagtctgaatgggagcagatgatgaaatggtcagataaatctgaggattag

SEQ ID NO: 30012 - DNA, 543 bp, Glycine max
  Peptide Sequence Number=SeqID_121697
atggtttccacatcaattccttctccggtttctcctccttcctccccaccgcctcagccaactcggttggttgaacctgttattcgtagtcatcatcttgaaggctacatcgttaatctgaaaattccacataagtatagcatttggtacgaacaagaccaattcttcttgcctgtttgcaatccaacatctccggggacattctttcttgaaacattgttgctcgcgagtgaagtgtgcattgatcgatctcataagcaagctatagtttctgataatcttactcaaggtttaggatctgttaatctcaactcttggaattgtcgtggtggtcggaattttggccagaacaaccgtggtggttgtggttcaggccgtggtggtggtagaggtaggtttgttgacgtacaatgtcaaatctgtcacaaatttggccatggtgtttcttactgctatcacagactagaggagaattatgttcctactcttcctccaccagcttcacttgctcctactcaatctacttcagcttccaatgcttag

SEQ ID NO: 30013 - DNA, 108 bp, Glycine max
  Peptide Sequence Number=SeqID_121698
atgggcactgcctccctccctcacaagttttacaccgtcgtgagtcatggttgtcgtcggagctctcgcgcttgctcctcacagtcacagttatatttgcatacttaa

SEQ ID NO: 30014 - DNA, 978 bp, Glycine max
  Peptide Sequence Number=SeqID_121699
atggagaaaaatggacagatatacatgcttataattgagttgcgggaccctagcatacatgccattgagtttgttctgaaagatggaaatcacgatagatggttgaaattgaaccacagcaattttcgaatagagatacctgcaagtgatgctcctggaatatctcattctgattctagaataccaaaaaatctgatagaacagaaggcttattcacggtgggagggaaggcctataagtttgccccagcaacagaagcaaaattatgatattgcattgagagagctcccaaatcacttatcaaaaggaataaccttgaccgagtcacggaatagctatctaactggaggaataaaacctgtgaatgataacagagataaactcagaagtggtatccaatattcctaccttaatattgaagactggttgcaaaagcattctgaagggcatgccaaaggcaccatatcaacagcagctcttatagagaattttatagggggaacagatgtattgtcaaagcaaatatatcatgttcataactatgagattatggtattttcaaaaaccattaatggcaacaaccacattttcattgctgcaaacacaaaaggtactacggtgcttcactggggtgtatgcaagtcctctccaagtgagtggttggtgccaccacaagagatatggccagaaaactcaaaactggtttctggagcatgtcaaagctattttagagataactttgcagggaatagatcctttcaggttgtttatgcaagtgcattgtttcacagtcctactattgtggattcatggaaaaggaattttgctggtattcaatttgtcatctggacaggtggatattggattaaacacaatggggaaaacttcttcgcggagctcaaaccaatcaatccaactgaaaaggccatagttccacatgctcacccttttggcctcttgcaattaaaaagttcctga

SEQ ID NO: 30015 - DNA, 783 bp, Glycine max
  Peptide Sequence Number=SeqID_121700
atggctcataatcctgttcttcatgctcagaccaagcacatggagattgatgtcttctttgttagagaaaaagtcttaaccaagcagctggttgttcatcatattcctgctcttgatcagtgggcagatgctctcaccaagcccctctctacaaccagattcatgatgcatcggaagaatgggcagtttgcttccttgaaggaaagcccaggttcatctaattgggattctgcacagagttctggtcaagttggcacttctcattctgaatctgtacgtagatgtcaccattgtggtgtcggtgaaaataatactcctgcaatgcgtcgggggccagctggaccaaggactttatgtaatgcatgcggccttatgtgggctaacaagggcacactcagagatctcagtaagggtggaaggaatctttctgttgagcaaagtgatctggacactcctattgatgtcaagcctacttctgttcttgaaggggaattgcctggcatccatgatgagcaagtagaatcttttacatgttgcaaattcattttcagcagtgcaaatggtagttctgaagatccttccaagtccaatgcagcggatggttctagtaatcatgctgtaaaccccagtgatgaggaattgcctgaaactgcagaacactttacgaacgttctgccactgggaattggtcattcttcaacaaatgacagtgaacaggaacctctggttgagctttctaatccttcagatacagatattgacattccaggaaactttgattag

SEQ ID NO: 30016 - DNA, 570 bp, Glycine max
  Peptide Sequence Number=SeqID_121701
atggtgtgtactctggaagcaatgccagaatctgcgccgctctcgttctatttaagtggatgggacgcgtttctttcggatgacctagcctcttctggccaaatcattgcaacggcgtcaacatccgcaaccacctttgcagatctaaaggccgctcctgctcgccgatggtggtggtcaatcaacagactgagatgttgtgttgtgacttcttgttggtttagttcgaagctatccagatctgagagagggagaatcgttgtcgttcatcgccgcgatggtgcttgttgtggattcgcggttagtggcttgcggtggttggttggcggtggattttctggtacttcgtggtggttccgccgtggccgtggtttcactgctgttatcgccctacttgggttccttcgcctcgccgttctggttgttacagtggtgtccgcggcggtggcggctcttggtggagacgacgaggataacactttgttgaatgacaaagacgttacagagatgctcaactattatgaaggtgaaaaaagagccaataatgtgttcttagttgactttgtgtga

SEQ ID NO: 30017 - DNA, 300 bp, Glycine max
  Peptide Sequence Number=SeqID_121702
atgatgcgtaaggggccatctggtccaaggtcactttgcaatgcttgtgggcttttttgggcaaataggtgtggaccagcggaccactctttcttgccatatgggattgatgtaggagttagtcccatatcagctggcactttgagggatctttctaagagaaacctggaacactctcttacaccacctgagcaggttgatgagggcagtaataataatgccttggacattcggagtggcatccctgcacagcataacaatcttgttaatgatagcaaagctttggtatctgatcgttga

SEQ ID NO: 30018 - DNA, 564 bp, Glycine max
  Peptide Sequence Number=SeqID_121703
atgaacagactccagcggcaacaaagataccaagatagttggagtggtggaggtgtcattgttggtggtggcgatgtcgatgatggtagcaatagaggtgttggtggtgacgaagatgatattagtggtggtggtagtggtgacgatggcaacagaggtggtaacaatgacgataatggggtgatactggtgttggtgatggcaacaagtgatgatcatggtggttgggacaaggttggtggtggttgtaatagcagtgatggaggtggtattgttcgtaatggtggtgacaatgacagtagtcatgatgatggcattaatggtgttggcgatgacaataacggtgccagtggtggtaccaccaatgctggtgatgatggtgatatcagtagaaccagtggtgacaacaacgatgatgacaaaggtggtatggtagtgacaatgacaaaggtgtcattggtggcggcaatgatagtaattataacaataatgatagtggtgacaataacgatactgatgatcgcggtcgtaataggaaaaagtgaaagtgtcaagatcaaatag

SEQ ID NO: 30019 - DNA, 1557 bp, Glycine max
  Peptide Sequence Number=SeqID_121704
atggtgcctggcattgttagattcaatatatttattaagccttccaaaaagtctaatggatatcttcttcacggagttgtgtttgctgcaggagcaaagcgtcttgttacacttggattaggtgatgatgatcaatccattgaagatgatttttctgcctggaaagaaactttgtggcctgagttggataagttgctccgaaatgaggatgatgcaaatactgtctctaccccctatacagctgctattcttgaatatcgagtagtgattcatgacccaactgtcacatcatcctatgataatcacataaacgtggcaaatgggaatgctgtgtttgatattcatcatccttgcagggcgaatgttgctatacagagggagcttcacaaacctgagtctgaccgttcttgcatacatttggaatttgatatatcagggactggcataacatacgaaactggagaccatgtcggtgtctatgctgataactgcaacgaaactgttgaagaagctgggaagttgttgggtcagaatttagatctattgttttctcttcacactgataaggaggatggcacttccctaggcggttctctcctgcctcctttccctggcccttgcactctgcgtactgcattagcacgctatgctgatctcttgaaccccccacgaaaggctgctttagttgctttagctgctcatgcttctgaacttagtgaagcagaaagattaaagttcctttcatctcctcagggaaaggatgagtactccaaatgggtggttggaagccagagaagtctccttgaggtgatggctgagttcccatcagccaaacctccccttggtgttttttttgctgcagtagcccctcgtttacagcctcgttattattctatttcatcctctcctaggtggtttgctccgcaaagggtacatgttacttgtgccttggtgtatggtccaactcccactggtagaattcacaaaggagtatgttcaacctggatgaagaatgctattcccttagaaaaaagtcccgactgttgctgggctcctatttttattaggccatcgaatttcaagctaccagttgatcattcaattcctattattatggttggacctggtactggtcttgcacctttcaggggatttttacaggaaagatttgcgctcaaagaggatggtgttcaacttggccctgcaatactcttctttggatgtaggaatcgtcgaatggattttatttatgaggatgagctaaagaattttgtggaacaaggttctctttcagaattgatagttgcattctctagagagggggctgaaaaggaatatgttcaacacaagatgatggatcaagctgcacatctgtggagtttgatttctcaaggaggttatctttacgtctgtggtgatgccaagggtatggccagagatgttcatcgaattcttcataccattgtccagcagcaggaaaatgtggactcgacaaaggctgaggctatagtgaaaaaacttcagatggatggacgttacctaagggacgtatggtga

SEQ ID NO: 30020 - DNA, 177 bp, Glycine max
  Peptide Sequence Number=SeqID_121705
atgaaagtggaagcagaaccgttaagggttggcgtgcagttttgtgttcacgggcgagttggctctggcgtttcgggtggtggaggctccggcgctgcaaggtggtgggtttgtttgggaaatcgtgtagtgagtgtgaaaggcagaggaagccggctatgtcccatcggtgcataa

SEQ ID NO: 30021 - DNA, 537 bp, Glycine max
  Peptide Sequence Number=SeqID_121706
atgggtggagagattgcacagctgaaggaagaaattgagatgcttaggcaggaaaaattagggaggaagattgtgacagtcaggagaaagatttttgttgaaaaatacccaagtcccacatcggctgcctcactccttggagtgcagcttatatacctagaattacaatcaaggaaggagaagcttgatttcaagtataagaagcaggggaagctgggtctgtgtcttctctctgaagagagtaatgacaagataaaaatgaatacacccgaaatgagcagtgcaagtgagaatagtgttaagatggagaaaacagctgaaggactttgctgctcatgcagtaagaactccttgtgcaagactaacaaatgcagatgccgatccagtggtgggagctgtggagcatcatgtggctgcaaacgttttaagtgcacaaatagggaaccaaaccaattagaaggaaatgaaccactaaaatcagataatacagaatgcactcttgaggcttcggctgaagacaaagatggaagtgtgtga

SEQ ID NO: 30022 - DNA, 646 bp, Glycine max
  Peptide Sequence Number=SeqID_121707
atgcctttcgagtctcaaggttttgtttcacactcttttccaacctccatagctgagaagctagacgatttcaactacctacactggcgacaacatgtcaaaccaactccgatgcgcgcagtttcacttgaaggaaaagcaatggatgaatatctccataagattaaaggctatgtcgatgagcttgccgatgttggtgttctggttcgtcatgaggagtacgttgatgcaattctggaaggtctcccttctgattatgcaccagttatctcagtgatcaaaagcaaaaaacgaactccatccattgctgagattgaagctctgctttattatggtcacgagactcgtcttgttcattacaaaaaagacactcaatttctcaattctccacccttgaattatactcaaggttatttgcattcaagttcatataaatctggtgattctggtggctctagaggggtgtatggtcaaggggtcgtggtggtggctgatttgccaacttccagtgccaaatctgtctcaaatatggacatactgctaattagatcttcaaacacttgggttaatcctaatcccaagcctattgctcagccaaccaatcaacctagtgttatgcttacaaactcagcttctcatggcaatg

SEQ ID NO: 30023 - DNA, 507 bp, Glycine max
  Peptide Sequence Number=SeqID_121708
atggcatggcaccgaagagaattgaatgcagttttctcagcagtgtctgcccttgagctttcaatgtccaaggagcttcacagatttggagtttatggaaagccagcccctcaagatttcactgctgattatgaacattggaaacgtgtaatgtccaagtcttatctagacgggatgggaattaaatggtcaaatgtacgcaatgtcattgatatgagatctatctatggagggaacttcagattgctggaggagcttcaacgtggtgaaaaaggaattggagatgacacaggtagctatggaatggatgatggtgatgacatttacatgcactcttggactggcaccattattggcccccataatgacaaccgatgtaggattggtggatattctacatcgattattaggaaaatcaatgtaggatatttaccatggggtgacattctacgacgtttcacggccacaaacgatgtagaattacggacattctacatcggttattag

SEQ ID NO: 30024 - DNA, 1536 bp, Glycine max
  Peptide Sequence Number=SeqID_121709
atgaagcttcagattttcacccaactgaaccaatctcaaaaatccgcattcgcggtggttttcgtgattctcttgccgcctttcttttccaatcttttccaacctctcggtcgtgcttcgccttctacgttctctgagtggaatgctccgaggcctatgcacgtggctttgctagagggtgccttgcaacgccaaacatcagttgaactccaaactagtatctggtctcccttggctttccaaggatggaagccttgtactgagcgtccaaaaccaccttcactacctgaaaagtcatggggttatatccaggttttccttgatggagggttgaaccagcagaagatagggatatgtgatgctgttgctgttgctaagattttgaatgcgacgttggtgctcccacattttgaagtgaatcctgtctggcaagattcaagttcatttgcagatatatttgacgtggatcactttattgatgacctccgtgatgaagtgtccatagtgaaggagcttcctagtgactactcttggagtacaagagagtactatggcacgggcataagagctacgagaatcaaaaccgcacctgttcaagcaactgttgattggtatatagaaaatgtcttgcctgtacttcagagttatggaattgctgctattgcaccattctctcatcgcttgacattcaacaacttgccatcagacatccagcgcctccgttgtaaggtcaactttgaagcactgatctttgtttcacatatcaaggaattaggaaatgccattgttcatcgtcttcgccacactacagaagggagtgactatccgctggaggaaactgataagtttggaaaacagcaaactgggaagtttgttgtgttgcatctgcgttttgacaaggatatggctgctcattcagcctgtgattttggtgggggtaaagctgagaaacttgctctagtgaagtaccggcaggtgctttggcagggaagggtattgaattctcaattcactgatgaagagttgagaaatcaggggcgttgtccactgactcctgaagagattggattgctcctggcagctttgggtttcaacaatagaacacggctttatcttgcttcccacaaggtttatggtggagaagctaggttagctactttaagcaagttatttcctcttatggaagataagaagagcctagtctccacagaggaaatggccaaggttaaaggaaaggcatcactgttagctgctgttgattattacgtgagcatgcagagtgacatcttcatttctgcttctccaggcaatatgcacaatgctctagcagcgaatcgtgcttatatgaatctgaagaccatcagaccaagcatgggactgttggggcagctatttcagaataaaagcataggctggtcagaatttcagcgtgcaattcttgatggacataagaacagacaagggcagataagattaaggaaggagaagcaatcaatttatacgtatcctgctcctgattgcatgtgtagagcttaa

SEQ ID NO: 30025 - DNA, 471 bp, Glycine max
  Peptide Sequence Number=SeqID_121710
atggtgagaatggtcataaatgagtttcaaacctggtgttcaaatttcacaaagatccaacgccatggtttcacggccaccaccaccgtcacttgtgacatcttttacggcaagaacattttacatcatcgacttcctcgtcgagaacgaaacctttggggaaacagaacgataagaatagtgtgcgccgtcagtcgcgtccctcgtcaatgtcacatgcttacacggcgatggtgttgtcgaccagaaaaccaaatcttggtttctcaatgggagcataaccataagagggtggtctcaaagaggtggccccaatacggcggcgccacagtgaaactccaacctccgacaaccgcgcaccacctgtcttcaaacggaagagaaatccacagcggatcaggtggctcccgcggcggagaagagactgaaaacgctgtcgttgatgacaatggaagcaagaagagcgattga

SEQ ID NO: 30026 - DNA, 432 bp, Glycine max
  Peptide Sequence Number=SeqID_121711
atgccttacggtgaccactgtgtagtgcacgattttgatttgatttcatgctttttaggtcatataagatggggtcccgttgtcatcaaacatcgaccaaagagggtggtgcggcaatttggatatgttcaaaccattccaccacagactaatgatgacacatatgtggagccacatatccctaaggtcccagtggcaccagcagcagcaccggcacatgccccttctaatgtggagcagcctagacatgcagtggaggcttgccaagcaattgtagaaaggttggaccgtttgttcaacccaaggatagttactacaggcacaaaaatacacgagatcatgaaagattgcttaaggatcgctaggggtgtcatagcagaggacaatgtttatgtcaggtcgcgacgaaggcgatgcacggatcagccatag

SEQ ID NO: 30027 - DNA, 351 bp, Glycine max
  Peptide Sequence Number=SeqID_121712
atgggtgaagattcttggtccttggtgcacaaccaggtggggaaagaacttgacaaatggtcagatgactatatcaagctctttggtggcacagacagatttgaggaattaaggatgtccctacttgttgatgggttatccatggttactatggataagtggatggatataaccgagatgagatatgtcattgcatcaaggtataatgtaatccttgtatcattgtcgctacaacaaagcatgacgttctttcctcttagaagtcaaccaccaacagattcttctgtgcatcgcataatatgtattgatcatgtctatgacaatcattttgttcaagtagattcaagatag

SEQ ID NO: 30028 - DNA, 120 bp, Glycine max
  Peptide Sequence Number=SeqID_121713
atgtatcatctttcttatccaaataacatagctaaagatcgaaggaaagagatctggactggaaaattggactattgttacatccatgcctgtgtagaaattttggaatatcttggctag

SEQ ID NO: 30029 - DNA, 474 bp, Glycine max
  Peptide Sequence Number=SeqID_121714
atgtctgagcgtcaatctccggaaaacacgatatccaatccaattcctcgtcgccaacctccaccacgcattccactagttcaagcactctcagcaatctttggaggcgagggcggcgagagcggtggtgccgaagccttcgcagcacgtgagaaggaggtcttggaaggaggggagggagtgggagaggagggtgaggtcgtggtcggtgagggacatgcgtttgaggtggagtttgttgagggaggagtggtaagattgggagagtgcggtgacccagggggtgaagtgggccccccagttcaggggcatgaggtcgaagtcggcgaagcgtggcttgcccttgatggtcacggaccggacgcgggggaatcggccggtggcgcggcggggggacacggcgtagcagtttccgatgaagagctcggtgcgggtgagggcctcggcgcggtaccaggacttgcagaccagtga

SEQ ID NO: 30030 - DNA, 318 bp, Glycine max
  Peptide Sequence Number=SeqID_121715
atgccaccattggaggattgtagtgatgcggaacctgtaaatggagatgtgattgttactatacgtgctcttaacatgcagcctaaggtaggaggtgatgaggagcataagaatatttttcatacaggacgtcacatagaagacaaggaatttgttggtgtttttccaaaagaaatttcatatggattacctccttcaagaggtattgagcatcaaattgacttcattcctagtgcttcacttccaaacagtcaagtccagaagaagcaaaggagatttaaaggcaagttgatgagttcttgcaaaagggatttctaa

SEQ ID NO: 30031 - DNA, 2001 bp, Glycine max
  Peptide Sequence Number=SeqID_121716
atggtccgtgactgcaattttggccgcaacatcaaggtttttggggttatcgtgaacacaatcacaattatggcctcatcagatggtcacactggctgtgtcaatgcggtggcttggaattccaaaggttcgatactgatatccggatcagatgatttacggatcaatatttggagctattctggctggaaacttttacattcaattgacacaggacatactgcaaatatattctgtactaagtttataccagaaacttctgatgagcttgtagcctctggagctggagatgctggagtccggttatttaatttgtctcgcttaagtgggagtggatttagtgacaatgccatcattgctccatctgcacattaccaatgtcacactcgaagagtcaagaaattggctgttgaaaatggaaaccccaatgtagtatggagtgctagtgaagatgggaccctaaggcaacatgattttcgggaaggtacctcttgtcctccagctggatcttcgcaccaagagtgtcgaaatattcttcttgacttacgaagtggatctaaaaggtcacttgctgatcctcctaaacaagtccttgctttaaaatcttgtgatattagttcaactagaccacatttgcttcttgttggtgggagtgatgccttcgcacgcttatatgatagaaggatgctgccgcctcttagctcatgttggaaaagaatgtctccacctccttgtgttaattatttctgtccaatgcatctttctgatcatggacatccaagcttgcacttaactcatgttacattcagtcctgatggacacgaggttctcctcagctatagtggagagcacgtttacttgatgaatgtaaatcatgctggagtgaatgagatgcaatatacttcaggagataattcaaagctgatgacatactctccaacaattaatgggacagagatgcagccttgtgtatctaatgtcttcccaaatggatttcctattaaaaagaacatcgctgcaaagcttgacaagtgcaggaaactaataaaatatgctaagaaatcattggacaatgggacaccctattatggaattgatgcatgtaatgaggttttgaatggctatagccatattattgggcctgcactgaaacatgaatgcttgtgtactcgtgctgcactattggtcaagaggaagtggaaaaacgatgctcatatggttataagagactgctatgctgcaagggaaattgataattcctcttacaaagcactatactatatgtcagaagcattgtcacagaatgggagagtgaagagaattgaagtagaagcactagtgaatgatattgattctcattactgtcttgtagaacctgtcatcaaggctcataaacttcagtgtttcgtggcaagtcctcagatcccgatgcgctttctcacagaggcagactgtgaacctggaaatgaaaatccagcatacaccgattgggaacaacaagatcaaattctcttatcatggctccaatcgactcttttagtttcaatcctatctcgaattattggatgtgttcattcatataagctttgggagcagctccatgagtattttcaaaagcaaacatgtgtaaaagctaggattcttcgagcagaactcaaaactacaatgcttgagcagaaaacaatgcgcgagtttcttctgcgcatcaaatgcatagtcgatgcgcttggatctaagtttgaaccacttccgatcagagaagtaaaggcactgctgcttgcacatgaggcacgcatgaaaaagtttcaaaagcgcttcgctgattcaccatcaattaatgttgctcaaggcagtgattctgaccgcggcggtggctacagtcacgaaggcaatggctttggagtgttggaggtcatcgtggtggcgacagagccaaacatgtctctcacgttgatggaaccagtgtttcaaagcaattcatcaaacaccttcggttcataa

SEQ ID NO: 30032 - DNA, 1219 bp, Glycine max
  Peptide Sequence Number=SeqID_121717
atgggaggagattgtggaacctgggtaccgcatctgcaatttggatggcaatcaccaaatttgaatccccttgacatggggaagccagttggtatttctgcagctatgaaccctggctttaatatggtctctagcaatgtgacagtgcctgctttcgtgtcctctgcactgcctcatttgcagttagggcattcctatgaacccagtggttggtcttattgtttgcccccctttcgacaaggattttcccctgctctgaacttcaatgctgagggaaaaacccctgctgaccatgtgaaaacttttggggacaaaattggtccctatggtgaatccagctcccatcagaaacaatttcttgttattgaccagacgggtggtcaaacgactattgtttatagctctatgtttgggaatcctgatgagtgccttgcttcttggcattcaaaactgcatggtgctaactatttgagggggaatgaaccttctttcagaagagatttgaatttgaatttgaacttgaaagtgaatatgactgagccaactttggctcataaagtggatgagaatctgaaaaccagcattgaaagtgagatgcatgaagacaccgaagaaattaatgcattgctttactcggacagctatggttattctacccaggatgaggatgatgatgatgaagttactagcacagggcactctccgagtacaatgaccactcatgataactgtgaagcctttaggggggaaaccgcagaagaagttgcgagcattgccgggaaaaccaagaagaggaagcaattggatggttattacgatgacatacaactcattgataccggcagctctcagaatctgaacaagtcttctgccacaggagatgatgcagaatcgagatgttctagtaataacaacgaaggatccttgtctggcaataagaagatgaaaaaggataagatacgcgacgttctgagtattctgcggagcataattcctggtgggaaggataaggatccggccatgcttctcgatgatgccatacattgcttgaaaaacttgaaacacaaggctcaagcgctcagacttgatgccttttctgttgatttgcttgttgttcatacttcatggagtctgcaaaataaacaaggacgtgccctttctgagttggattgtgtaaggaaagacggaagtgttcagtgtatcaagcgcaataaaggaa

SEQ ID NO: 30033 - DNA, 804 bp, Glycine max
  Peptide Sequence Number=SeqID_121718
atgttgcaatccccgaccagcagatcaagtgcacagtttgaagcagcaaataggcaaactttatccgtcctcgttgaacatcctttcacggtggtcggcgccaccattatcaccgacgacgcacgcgttctcgcagcatcgacggcatatgcgttctcaccgcacctacgactccaccaaccaccgccgctcaagatttcgtcattctcgaagcaacgccaatctgttgtcgccggtatcaacaggcaaggtgtcgctctcgaagccgaaaacatagtcgaagtagttggtgatgggggtgaaggttcccaaatctcattgaataatgtttatgaagttgtcatgatatcttcaaacatttggtgggcatctactgtgagtattatatttataataccaactcgacaaatttgcataccaggcacacaaggttcggggtgtgactttattttaaagggctgttgcaaggaggatcttattctgtgcggttttggaggttcttatgcagggtatttgctgttgtggatttggagttcaacaacttctccaaatcgtcccacgaatctgcacaaaaccctcgccgtactccttctcctctgcctccatctcgacacatctggtcgtatcgctgcaagcatcggtatttggttcacgttctttctctacctattgacccatcggccatcgcctcttttacccagatttgcaatttttggtgcaactgagatgcacaatgcgcgagggaagaccacaagattgttcacgttctctctcagtgcactttttgatccatcactcaattga

SEQ ID NO: 30034 - DNA, 267 bp, Glycine max
  Peptide Sequence Number=SeqID_121719
atggaaaggagttcctcgtcgtacacctcagaggcccgaagtcgcgtgatgtgtttgtgtaacgtagaggctccactggtaacatcgtggactgaggataatccagggatacatttttatggttatggtctatacatggttacaggtaggaaagggtgtaattattttgagtggcacgatccggttgcaaacagtcttcagaagaggatcattgtagcattgatgaagaaggttgatgaattgaacttgagggaaaagggaatgtga

SEQ ID NO: 30035 - DNA, 1047 bp, Glycine max
  Peptide Sequence Number=SeqID_121720
atggattccctcctcgctggcatcagcactggcacccccaccagcgagaccctcgaagactacaacgataacgaggatgatgggtatttcgccagtgtcaatggcaaaacatactatttcgccaggaccagcagtggcacagagggttccgtcagcaccaccagcgacacaacactgtgtcaactttccacgtctgcatggtgggtttcgctagaccaatgggcgaaacacactcatgcatggtgccgccagcccacttggcgaaacgaccatgcattcacgccttccctccatgcacgaatgcatgccatgcatcacatgggtgccgccagcctggctagcgaaacgcgtgcaatgggttccgccaaccccattggcgaaacggggcatgacgaggacaaaactaagggcaaggatcatgaagcacttgaagggcccatgaccagagacatacttaaaaaggcccaacacagtgatgaggacacaacaaagggcaaggatcatgaagcacttgaagggcccatgaccagagacagacttaaacaggcccaacacgacatagagacaagactgaaagcttctctcagggttcctgttgaaccaaattctgacctatcaaggttgattccttgtggcgtcaccgtgacttatcttccatctctggaagtggcatccctctccgccaacaatcctgtgtcaaacgttccgccccgtaagattcgtgtcagggcacctcctgcaccttctaaaacttttgaaaaagcttttgcatgcagctacgttgaagcaaaaaagctgggaaactggttagcacatccagactggcagcactcatgtgatgcatggcatgcatccatgcatggagggaagcgaaacccaccatgcaaacgtggaaagctgacacagtgctgtgtcgctggtggtgctggcggaaccctctgtgccgctgctggtctttgtgaaatagggtgttttgccattggtactggcgaaacacccttaaaaatagattcccccaagaatttctttacaaacagacccctttag

SEQ ID NO: 30036 - DNA, 510 bp, Glycine max
  Peptide Sequence Number=SeqID_121721
atggtttcaagggatcacattgtgcctgatcctcttacttacaatgttttgatcaacgagttttgccgcagagggaaacctgaccgtgctagaaatgtgatcgagtttatgaagagtaacagatgttatccaaatgtgtataattactcagctctggtggatggtttgtgtaaagttggtaagctggaagatgcaaaaggggttttggctgagatgaagggttctggtttgaaaccagatacggttacttacactagtttgatcaatttcttgtgtaggaatggccagattgagaagatagatttgaggaggctctggatatgcttgagaaactcccacaacaaggcggggatggttgatgatgctgctgtggcactattttacttggtggagatggggttccagccaggacttgagtcttgggaagttttaattggattaatctgcagagaaaggaagttgttgtatgtttttgagctgcttaatgaattagtgatcacaaattcttga

SEQ ID NO: 30037 - DNA, 2901 bp, Glycine max
  Peptide Sequence Number=SeqID_121722
atgcgtgttaccggggatctagggttttcgagcctggtccttgtggtggtttgtgttgtgctgccggtgattggcttcgtgattcgtcgtaaatggcaggtctcggaggccaggaaggatgagatcaagaggcttttggttttggccgcggaggaaactgccagggccgagaaagaggcgtcctatgagtacggcacagcggtttccgccgctccgagcaatctatgtgccgtgtgctattttcccgccaccgcgcgctgcgcgcagtgcaaatccgttcgctactgggttgaaaatgggaatgttgactctgatttccttttctggagtgcatctcttctggctcgttttagtataagtgtactagaagagctcttcgacaagtgcagtccattatgtacaggagatcagttggctgttcctctctacaaaccgctggctattgttaatggaaataaaaatcatgccgcaacttttgccagttcttttgagtgccaaactgttcattggcgccaaggtcacaagttagaatgccgtcctcccagcacaacttgctggagtgatgatgtagcaagtgatcatggccgcaagctagtagagcaaggctactctggaatccatgttgagaagtctgaaagtgaaggcaaagaatgtaaagtagcctctgaaaagtccccaatttctgatatctgcttttctccaaaagtttcacctggaaaggatggaaatattagagtcgagtcccttgcagagggaaatataacagattctaattctgaattgtccagtaactcattttctggattctcagcttccacgggttctaatgattcatctgatgattcctctgtctgtgagagcatcatctcaaatgagcatgatggatccaagggacatacttttgttgatcctacccttgacattcctgataacactagtgatgattgcatgggtgtaaccatgtctacttcaccaaagtttgctactttggttgattcagtagatggtttttctacaatgcataaattaaatcatactggacctggttttagtaaagaagagagtaagcttgcatcaaatggtaatccaggttcaagtatgtggaaggggaaaacaattgagccttctacagtggtttcaggattctgggataaagctcttgattcaagagggattaaagatgatactaagaatgacactcatccatcctgttctgatgaatccacaggcaaaaggactgtttctgaatcttcatttcacttttcattcagtaccatgtctcctttgcatgtaagagataccaagacaaatgattctgtatctgatgatgcttttccaaactgtattgggaatgatatggcaagttcaggatcagcatcatctgagaatgacaagatgaattcttcgaaggggaggaatttctcgttcatcaacagcaaagtttccagtgttaggagttatgttactccaagtggttctgaatctgatcaattggaatctaaagacagctctgggccacctttatcatctttctcccctcaatcctccagtgttgacaaaaattcagtttgtgcagatgctttgaacttccatatcttgcaatcaactggctctaaggtatccaatcatgttgtggacaaccgtggcagcaccttgaagtccactgaaattggattcctgacacgtgaacttgctgattctaatttagcttctggaactgaagaacattctcattccagtacaaaacaagggaataatgacattgaatctggcactcaaactgtcacttcttctcaggttgctagctgttctgcaaattctaagagtggcttgaaaacatctgttttgaaagttgttgatcagtttagaggatcaaatctgtcaaagcactttccattagctgttgggagtgatattgctggaagacataatgacaagagttttttcccttatgaattgtttgtcaagctttataactcgaacaaggtggagttatgcccatttggtcttataaattgtggaaacagttgttatgctaatgctgtacttcagtgcttagcatttactccacctctgactgcttatttgcttcaaggatcacattcgaaatcatgtgcaaataaaaaatggtgtttcacctgcgaatttgaaagattgatattgaagtcaaaggacacaaaatctgcggtgtctcctatgggcataatctcccatctacagaatattgggagtcagcttgctaatggaagagaagaagatgcacatgaatttcttaggcatgttattgacacaatgcaatctgtttgccttatggaagctggggttaatgcattgggctcattagaagaggacactactttaatgggtcaaacatttggaggttaccttctatcaaagataaaatgcatgagatgtggagggaagtctgagcgtcaggaaaggatgatggatctgactgttgagatagaaggcgagataacaaccctggtggaggcccttcgacgatttacaagcactgagactttagatggggaaaacaagtaccactgtgtcagatgtaaatcatatgagaaggccaagaagaagctgacagtttcagaggcaccgaatgttcttacagttgcattaaagagatttcagcgtttcttatttgttacatctgtattgcagtctgggaaatttgggaagctcaacaagcctattcaatttcctgaaatacttaacttggcacctttcatgagcgggactagtgataaatcacccatatacagattgtatggggtagttgttcacttagatatcatgaatgctgccttttcgggtcactatgtgtgctatgtgaagaatatccaaaacaagtggttcaaggttgatgacagtgtggtaagtccctcagtttag

SEQ ID NO: 30038 - DNA, 996 bp, Glycine max
  Peptide Sequence Number=SeqID_121723
atgctcatgccaccttcttccttcaccctcctcctcactctccttctattattccttacatatgaagcagagagcggagaaactccaccccctactcccccgccgccgttcagacccggcatagcggtgctggtgtgcgttttgacaaccataatctcccttacatcgctcctcctcctctacatcaaacactgcaacggcggcatcccagacggcggaggcggaaactcggctccgtggacggtggcgcccttctccggaaggaaaaactccggcattgaccggtccgtggtggaatcgttgccggtcttcagattcggagcgctgcgggggcaaaaggaaggactcgattgcgcggtgtgcctgaacaagttcgaggccgcggaggttctccggctgttgccgaaatgcaagcacgcgttccacgtggagtgcgtggacacgtggctggacgcgcattccacgtgtcctctctgccgctaccgcgtggatccggaggacattctcctggtggaggacgcaaagcctttccgccagagtcatcaacaacaacggaacaaggaagaggaacgcgtgcgtttgaatttggacctggagaagcaggagatagtggagtctcgacggaggcattcgtccgttggggtgggggaaggagaaacaacggaggagcagcagcagagtcggaggtggacgacgtcgtttagaaggtcattggatagcattagcgccacatcgagaaagaagaacgagagcaaaagacgggatgttgttgacgcaagagacggagagggcaagcgtggaacggaggttggagcaccggattattgtctccccgggccagggcccgggcccaggcccaggcccaggtccgtgtgggctcgagcagcggtggagcgacttgcaggcttcggacctgctgtatctgacgtcggagatgataatgatgagggacagttggaatggcagagggagtggtgtctgagatcaggggattga

SEQ ID NO: 30039 - DNA, 708 bp, Glycine max
  Peptide Sequence Number=SeqID_121724
atggcttgtgggagtaagagcgggaaaagtgagatcagtgaaggaggtgcaaatgattcagtggctgtgggagatgtgatatttgtcaagcttcgcggtagctcatggtggcctgtacaggttgttgatgaaaatagtgttaataagagtgttaaaccgagcaaacggaccaaacgattgccgggagacatccttgccttgtttccttctgcagctcatatgctgatcctattaaatgtcgtgatgagtttaagaggctttcagatacttgagcgtaatgatggttctctcaagaaagtacttctacagactcttgaacagggtctttctgagcatctcactaagaaggtagaggatattgttgttattgagagagatgaatggaaacaggactttgaatctattagaattcaagccttgacaagtcttaatttccccaactgtaaaggggaatcatggagaagatgtgtggctgtggaaggggtgatagaggtaaccttcactacacttgttgttaagcaagatgggcacactcaagacaactactactctttgcatgggtttccatataaaattgctaaggtttctcaatctccaaatccggctattgagcagaagattaagtctgagggaaatcaccttagtttgttctcagccaatgagtacaaggagtatcttcagcttaaggaagcctatagcctatactaa

SEQ ID NO: 30040 - DNA, 252 bp, Glycine max
  Peptide Sequence Number=SeqID_121725
atggaaaaaagttcatctcctggaagcaaaacaaacggagggtggctttcatgttgggggcgtctcaagttgaagcttccatgggcgaagagaacaagcacttataaatccattggtggttttaaatatgaccctttaagctatgctcaaaactttgacgagggatgggtagaggatgatgaagaatctttacatcgcgggttctctgctagatatgcagcaccctcctcacataaattgttcaagcaatga

SEQ ID NO: 30041 - DNA, 1681 bp, Glycine max
  Peptide Sequence Number=SeqID_121726
atggcctccatcgagatggagagtgcaaaagaagatgacatttcgccgatcgaggaggttcggctggtggtgtcgaacgaagacgatcccaggcagccggtgtggacgttccgcatgtggttcctgggaatcgtggcggtgatacttctctccttcctcaacactttcttcggctacaggaagcagccactcttggtcaccatgatttcggttcaggtggccacgcttcccattggccgcttcatggccagggttctcccgccaaccaagtttcggatccgagggagggacttctcgctcaaccctggtcccttcaacatcaaggagcacgtcctcatttccatattcgccaacgccggcgccgcgtttgggaatggcgccgcttatgccgtcgggattgtcgatataatccgcgccttctacggccggaagattaccttcctggccggttggctccttgttctcaccacgcaggtgttggggtatggatgggcggggataatgaagaagtacgtggtggagcccgcagagatgtggtggccctccactctagtgcaggtctctttgttcagaaactacgctaagtccagaactcttgctgcctcgacttcgactcgtccatacaccagttcgaattgcccaatggctcgaagtcctctttcttgtcttagctttgtacttccacagcagattggatccggcgaaaagggacttggtttgggttccttttcccttgactggaccaccgttgctgcattccttggcaacccacttgtttctcctttctttgcaacagcaaacgtgttggtgggctacatcttattgatctacctcatcatacctgtctcatattggggacttaatatctacaatgccaagaacttcccgatatactcttctagtctattcgttgccaatggcacggaatacaatgtgaaggccattgtaaatgaaaagtttgagatagatatgctggcatacgagaaacaaggtcgagtcaacttgagtgcgttctttgctattagttatggcattggttttgctgccattgcctcttccctcactcatgtggccatattcaatgggagggagatatatgaacagttccgatcttcacgatctaaaaaagaagacattcacgcaagattgatgaagaagtacaagcgaatacctagttggtggtttcatgtgacgcttttggtttcttttgcacttgcacttttactgtgcattgtcatgaaagatcagatacaaatgccatggtggggtctcatctttgcatccgggattgcacttacttttactcttcccgttagcatcataacggccaccactaatcagactccaggtttgaatatcattactgagtacatcatgggtgtgattttacctggcaaaccaatagcaaacgtttgcttcaagacatatgggtacataagtatgtcacaggctgtttcctttctatctgatttcaagctaggacattacatgaagattccgccacggtccatgttcattgttcaggttgtagggacgctgatagcaggaaccatggacgttggtgtcgcatggtggttgctgggttccgttaagaacatatgcaaccaagatttactgcccgcagacagtccatggacttgcccgggtgacaaagttttctttgatgcatctgtgatctggg

SEQ ID NO: 30042 - DNA, 210 bp, Glycine max
  Peptide Sequence Number=SeqID_121727
atggtggtgggtggttggaacagtggtgtttggcttgacggtagtattgggtggaggtgggacttgcttgggagaggcaggggtatttgtgtctgttcaggtctttttggaggtacaggaagcaaaaaggaagaatcacagggaagtgatgagttggaaaaaagaaaaaactggggaagaatgtatagtcatctaggtctaggggtttga

SEQ ID NO: 30043 - DNA, 327 bp, Glycine max
  Peptide Sequence Number=SeqID_121728
atgagggctgagggttctgtggaaggagcattgcaagttaaattgcaaactaaccaaggagaggaaaacaagtggaagaaatacaagaagaaaaatttcaacacccaagaagcaacagctaacactagcaacaataatgaagacaacaaaggatttcctctttgcaagcattgtggcagaatggatcatcttcctttcaaatgctggagaagacctgatggtatcaaaggcaatggcgatcttatcactgttgaaggaaaacgaactatagccattgaaagttgtgtagattcatcaaaacttgctaagtgtgggacaattgattga

SEQ ID NO: 30044 - DNA, 480 bp, Glycine max
  Peptide Sequence Number=SeqID_121729
atgacacacaggttccccccttcctgttggttttggtccaatggcacgagctaccccaagaagaaacgacatgggaagcctaggaaacactgcgcgcaaatttccaccttgaggacaaggtgtctttgccagacgcgggtattgatgcaaatcatcaacgcgaccacgaaggagcacccattggccaagcttctggaaagattacgagagccactaagcgagcatgatcgtgtgattccgttagtaattagtgcgctaatggatattgggttcatgcacgtaatgattatgcctgcattttggagaagatgggataaccttttcgatttatcatccgcattaccacaccatgctaaagaacacttcttgcaaaactcacatggtctacaagaatacactttgatcaagatcgtctatggcataattgcatgtcctccacttggtcatggctcaaagggtataaaaaggatttctcggtga

SEQ ID NO: 30045 - DNA, 357 bp, Glycine max
  Peptide Sequence Number=SeqID_121730
atgaaggttgattttggggcttataggagaaaattaagcgacggtgttgttgaatccgtggaatttagggatgagtttggttctactgagagagagaggaataaggttactcttgtgaaggaaatgggagttgagagagttttgaagaggttgaactgtttgctgcggatgtttgatcgtgccttgggttgtaggcccaatggtgctgctaagaacaataacttggtgctggttgcgctttgccaggttgtgagggatagttttaagctttatgcaaagtccaaagacttgccacatgagtttgcttacatagacaaagacttgtcacatagacatatgactaatagtggaaattga

SEQ ID NO: 30046 - DNA, 828 bp, Glycine max
  Peptide Sequence Number=SeqID_121731
atggcatcggggaagaatctagcatggcctctattatgtcatcatgagtcgtcacaagggctggttaaggaatgtctgttggttgttgtattcgacgatagacttgaaagggttgcgcagccggtggctctctgcgtggaatatcctgatggacatcaaagatggcatgcgattaatgaggtagcaagctgtgagaacatcaccccaaaaatgcaagggaacattgccatagaggagaagagtctgggttgtttcaataaggacagactcgatagtgagggatggaagagggtgtttgagacccattggcagagtcaagtacctaaggacccaaggaagattaaggagatacaagcaatagatttaccggttggattgagtagtaggctaagtggaatcatttggagatgtctgagctacattggtaagcgtccaaacttattgctctgggaaacaagagcagatgaatcacctatggtagattcaggaacgtcaactgtgggctctaacgaaatccgaagtaatgtagcagatgctgattgcatcgttggtgccatagttcttgagttccgtcttagcctcggtggcgatagaggcagtgggggggggccaacatgggcccgtcaaatcgctaaggagcttggacggtcatcaagtctttgcacatgttgtataaccgttgagcatcattcgtgtagagagcacgtgcctcactccaaaccaattcacaacctaggatatgtattcagtggaagtagtgagatgggatttgtggccaagcccactaatgcacaaagtgatgttggatgcccaagtagagtagtttga

SEQ ID NO: 30047 - DNA, 183 bp, Glycine max
  Peptide Sequence Number=SeqID_121732
atgtcaccctgcaagttcgggtccgccagcgtttgtgcacgcgacttgcaccaaagattccgggataaggatgaagccgtgatggaggtagcgttgcagcaacaacggatctgcagaggcggcagatctgtaatgagcacaatgagcttaagagtttatactcaagatgcatctatcacctag

SEQ ID NO: 30048 - DNA, 1767 bp, Glycine max
  Peptide Sequence Number=SeqID_121733
atggaagaaggttctttcgtagttataaattacaacagcggaagaactttcttccctgaattcttgcggaagaacttcttccgtgccatctcgcggaagaacttcttccgcaggaatccacagaagaagggttctcctgaatccgcaatggccgtttcaaccactttctccggtgccaaattggaggctctattgctcaaatgttcttcctcctcttcctcaccaccgccttcaaggtcatcattcaccacttttcccggccaaaacagaagaaccctcattcagagaggggttattcgctgcgacgctcagccctctgatgcatcatctgttgctccaaataatgccaccgctctctccgctcttgagcagctcaagacttctgcagctgatagatatacaaaggaaagaagcagcattatcgccattgggctcagtgtgcacactgcacctgtggaaatgcgtgaaaaacttgccattccagaagcagaatggcctagagctattgcagagctgtgtagtctgaatcatattgaagaagcagctgttctgagtacctgcaatcgaatggagatatatgttcttgccctgtcccaacatcgtggtgtcaaagaagtcatggaatggatgtcaaaaacaagttctgtccctgtttcagagcttagccagcaccggtttttactttacaacaatgatgccacacagcatctttttgaagtatcagcaggtcttgactctcttgttttgggggaaggtcaaatcctttctcaggttaagcaagttgttaaagttggacaaggagttaacggctttgggagaaatatcagtgggctattcaagcatgcaattactgtcgggaaaagggttagaactgagactaatattgcttctggggcagtttctgtgagctcagctgccgttgagttggcctatatgaagttacctgaagcctcacacgataatgccaggatgttggttattggtgctggcaagatgggaaagcttgtgatcaaacatttggtggcaaaaggttgcaaaaagatggtggttgtcaatagaactgaggagagagttgctgcaatacgtgaagaactgaaggatattgagattatctacaaacccctttcagaaatgctcacctgtgctggcgaagcagatttagttttcaccagtactgcatcagaaaacccattattcttgaaagaacatgtcaaggaccttcctcctgcaagtcaagaagttggaggccgtcgctttttcattgatatctctgttccccggaatgtgggttcatgtgtctcagaccttgagtctgtgcgagtttacaatgttgacgaccttaaagaggttgtggctgccaataaagaggatcgcctaagaaaagcaatggaagcacaggcaatcattgctgaagaatctaagcaattcgaagcttggagggactcactggaaactgttcctactattaagaaattgagggcttatgctgaaagaatcaggcttgctgagcttgagaagtgcttaggtaagatgggtgatgatataccaaagaaaacgcggagagctgtggatgaccttagtcggggtatagtgaataagttgcttcatggtccaatgcaacatttaaggtgtgatgggaacgacagccggactcttagtgagacactggagaacatgaatgctttgaataggatgttcaaccttgagacagaaatatctgttttggaggagaagattcgagcaaaggtcgaacaaaaccagaaatga

SEQ ID NO: 30049 - DNA, 1530 bp, Glycine max
  Peptide Sequence Number=SeqID_121734
atgcccagaggaatcggtcagaatgagattgtgaacaagttagagagggagacagaaggggcacggaatttggaattcaaacacaatggcgaatcacgaaacccaacaacaacaacaacaacatcaacgcccccgccaacaccgccgggttccgctgaggatgctgctgcgggtagcgtcggttgccggtggcattcagttcgggtgggccctgcagctatctcttctcacgccgtacgtgcagcagctcgggatcccgcacgtgtgggccagcatcatatggctctgtgggccgctctctgggctcctggtccagcccctgcattgtcgatcgtcgccgctgttctcatcatcggtcactccgctgacatcgggtggtggttcggcgacacccttgagcatcgcccctgggctgtcggagttttcgttttcgggttttggattttggacgtggctaacaacgtcactcagggcccttgtagagctttgcttggtgatctcactggcaaggatcaaagaaggacacgtgttgcaaatgcttattactccctgtttatggctattggtaatattcttggatatgcaactggatcatacagtggttggtacaaggtttttgctttcacacttacccctgcatgcaatattagttgtgcaaatctcaagtctgctttctttctcgacattattttcattgctgtcaccacatatataagcattgtggcagctaaagaagtgcctctaagttcaagtggagcacaccctgttgaagaagcagcagcaggggaatcaggtactgcaggagaagctttcctgtgggagctatttgggacattcagatatttttcgacccctgtatggacaatactgactgttactgctctaacatggattgggtggtttccatttctcctatttgatactgattggatgggccgagagatttatggtggtgagccaaatgaaggccctaattatgatactggagttagaatgggggcacttggcttactgcttaattcagttgttcttggagtaacgtcagtactcttggagaggctatgcaggaagcggggacctgggtttctgtggggaatttcaaatatcctaatggctgtctgctttatttcaatgcttgttgtaacctatgtggcaaataacattggctatgtaggcaaagatctaccaccaactggcattgtgatagcttcattgataatctttaccattcttggatttccacttgcaatcacttacagcgttccatatgccttgatttccacacacattcagtcattggggcttggccaaggattgtcaatgggagtcctaaatcttgcaattgtgttcccacagatggtggtttccctgggaagtggaccatgggatcagctatttggtgggggaaactctccagcctttggtgtggcagctgttgcagcccttgccagtggactcatagctgtcttgtttattccccgtcctggtggtcaaaagcctcgaagccctaggaatgatgaaaatgaatga

SEQ ID NO: 30050 - DNA, 543 bp, Glycine max
  Peptide Sequence Number=SeqID_121735
atggcgggtcatagagctaaggcacccacgactccatccagctctctttttacagctatatcaccgctctttcttctctgcaccagagttgtcaacgcctccagttccaagttaggttggtgtcatggagttgggtcgccactggccactaagtttaagcctggtgtcaggcttcggagaatttgggttgtcgggtttggtggggaggagagaatggcagtggagaaccttcttccatgtgatctcgcgaaagaacttcttctgcatgaatccacggaagaaggttcttccgctgttgttattttcaattgtggaagaaccttcttctgcgagatgacacggaagaaggttctttcgcagttaatgttacaattgtggaagaaccttcttccgtgcgatctcgcgaaagaagttctttcgcaagaatttacagaagaaagttcttccgttgttgtaatttacaactacgaaagaaccttcttccgtggcttcctacagaataagttcttccgtgagatggcatggaagaaggttcttccgtag

SEQ ID NO: 30051 - DNA, 384 bp, Glycine max
  Peptide Sequence Number=SeqID_121736
atgtgggtgtcgagggagcggtttctgggagatttcaggcgggaggagaaagagaagagcgatttcagtatgattagcagctatgatacaagtgggttgcttcatgaagcattggaccttttgagagatacgcatgttatgagattcaagcctagtgaaattggaatgataagcatcacacatgtcttggcagaacttgctgagagagtgattggggaaagccatgcttgcttatgtaatcacaaatggcaagctagtatcatttgttggactgctatgaggaaagcctatattcattgcaataatttgaatgaaggctctggtaatcgattaccaggaagtgtaatcgattaccagaagacagggttgagaaatagctgttga

SEQ ID NO: 30052 - DNA, 598 bp, Glycine max
  Peptide Sequence Number=SeqID_121737
ctacgcatggggagttgttgcactaattgatatgtatgagaatttgaatgatgggtcaaagagaagcgctagccaaattgtaggatatatcacacttttacagtgttcgatctacgagcattttcctactgtcgtttcttctattgttgttgaaggttatcatgagagaaaaccatgtgcttgctattggaagtctggaaagatattaccagtgtcagcgtatcataagcgattggatacattggcgtctcatgttaccattcttccacaccctattgctcaatctttatttatagaggatattgatgatagatggattcagttttctaaataccttacactagtgggtcagatttgtgttgctcttggacaacatccactcgtgatgcacgatgatacatttgttgaaccttatcatcctcagcaattggtcgccacaacagctatgccagaaccacctacagctgcacctactgatgtagacatgcatcgacatacactggatggccaagggtgtgactgcgcaagggaatgtatacgttcgatcgagatgaaggcggcgtacgccagacacatgaagattgttaggatttttaag

SEQ ID NO: 30053 - DNA, 1002 bp, Glycine max
  Peptide Sequence Number=SeqID_121738
ggtgtttggctagaagaggaagaagatattaagcacatggtgagtgagtattatcatgatctctttatagataatggagtggagaagtatgctataactgaattcacctttcttgcagtccttcttaaagagaaaatatctttgaatggtcctttcaaaattgaagaaattaaaaatgccctttttgatatgagtttgtggaaggcctcgggtttggatgggcttcctgcatctatggttgtgcccgaggttgagagggagaaattgaaggagaaggatgagaaggctggtgcgattcaacaaattgatgacgtgtttggacttgtagacagtgaagtcagtgatttctgtgcagtcaaggtggttaagattaagacagtggtggggagaatgggtggcacggtggctggtgctagtgttgcggtggctgtggctgtaaggcacggcgtgcgacgcgaagggagcgacagagaagaaggaaccctcagaggagaaataatttgtgttgtgcattgttgtgttgttgtggtggctcttatgcctaggttgatttttccaaatcagaccagatttattcccactggatctacttatgatcgtatgcagtggcctttcatcaagaatgtcatggaagaagttgtccttcctgcagaccttattaagggtctccttcaaggaggccttctatctccttatttgctcattttgggaatggacaagctttttcacttaattctcaaagaagtgaataatggggaggagaatttgtggactcaagttttgaaaggcaagaatgggagatcttccaattttgaagatgcacttgtgctaaaacctttagattctactctcaggaaggttgtggccagttactatcctttcttgaaggagaatgaaatcatatcctccttgagttacaacaagctcccagatttagtgaatgatggtggagattggaatattgagcttctgagggacatcctcccaagggaaattgtgtag

SEQ ID NO: 30054 - DNA, 1614 bp, Glycine max
  Peptide Sequence Number=SeqID_121739
atggccgaattatctcttcctcaggattcttactttctcggattcgacagttccacccagtcgttaaaggccactgtgttggactccaacctcaacatcgtagcctcagagcttgttcatttcgattccgacttgccccattacaaaaccaaagatggggtgcacagagacccttctggcaatggcagaatcgtttcacccactttgatgtgggtggaagctcttgacctaattcttcaaaagctttcaaaatcaaattttgattttgccaaggttgctgctgtttctggcagtggccaacagcatggtagtgtgtattggaagagtggcagttctcagatattgtcatcattggatcctaagaagccattgttggatcagcttgaaaatgctttttccattaaggaatccccaatttggatggacagtagcaccactgctgagtgtagggctatagagaaggcttttgggggagccttggagttggctcgtgtcacgggatcacgtgcatatgagaggtttactggtccccagatcaagaagatatttgatactcagccagaaatttatgacggcactgaaaggatatcgcttgttagctccttcatggcgtctctttgcgttggcgcttatgcttccattgatcattctgatggtggaggcatgaatttaatggatttaaaggaaaaggcctggtctaaagtagcacttgaggcaactgcccctggtttggagtcaaaacttggagagttagcccctgcctatgctgttgctggaaatattgctccatattttgtagagaggtataactttaacaaggattgcttagttgttcaatggtcaggagacaatccgaatagtgtggcaggtttgaccctaaatattccaggagatctcgccatcagccttggcactagtgatactgtatttatgatcactaaagatcctaatccaggattagagggacatgtcttccccaatccagttgatgcagaaggttacatggtaatgctggtatacaaaaatggatcccttacccgagaaggtggaaagttaggtttctactacaaggagcatgaaattctacctcctcttccagttggtttccaccgctatatcatagaaaatttctcagacacaccagatggactgaaggaacaggaaatggaggagtttgatcctccatctgaggttaggaatcaagtggtccgggcattaattgagggtcaatttctctcaatgcgggctcatgctgaaagatttggaatgccttctcccccaaagagaattatagctactggtggagcatcagcgaatcattgcatccttagtgcaatagcttcaatttttggctgtgatgtctatacagttcaaagacctgattcagcttcacttggagctgcattgagagctgctcatggctggctctgcaacaagaagggcgggtttttaccgatatctgatatgtacgtggacaaattggagaaaacgtccctgagctgcaaactttcagtgagtgctggagatcatgaattggtttccaagtatgccaccctcatgaaaaagagaattgaaatagagaatcggctcgttcaaaagcttggacgcttttga

SEQ ID NO: 30055 - DNA, 567 bp, Glycine max
  Peptide Sequence Number=SeqID_121740
atgggtcctcctgctgatgaaaatattgaaacaaagaaagtggatctcagaagtatgccatcttcttcatttggtcaggcaccacaagcccacaaagtggcaattcctccgagacagaacctcttcaaggaattccaagacactataaaagaaacgttcttttctgatgatcctctaagacccttcaaagatcaacctagatcaaggaagatcaggctcggtattgaagccatattcccaatacttagttgggggagaagttacaaccttaaaaaatttagaggagatttaatatctggtctcactattgcaagtctttgcattcctcaggatattggatacgctaagcttgcacatttggctccacagtatggactgtactccagttttgttccaccactgatttatgctgtcatgggtagctctcgtgatattgctataggaccagtggcagtggtttctctcttgttggggactttacttagtaatgagattgatcctaatacacatccagcagaatatcagcgacttgcttttacagccactttttttgctgggattacttaa

SEQ ID NO: 30056 - DNA, 747 bp, Glycine max
  Peptide Sequence Number=SeqID_121741
atggcaggctgccaaactgcagtctctaatattgtgatgtcagtggttgtgttcttaaccctgaaattcatcactcctcttttctactacactccaaatgccattctttctgcaatcatcatttctgctgtcatcagtcttgtagactatgaggcagcaattttgatctggaagatagataaatttgattttgttgcttgcatgggtgcattctttggggttgcttttgtctcggttgagaaaggacttctaattgctgtctctatttcctatgccaagatcctattacaagtcacaaggccccgaactgcaattctggggaagattcctaggactactgtgtatagaaacattcaacaatatccagaagctagtaagattccaggtgtactgattgtaagagtcgattctgcaatatatttttccaactccaattatgtaaaagaaaggatattaagatggctgatggatgaagaaaaaggagactaccgcacaaaaatccagtttttgatagttgaaatgtcacccgttacggacatagacacaagtggcatccaagcctttgaagagttacacagaagtcttgagaagaagggtgttgagcttgttttggcaaatcctgggccagcagtgacagacaagctttacgcatccagttttgcaaacacgattggcgaggacaagatcttcctcactgttgcacaggctgttgcatattgttctccaaaggtggttgaggacccatga

SEQ ID NO: 30057 - DNA, 1224 bp, Glycine max
  Peptide Sequence Number=SeqID_121742
aaaacctttggttctgcagctcctgatctggatcctagcagtgtatatggtgtatggaggatcgatgatacagataatagtttctcaactcagtcttttcggataaaatacgccaggcaggatgttcatctgtatatgatgattgtgttcaacttatcccgtagtgaatttgtggatttagctacaactgctgttattttaaaatttgaacttatatatgctcctgcaactgaggatggtgtcaacatgcaagcttctctggatgattcctctgctgctatccatgaattccgaattcctcctaaagctcttataggattgcattcttattgtcctgtccattttgatgctttacatgcagtgcttgttgatggctttggtggagttgcttttctagatacgggaaatgtctcacttgttaaagcattattaacttctcgtgatatattggttgaagaactacaaaaaatcagcaaagcaatcaatgaagctttagatatttcagagtttgtgtcaataatgagtaatatgaagttattaaattctgtgctgcaagtgaatcaatttgcaatagatgttgaagttgtaggacaaggcaagccacaaaatggtcttaagggaggaaatgaagctctggattttctggatgttgaaaagctccattccctgtctcagaatgaactggataacaaatcaaggattttaggatttttacgtgatgcatgggtgaaggaccggaaagctgaatggtcaatatggatgctatattctaaggtagagatgcctcatcattacataaacagtaagagtgaagagtcttcccatcgtggtgtacacagacgagtttccagtttgtggaagttacctgatgatcctctccagactgcggctacacgtgctgaacttcatcgaaggagcattgaacaaatgcggattaacaaccgctcagttcaagacatgcagatatttggagatctcttgcatactccaattgtgattgttgaacatgtgatgaatgtaccccgtcgctgtccgagtgcaaattcattactgagacatattgggagtatagattcagatggcttaccaattggcctcagctctgacactataggcaagaaatttgcaacacaaagtaatgctcgtgtgttgaagattgttgtctttgtacatggatttcaggcatgtcttgtggattttattgcaaaacccttttctatttga

SEQ ID NO: 30058 - DNA, 627 bp, Glycine max
  Peptide Sequence Number=SeqID_121743
atggaactgagcggaagagcctttggcgtcttttcctatcctaatccatccattgtggaacactgtggttttggctaccgttccggtgagatccaagggaacggaaactctgccgaggagtctcccggagctgacgccgcaggtggagccgcgacggccggtgtagatagagattttgaggcagagcttggcggagaagatggatttgccggcgagcttgtcgagatcggacttgctgaggtggaaagtagcagcgataggatggaccagggagtcagggaagagggaatccggaggaatgaagggaacgacggcggattgaagaggaaaattcttgagctggattttgcagaaacagggagaagaagaaggatgaacaacggagcgcgcgggtttggaagcgacgggaattttgagggcgaggttgcgaacggtgagtctggagaaagggcaaggatccatggcgggagggaaagaaggcagttcctgaaggttatggagagggatgagagagcagagaaggaagatgtggtgggtttcaagcatgttgatggcgccaatgggaattggattgaggatagtgtgttcgtcgacggcgcatcacatgaagacgcaggcatgggatag

SEQ ID NO: 30059 - DNA, 150 bp, Glycine max
  Peptide Sequence Number=SeqID_121744
atggtgcaccagccatactgctgggtgcacctagcaacacccgttcaattccgagggaaggggtgcaaatcgccagtgtctttggcgagtccgtcgttgctttgggaaaccgctagtttgactagcgggttgggttcagacctagcttag

SEQ ID NO: 30060 - DNA, 513 bp, Glycine max
  Peptide Sequence Number=SeqID_121745
atgtgggttctttaccaactcagacagtactcactagacgaggaaaggtcggcaaaaagatttgaaaatctaaaggctggtcttgaaaccaaaaaacttggaagaaaagggttgcagccatggacaaattataaaccatacgagttgatggatgatacagaagaaaacgaacatgaaagggatgatgttgttgttatacatgatggggataaggttgaagaggaaaaatctgaggaagtagaagatcttattgatgaacaagacaaggagaaggaggagcaaaatgaagatgaagagggtgaagacatgggaaaacagatggaaggtcttatgagcttattagaagatgaaggtgaagaagacacacatgcaacaactgagaagcataacaaagagaaggtgcatccagggtttaagaaaaataaaagaggaagaggtaggaaatttaaaaagggttggaacagaaaagcagcagaagaaaatcttggagccaagcaattcaagtcatcataa

SEQ ID NO: 30061 - DNA, 2232 bp, Glycine max
  Peptide Sequence Number=SeqID_121746
atggcggtttccgacagtcccagcggcggctccacgccacctcaacaggaacaacaacccaacaagtacgctttcaccaagcccctctctctcgcgggtcccaccgacgccgatctccagcgtaacaacgaattggacaagttcttgctcgattcggggctctacgagagcaatgaagaatccgcggcgaggaaagaggttcttcaccgccttgatcagattgtgaaaaactgggtgaagcagttgacgcgccaacgtggctacacagatcagatggttgaggatgcaaatgctgtcatttttacttttggctcttaccgactaggggttcatggacctggagttgacatagacactttgtgcattggtccttcttatgtgaaccgagaggaagatttttttgtcattttgcataacatcctggccgaaatggaagaggtttctgaacttcaaccagttcctgatgcacatgttccagtaatgaaattcaaattccagggaatatctatagatttgctgtatgcaagtatatcacttttggttgtgccagaagacctagatatttcgcatggttcagtgctgtatgatgttgatgaaccaactgttcgaagtcttaatggctgccgtgtggcagatcaaattcttaaacttgttccaaatgttgagcacttccgaactgcattgagatgtttaaagttttgggctaaaaggcgtggtgtttattcaaatgttactggattccttggtggtgtaaattgggctattttagttgctcgaatttgccagctctaccctaatgcaatccccagtatgttggtttctcgattcttcagggtctatacacagtggcggtggccaaaccctgtaatgctatgctctatagaagagaatgaactgggattccctatatgggatcctcgtagaaacccccgagacagatttcacactatgccaataattactcccgcatacccttgcatgaattcaagctacaatgtttcggcaagcactcttcgtgttatgatggaacagttccgctatggcaataagatttgtgatgaaattgagcttaataaggcccagtggagcgcactttttcagccttatattttttttgaggcatacaaaaactatttacaagtggacataattgcatcagacgcggatgatttactagcatggaggggctgggtagaatctcggttgagactgcttaccctgaagatagaacgagatacaaatgggatgctgcagtgccatccttacccaaatgagtatgtagacacatccaagctgtgtgcacattctgcatttttcatgggcttgcaaagaaaagagggagtaagaggtcaagaggggcagcaatttgatatacgtggaacagttgatgaattcagacaagaaataaatatgtacatgtactggaagccagggatggatatttttgtttctcatgttcgtcgaaagcaactccctgcatttgtttttcctggtggttacaaacgcactcgaatgccaaggcatattagccatcaagctgaaaaaacaggtgatgatgccactaagtgctactctgggtctgggtctgggtcgtctgaaagatgcatcaagaggaaaagttgccctgaaatggtggataagaagccaggcaaaccagataagcgggcatctattagcccacaaaggttagaatgtgtttctcctgaaagttgtactagtaaatcaggtggtacaactcaaatgagtattgagtgtatcgaagtggttaggttagctggttcaacaaccaaggatgctaacgacaattgtgaagttaagtcatctgatgcactcccaggaagtggactaagcactgaggtagctgacatgcagattagtgaaccgggctttgttgacaccacacatgatatgttgaaatcaaggagtgttgaaattccaaatgagaatggagttctcaatggggacaaagctcaggatctagctttagattgcttggaaagtgcagaaactgaatctactaacagcttgtcaaactataaagagggagacaatgatacggatcagcgactagacaaagaatgtaatttcatcccaagggctgaatgttcagattatgacttttttggattaggaacgttgtggatggcagtgaaaaaactggaagtctgggagatagtgagtcagggatctttgcagggtgatgtttgtgtggctgatccagatcagttctga

SEQ ID NO: 30062 - DNA, 1758 bp, Glycine max
  Peptide Sequence Number=SeqID_121747
atgtcgagcacttcgttgaaggagatgaggaacggtggtgaggattatagcaatggtcatggtggtggtgtaagggacttgtatggagaggattgtgccacagaggaccagcttatcaccccatggactttctctgtggccagtttgctgagagatccacgctacaacaaaggactggcctttactgagggagagagagatgcccattacttgcgtggccttttgcctccagctgtcttcaatcaagaacttcaggaaaagaggttgatgcacaatcttcgccagtatgaggttcctctacataggtacatggccatgatggatcttcaggagaggaatgaaaggctgttttacaagcttctgatcgataatgttgaggaactgcttcctgttgtttacactccaactgttggagaagcatgccagaaatacggaagtatttttaggcgtcctcagggtctatatatcagtttgaaggagaaaggcaagatccttgaagtactgaaaaactggccagaaaagagtattcaagttattgttgtgactgatggtgagcgtatattaggacttggagatcttggttgccagggtatgggaattcctgttgggaaactttctctctatacggctttaggaggtgtccgcccttcatcttgcttgccaataaccattgatgttggcacaaacaatgagaagttgctgaatgatgagttttacattggacttaaacaaaagcgggcagctgggcaggaatatgcggagcttctagaggagttcatgcgcgcagttaagcagaattatggggagaaagttctcgtacagtttgaggattttgccaatcataatgcatttgatctgctggaaaaatacagctcatctcatcttgttttcaacgatgatatacagggtacagcatctgtggtattagcaggattgcttgcatccctgaaattagttggggggaccttagctgaccataccttcttattcctgggtgctggagaggctggaactggtatagctgagctgatagctcttgagatttcaaagcagactaaagctccagtggaaaagacccgcaagaagatatggctcgtggactcaaagggacttattgttagctctcgattggaatcacttcagcacttcaaaaagccttgggcccatgagcatgaacctgttaagactcttctagatgccgtcaaggcaatcaagccaaccgttttgattggatcatctggagcagggaagacatttaccaaggaggtggttgaaaccatggcatccctgaatgagaaaccactcattcttgctctctccaacccaacttcacaatctgagtgcacggctgaagaagcttatacatggagcaagggtaaagcaatctttgctagtggaagcccatttgatcctgttgaatatgaaggaaaagtttttgttcctggacaggccaacaatgcttacatatttcctggttttggcttgggtttgatcatttctggtgcaatccgcgtgcgtgatgagatgctcttggcagcctctgaagctttggctgcacaagtatcacaggagaactatgataaggggctgatttaccctccattctcaaacatcagaaagatatcagcccacattgctgctaaagtcgcaactaaggcatatgatctaggtctggcttctcatctgcctcgacctaaggatcttgtcaaatatgcagaaagttgcatgtacagcccaggctaccgtagctaccgttga

SEQ ID NO: 30063 - DNA, 1617 bp, Glycine max
  Peptide Sequence Number=SeqID_121748
atgccgtccaacgattccgattcgccgatgaagatcgtacatggcgacgctggttacatactcgaagacgttcctcacttcaccgactacattccaaatcttcctacgtatccgaatccgcttcgatccaatcctgcttactcggttgttaagcagtatttcgtgcacatggacgacactgttcctcagaaggttctatctgtttctacttatgctagcgacctcaattcagcattaacaaggtgtattggtgtttatacttttgtttggcctttcaataggttgttgttcacaaggatagtccaagaggtatactttaaatcggatgaagtgcatgcatgcattgtcacgtgtggtggactctgccctggcctcaacactgtcataagggaaattgtctgtggtctttcctacatgtacggtgttaacaaagtccttggcatagatgatttaggaaagaaagctgacattgctctgatgtgcttctctatccctgacttctttggtggttatagaggcttttattccaaaaacaccattactttaacacctaaggtggtcaatgacatccataagcgtgggggtacaattcttgggacatcccgaggggggcatgatacgggcaagatagttgacagcatccaggatcgaggaattaatcaggtttatattattggaggagatggaacacagagaggagcgactgtgatttacgaggaagttagacggcggggtctgaaagtagcaattgctggaattcctaaaaccatagacaatgacatcccggttattgacaaatcttttggttttgatactgcggttgaggaggctcaacgtgccattaatgcagctcatgttgaagctgaaagtattgagaatggtattggtgttgtaaagctaatggggcgttatagtggttttattgcaatgtatgccactcttgctagcagagacgtggactgttgcttgattccagagtcgcccttctaccttgaaggaaagggtggactttttgaatttattcagaaaaggctgaaagaaaatggacatatggtcatagtcatagctgagggagcaggacaagatcttcttacagaaagcatgcaagccatggatcagaaggatgcttctggaaacaaactacttcaagatgttggtttatggatatctcataagatcaaggctttgttgttgttgtatctgccagatccaacttacatgatccgggcaatccaaagcaatgcatcagataatgtctactgtacacttcttgctcagagtgcagtccatggtgcaatggcagggtatactggatttacagttggactggtcaacggcagacatacttatattccattcaatagaatcaatgagaggcagaacaaggttgtgattactgacagaatgtgggcaagactcctttcttcaaccaaccagcctagctttttgagccccaaagatttagaagaagccaagaaagcagaacaacctccgactgaattgttggaaggaaacaattgcaatgatgttggtgatgccgggaaagaagaacaacctcccaaagatgaacaagaatcaggaaatcacgcagacaatggtatcaagacagaaaattag

SEQ ID NO: 30064 - DNA, 2133 bp, Glycine max
  Peptide Sequence Number=SeqID_121749
atgcctgagctgcgttcccggccacacataagccgccttgtagacagcgcaaacgccaatccgaccactcagccagcctcgccgccggccgccggagcctgtcgaaggaagccagccgtcgccgccgctccgaccgggaggaatcgcaggctgaacaacgcgattgccgtcgccgccgatcaaatcctgaacgccgaagacgaaggtggtgccgttcgtggaaccagagcgaggaagctgaaacaagatcaaggagtgaaggagaatattaaaaataagaaggtttcagttagggttttggaagtggaaggcatggatgagtacgatagtggtagccgcagtgccgataaggctcccggagctgaagacgaaggcaccacacctcctattccagagaaggttcaggttggtggttccccattgtacagagttgagagaaaacttgggaaaggaggatttgggcaggtttatgttggtcggctgctcggagctgcgaattctagtgaacgaactggtgctggggctgttgaggtagccttaaaatttgagcatagaagcagcaaagggtgcaattatggacctccatatgagtggcaggtttacaatgcactaggtggtagtcatggtgttccgcaagctcattataagggacagcaaggtgactactatattatggtcatggatatacttggccctagtctgtgggacgtttggaataacaacaatcctcacatgatgtctactgaaatggttgcatgtattgcaatcgaggctatctccatattagagaagatgcattctagaggatatgtacacggtgatgtaaaacctgagaactttttgcttggactccctggaactcttgatgaaaagaagttgtttctggttgatcttggattagcaactcggtggcgtgatagttcgactggccttcatgttgactatgatcaacgtccagatgtttttaggggcacagttcgttatgctagcgtgcatgcccatcttggtagaacaggtagcaggagagatgacttggaatctcttgcttacactcttgtctttcttcttcgtggtcggctaccttggcaaggataccagggagaaaataaagggtttcttgtctgcaagaaaaagatggccacttctccagaaactttgtgttgcttttgtcctcaaccatttcgacaatttgttgaatatgtggtgaatttgaagtttgatgaagaaccaaattatgcaaaatatatatcccttttcgatggaattgtgggcccaaatccagatatcaggccaataaacactgaaggtgctcagaagcttatatgtcaggttggacataagagggggcgattgaccatagaagaagatgatgatgaacaaccaaataagaaggttcgaatgggaatgcctgctacacaatggattagtgtttacaatgctcgtcgaccaatgaagcaaaggtatcattataatgttgctgatgtgcggctggcccaacacattgataaaggaaatgaagatggtttatttatcagcagtgtggcttcttgttctaatctttgggcactcattatggatgctggcactggtttcaccgcacaagtttatgaactgtctccccacttccttcacaaggaatggattatggaacagtgggagaagaattattacattagtgccatagctggggttaataatggatcctcattggttgtaatgtctaaaggtacccagtacttacagcaatcctataaagtcagtgattcgtttccatttaaatggatcaacaaaaagtggagagaaggattttatgtcactgctatggccactgccggctctagatgggcaattgttatgtcccgtggggctggtttttcagaccaggttgtggaacttgatttcttgtatcccagtgaaggcattcatcgaaggtgggatagtggttatcgcatcacctcaactgctgcaacatgggaccaagctgcttttgttcttagtgtcccaagaagaaaaccagctgatgaaactcaggagacactccgcacatctgcttttcctggtactcatgtcaaggaaaaatgggctaagaacctctatatcgcatctatttgttatgggagaacagtgtcataa

SEQ ID NO: 30065 - DNA, 468 bp, Glycine max
  Peptide Sequence Number=SeqID_121750
atggccccaaaccagcactttactaatggttttcaaagcactacggtatctgatataaccttaattgaacgcaacaaagaagtggccatagaagaaacacatgatgagtacatattaccaaccgtgtccgaggtagagaatgcgaaatgcgagtgttgtggaatgttcgaggagtgcacccgcgagtacataaggcgcgtgcgtgaaatgttcttggggaggttaatatgcgggttgtgtggtgaagctgtgaatgtggagatggagaagaatggtggaaagcgagagaaagctctcaaagagcacatgagcgattgtgtgaggttcaataggcttggtaggtcatatcctgctctgtaccaagctgaagatgtcaaagagatcctgaagaagactcagaaaaaggccatgtccaacactcctgatgattctaagggtagtccaagcaagtctggggcacagggatga

SEQ ID NO: 30066 - DNA, 658 bp, Glycine max
  Peptide Sequence Number=SeqID_121751
atgacaaatgcctttagagtttggcaccactgtgctactgatgctatctggcatatgagaaacaagctggtttttcagcaggagtcttccttggctccttgtatgactatgaagtccagttttattattaaatggatcatgccatcggaggaagtgctcaaacttaactgtgatggtgatgtaactgatggaaggagagcctattgtggtggtgtcctgaaggatcactttggctcgttccttttagcttatgcatgtaatattgtttcatgctcggttattcagcccgagttatgggctgaaacttgttccagaaatagtgactataactaccgaatcagccaacgaatgctagataatgcgttagaacacagaccaagtggcaacaagctcaggggcaatctcccagtcaccgaatccacagaagattttggtcctgacataaatccagtaacatgtaaagccattcaatcagaaagtagcatattatttgtcaaggaaaaagctgtcaagatagggagcaactttgaaaaacatcagcatcaaatccatgagtctggaagcataccaggtccaacagcaagaacagtctttgatcctgccacactgttcccatcttctcaaaagataccgatcaatgcaaaagtaggcagtggtg

SEQ ID NO: 30067 - DNA, 393 bp, Glycine max
  Peptide Sequence Number=SeqID_121752
atggctgatatggactcaggagagcccgacgagacggccggaagcaaacgcgcgcgtttccggcaaggggagggcggcgcgtggtggtcacgcgccggcgtttggcgcgcacgaagatggcgcgtgacggcgcgtgacggcgcgtggggaagctcctggcccagcgatatcttgcatcaaagttatcctgaaatgtttaatgccttgggtatggctcaacagcataatggatggatatacggagatttcaaaaagaggatatcaaagggtaattattacatgaggacgaggagtaagagaacaaatttgagacaaagaacaactcaaaaattaacaataattgcatatcttatgagcacattgagatgcaatctttccggatttcatctttag

SEQ ID NO: 30068 - DNA, 570 bp, Glycine max
  Peptide Sequence Number=SeqID_121753
atggaatcccgtgcctccaattccaattctccataccattaccatcaccaccctcgtttcaaaccaagccaacccatctcagaccgaatagttcgcgccctccgccaccgcctgcgcctcctccaccgttccggctccaccttcttcatattaggcgccaccggaaacgtgtacacggaggaggacccctcgtccctgccagctccaacgcctcctcggaacacccacattgccggaggcggtggcgggggcaccctgaggcagaggtttcaccagcttttctttagtggagggtcaacagagacaaagatagagatggaggagggtgccacgtgcccggtttgccttgaggaaatggggaaggagcaaaacctggtggcatgtggaacatgccgtaacccaattcatgaagagtgcttgatgaagtggaagaggaccaagggaagaagtgctagctgtgttatttgtagagcaaggtggagggatagggtggagcaagatgagtatctgaacctgtctgcttatgttggcgaagatgatgtggaacaacctgatgtctgcacttgttaa

SEQ ID NO: 30069 - DNA, 399 bp, Glycine max
  Peptide Sequence Number=SeqID_121754
atggccacttcatataaaacattcctagtgaattgctccattcagaaaagaccctcctatgtctcggacaattctggtcactacaaccttccactcttccttgcctttaagccactcaagaaagttctgcttgaagtccccttgcaaattgatgaagttcacaaaaccatggcaaacactgcagctatattacttgacgcttttgtagattcattctttgaatttcttgaccaaccactgcttccatctcagagtaactttgctccagtggtggagttaggtgaagctatagtcgtgacaagcatccaaggacaaattccagatgattttcccgagggtgtctatattataaacggtgggattcctttgaaatttttattaacgcaacatcatttctag

SEQ ID NO: 30070 - DNA, 342 bp, Glycine max
  Peptide Sequence Number=SeqID_121755
atgaagaattacgtaccaacgctcttcggtggtgtagtagctagcgaggaatgcaacaagtacttgctgcagatcgagtgcagacttgccattaatggacgacttcgtgacagcaatcttgacttgtgtaacgtacaacgcaaagacaaaaaggaagaagcagaaaagccttattctgatgaagaagaagaagttgggtatatggacatctcaaacattttgatggctcgatccacggaagaaccattctatgactctcccgtagaagaagaaccactgatctcaacaagttcatcctccaaaccaaatgcaggaccttggtttactcttgacgatacttga

SEQ ID NO: 30071 - DNA, 378 bp, Glycine max
  Peptide Sequence Number=SeqID_121756
atggtcatgccagtggacaattcaaggaagctgagaaacattatcatactacattcaaagaggcattggcgaccaagcaagactgttaaggtgataacttctactcactccttcccgttgatattcatggtaaaacccctagctgaaacagccaaaaccattagggttttccctccaggacctttggacccagatctaccaagttcatcccaaagaccaaaggattgttatcctactgataggataatacttcagaatgttaaggacagtcaaattcgcatagagatttatgttccagatcctaagtttcaaaaagtagaagatttagttgatgacaattctgctttagaacaagacttggaagactacaatgcttaa

SEQ ID NO: 30072 - DNA, 1518 bp, Glycine max
  Peptide Sequence Number=SeqID_121757
atgaaagaatctaactccttttcaatttcagtgagcccaagcgcctctaactctatatgctcagttcatcagctggagaacatagatgagaatgctcctgcagattggcctgcatcatcctgtccccctcctgatactccaactgaatctatggagttccttgcgagatcatggagtctttcagccatggaactctccaaagcactgcacagcaccaacgttacaatctccaccggtatagagatgccactttcgtgcccttcaggccaccaatttgataccaagagttccactgcttccaaagctttatctaacgggtgtttccctccatttttgccaaaagacagtaatgaaaagaaggatttacttttactccaccaagcactcaatccagaattcctttccagtcaaaacttgctcagaaatgggctttacaggagcttgctaagaggtaggacaatgggtaggtggttgaaagatcaaaaggagaggaaaaagcaggaaattagaacccataatgctcatttacacgctgcagtatctgtggctggtgttgctgctgctattgctgcagttgcagcttcaacagcatcacctgaaatgccttatgcaaaccaaaagaaccctcccccagcttcttctgcaattgcatctgcagcagctttagtagcctcacactgcattgagattgcagaagatatgggagctgagcatgaccaaatattaacagtagtcaactctgccattaatgcaaaaaccaatggagatattatgactttaacagccggagcagccacagccttgcgaggagcggctactctaaaggcaaggctgcagaaggggcctggagctacttcaattcctctagttgaggaaaagtgtgatgaaaggaaagaagcaaacatcttgacagcactggattatgtctttagaggtggagaacttctcaaacgtacaagaaaaggtatgtttactaacatgtttgtgatagtggcttcattgaaatggaaaagaataaaagaagaatgccaaatgtttaaagcaacttacattcctaatgccagtaaccatgctattttaattgttaataccaggagctcttcactggaagcaagtgtctttcaatataaattcaaatttgcagatggctgcccaagtagcctctctgctcaattggtaaggctgaattatctgatcctccccagattccacaatggtgggagcctcgtgagaattgagaaatggaattatggcaataatgttgtagtcaaaatgaaaagcaagcatatggcaggaacattcacgaaaaagaagaaatatatagtcaccggagtttgcaatgatatcccagcttggcccggaagggagaaggaagacatcagtgaaaagagggcatattttggaataaaaacaacagacaggacaatagaatttgaatgtggaagtaaaggagacaaacagttctggcttgaggggatccagtatatgttgaattgccgtgtcaaagtaacattataa

SEQ ID NO: 30073 - DNA, 231 bp, Glycine max
  Peptide Sequence Number=SeqID_121758
atggatatctctacaaagaatcttgcgatcctctatgatgtcatggaaataagactttcaagtgttatgttgagttgtccaagcgaccaagcttgtaccagttgcaagcactcagactccaccacaaacgaggtgaaagtgttaccggtgggtggtggttgttgcggtgattggttcgttgtcggaggtacaccaggtacccgagttggtgttgttggtttccctgagtga

SEQ ID NO: 30074 - DNA, 1794 bp, Glycine max
  Peptide Sequence Number=SeqID_121759
atgtgtcgaacatgtagagaaagttgtttaatcctacagatatggtacacactgctgtgtgctcttcaattcactccagcacaacctcctcctgttgtgtctcttgcaatggaaggtctctcagaaatggaaagcgtgatagaagaaccccttttgagcaagcagaattccaatgccaagggtggcttcagaaccttacctttcatcatagcaaatgaggcctttgagagactggctagcctcgggcttatgcctaacatgatattgtacttgacaagagagtatggcatgcagacggcaggagccactaattttctcttactatggtctgctgcctcaaatttcacccctttcgttggtgctgtcctttcagactcctatgtgggtcgatattccatgattgcttttggatctattgcaagtctactggggatggttcttctatggttaacaactttgattcctttgtcaaagccactttgtaaccaatttaccaacagctgcaataactctcctacaacaattcaccttttgatcttgcattcttcttttgccctcatgtccattggagctggaggcataagatcatcctccttggcctttggtgttgatcagttgagtaagagggacaaaaatgcaggaatcaaagagagctacttcagctggtactatgctattgttgcaatgtcatcactgataggtttaactgttgttgtctatattcaagataacatggggtgggcagtggggtttggaattcccgttatcctaatgtttgtagcaactgcatcatttttcttagcttctccattttatgtaatggtggaggttaaaaggaacatgctaagtgggttagctcaagtccttgtagcctcttacaaaaatagacttctgcagttaccacaggagaccgagaatggtatctaccacctagaaaaggattccgatctcctaatgccaactgaaaaattaaggtttctgaacaaagcatgcttgattagaaattccttacaagatctaacaccagagggaagagctttgaatccatggaacctttgcacagtagaccaagtggaagaactgaaggcacttatcaagatagtcccaatttggtcaacaggaatcatgatgggtgtgaacatcagtcagggttccttactggtactagaggcgtcctccatggaccgccacattacgtcaaacttcgaaattccttcaggctcctttgtgacatttatgattgtatctctagtactttgggttataatctatgaccgaattttagtccctgtggcatcaaagataaaagggtccccagcatgcataggagcaaaacaaaaaatgggaattggtcttttaactggttgcatagcaattgcatccctagcagttgtagaggatattagacgcaaaattgctattgagaaaggctatgaagatcaaccacaagctgtagtgaacatgtctgctttgtggctcttaccgcgccaaatccttaatggattggctgaggccttaggtgtagtaggacagaatgagtttttcctcaccgagctacctcaatctatgtctagcctagcgtccactcttaatggccttggctcttctgtggcaaatttggttgcaagtttcattctcagtgttgttgacaatgtcactggaggtggaggacatgaaagctggctttcaagcaacataaacaaggtaaatcttatggtccttgtaagaatagaggaaagtagaactttagatcttatgatccttatggatacagatgatgttagtagtacctga

SEQ ID NO: 30075 - DNA, 162 bp, Glycine max
  Peptide Sequence Number=SeqID_121760
atggtggatggcatgcatgggaaaagtttgagttttggttgctgtgaactgtggtatattcgaattgaagtcaaaggtttgtttgatgggagtattgtggttgatagtgcagactgcagaatggatacagtaattgtttattcagttttggtatatgaatag

SEQ ID NO: 30076 - DNA, 633 bp, Glycine max
  Peptide Sequence Number=SeqID_121761
atgcaatcacaaggactcgcgctgcctcctgagcctaaggttggtccttcagctgctcgtgtcagcataaaggagagttgtgttgatccctcagggaacgatccagacccaggtgactcagacaaatgcgggttacacgtcaaagaaaatcctcctcacctggttgccctaggaagactttatgaggggtccacaaccgttcacaacattcatttactccatgatcaagtcaaggttggtgttgaggaggttagagatgcaaatgctcccattcttatacccactgaagagggagctgtgggatcggtgaaacttgcagatagggcggatcatgatgtcgatgatcacctatatctgataacattgactatcccacaactttttctgaagtcgttgcaggcatatgaccgagagagaagcatgcgagtagggaatgccaatgtgtatggattccttgagccacagtccatacaaagatctgggttagtcctatttttcaatacatttgcattagcattagtcgggaacatcaatattttaattgtacaatacgcaaccatgtttgtattcaatagtgctttgaaaggacttgacgatactccacaaagtaaatccaaggttgttgctaggtag

SEQ ID NO: 30077 - DNA, 306 bp, Glycine max
  Peptide Sequence Number=SeqID_121762
atggatattggaaggtacaaagagagcaaatggactgcagaatctacaacagactatgcacaagtcatgagagagttagaatatctgaaaaaggaattgttcaaccttaagtttcttgtggcttcattcatggatcacaaatccagtgtagagaaggaaattgaagcatcgaactcgaagatgttatcatgtttaacaactgaacaagatcttagaagggagattgaggagcctaatgaggagcaggtacttgcttcagtggccaagatcgaggctttgaaagaaatgacagatattgaggcttag

SEQ ID NO: 30078 - DNA, 430 bp, Glycine max
  Peptide Sequence Number=SeqID_121763
aaacaaagctaacaacaatgctctgggtcaaacacctacgtcactacataaaagtgctgagagcattttggggttttacaaagggatatcatttggaaattccaaccacgccaatgtgaccggggttcagtgtagaggaaacgtaaaacatgcaatgttggttccaaagtcagaaaagatgcaaagacaagctgaaactaacaagaaacaaggttcctctcggtgtggggtttcaatggagaacaacgacggtttgttgtggctaatggaggctgtgggtgatggagaaattgcttgggacaccaaatttcgagaagatccaatggttaacgaagactgggtagcgtttttactgaggcagcttcatgtagcttcctcaagaagcttcattaagaggcttcctcaagaagcttcctcgtggcttctttga

SEQ ID NO: 30079 - DNA, 670 bp, Glycine max
  Peptide Sequence Number=SeqID_121764
ggagcttccaaaagacaatctttggacttggaggcaattagtactcttgtgacagatgttgacatggagaaggagaccaagccaagtttttacttaaaacacatcttacctattatacttaaaaatcaagttattcactttgttggatttggtaatcgtctggcatttgatccaatagcatttgagctgcagaatacaagcagcttgtgctttgttggaccattggatccttaccttgttggtccatttgcaaaatcgatgaagggagtttgctcacgattggttgctttgaccaacttgtaccctaaattggtcagcaaagagaacttgctttcttcagctgaacttcaatcttttgctaattattcctctcagttagcagcactggacttcataggctgcactgcttcagatgcattcgccatgactgattcaagaagaagaaagcagttaggcaaactaaacatgtacagacaaggccgaaggcaagaagtgtttactggtatcctagcaatgacccgtgcctacatccagtcctcaagcaacctcttgagatttactttccttgtaaaaatcctttacaagcaaagagccacaaaggatgtaccctcccttatgttcactattacaaccaagaagctacccacttcttacacagaattctcagacg

SEQ ID NO: 30080 - DNA, 261 bp, Glycine max
  Peptide Sequence Number=SeqID_121765
atgactgcgagaaatgagcgagaacgacttcttaccgaggccttgaacaacttggcgcaagttatggccaatcagggaggtggtggaggagcaactatgtaccatgggttagatcgctttcagaggaacaatccacctactttcgaagggggttatgatcctgagggtgttgaggcttggctgagggagattgagaagatcttccggcgtgatggagtgtcaggaccatcagaaggtgttgtttgctactcacatgactag

SEQ ID NO: 30081 - DNA, 273 bp, Glycine max
  Peptide Sequence Number=SeqID_121766
atgctagcaacctggaagtattataacattgatttcactactccaaagattccactcaatgagatagtggccatcaaggttcttgatgtagaagcaaagcttcatggtgaatcaaaggtgattcaaaggtgttttgatgataacaatgatgatgacaaaggtgatgacaaaaagctcaaagatcaatcaaagaacaactcaagtgaatcaagaacaattcaagagttcaagataaaaatcaagaacaattcaagactcaagaagaaagtctag

SEQ ID NO: 30082 - DNA, 402 bp, Glycine max
  Peptide Sequence Number=SeqID_121767
atgactgtatgggaatttagctgtgaggttggcactaatggtaaggtgttgatatctggagtaactacaactggagagaatattgtatcccagtactctcaggtatttgaaatgcaaactcacaacctttgtccatcgggccaattctccatctcgttccagctgcctggccctgttgatccgcatcaattttcaggtggcttgtatgccccaaatacatgcacaatcctttcatccgcaattatcgttgtctatttacctattcatgtaaaagagtctttctacttctcttttgttcgagttagaagtctgccaatacaattttacatttttatttccaatgatccattgagatgggtcattaacgaccatccagcgatccttgtaaagcattttgggtag

SEQ ID NO: 30083 - DNA, 219 bp, Glycine max
  Peptide Sequence Number=SeqID_121768
atgacttgttataaaaaggacaaggagcttatgggtgttgagaaaggcaacaaattggaaggcttgttagaggcgcagatctttaaggcacttgaagatttgtgtagacatgtacttccacctacttcacacgttccctgtataaaactatcaattagttttgactatatgacaaagacattgaatgtgatcaccgaagatgcaatagtcctcacgtga

SEQ ID NO: 30084 - DNA, 237 bp, Glycine max
  Peptide Sequence Number=SeqID_121769
gtccccgagccaccaacaacattgacacatgcccgttctgatgtggaccagactagacatgcagtggatgcttgccatgcgatcgctgaaaggttggagcgtctactcaaccttaggatagtcacggttggcacagagacacacgaggtcatggaacaatgcatcaagattgccaggggtgtcatagaagaccacattgtgtatgtgaggtctcgacgtaggcggcgcacggattag

SEQ ID NO: 30085 - DNA, 99 bp, Glycine max
  Peptide Sequence Number=SeqID_121770
atgagtagatcaggacaatcacaggatttgaataacttggagcagatgccacattggcagtgtctcttgcagtctgagaagctggtgctgctgtcctga

SEQ ID NO: 30086 - DNA, 198 bp, Glycine max
  Peptide Sequence Number=SeqID_121771
atggaatactcatgggagtataacaacaggagattgattagtgaagaaagcggtgtaggagtggccggcggcgtggagcagctggcgagcgacgctgctatcgacgcctccgctgacaagaaccgcgagttggggcgacgagttctgtggcatggagcagcggaggtagcggtccaggtcaccggagagaagaggtga

SEQ ID NO: 30087 - DNA, 231 bp, Glycine max
  Peptide Sequence Number=SeqID_121772
atggcatcagtcagtattgaaaataagcttcctcctgccaaaaaaattgaacaattgtcatacaacattactgcattgctgccgtgtcttcctgagctggctgatattataccaagggatactcttctttggaagctgaaacttctcaaatcagttgttgcatatgctaattcgcatataattcgtgttaaacatgtttttacatcggtgctgacgtcaccaccgatgtag

SEQ ID NO: 30088 - DNA, 1008 bp, Glycine max
  Peptide Sequence Number=SeqID_121773
atggctgctgaagtatattaccaggctattggtactttgcagtcccattcttatctgaataatttaaatcatcaccaaaagcatcaaaacaatttagtaacattggtgtctagggattttatcagcagtaatggcttgtcaacgagaagaagtaactgcactggccagaggaattgtagtgtaattcgatctctagcttcgcaaacatcagtcgttgatccagtgttgtccccttcaagaagcaatgctggtgacacttacaagaaatcaaatgaagcagctttaatccttattcggcatggtgagtcgttatggaatgagaagaacttattcacagggtgtgttgatgtccctctaagcaagaagggtatagatgaggcaattgaagctggaaaaagaattagcagcattcctgttgatgtaatatttacatcagctttgattcgtgcacaaatgacagccatgcttgccatgacccagcaccgtcgtgggaagtatactagtaaaatgttatttcctaaatcatcaacttcccagcaggtccctatcatgatgcacaatgagagtgaacaagcaaggtatggggagctgcagggtctcaataagcaagaaacagcagacagatatgggaaagaacaagtccatgagtggcgacgaagttatgacatacctcctccaaatggtgaaagtttggaaatgtgtgctgaaagagcagttgcctatttcagagaccaaattgaacctcaacttttatctggaaagaatgttatgatttcagcccatgggaattcattgagatccattatcatgtaccttgataaattaacttcccaagaggtcattagtttggaactgtcaactggaattcccatgctttacattttcaaagagggaagattcattaggagggggagtcccataggaccttctgaagctggagtttatgcctatactaggatattatttgtctggaaggctgcaatggcacttgcagtcctctaccaatag

SEQ ID NO: 30089 - DNA, 255 bp, Glycine max
  Peptide Sequence Number=SeqID_121774
atggcatcttcaggaacttctgctatcttcattgtgttgcaaatctctatggagcctatgaaagagattgccttgaatcaactagaagagaaaatgtggataagggatattggcagcttgaacttcgggccgggctatgcttgtgaaatactagggtgtagaggtactagagtagtcatccaaggtgatcctccgtggccggtcttcttccatgatgtgttcttcaaagttgggatgtggaaaagaagaagatga

SEQ ID NO: 30090 - DNA, 126 bp, Glycine max
  Peptide Sequence Number=SeqID_121775
atggataagagcttgaagataggagaagatgagtggagggacaagaaaaggagtacgaaattttatgtctcaaatgagctcactaatctaagatcaggtccaagattctccaataagtgtgcttag

SEQ ID NO: 30091 - DNA, 615 bp, Glycine max
  Peptide Sequence Number=SeqID_121776
atggagatagtagacaatgactctaatttagaagctgtagaaaataagataaataaaattgtctctggatttaaagagatgcagtcaagcattgatgtcaagtacaaaaaattgcaatttgtccttgctcgagtgcaattagagactgaaactttggctctaaagaaagagcaaattaataagtttctcattctagaagaaaaaatgggagcaagacttagggaatttgctcgaatttctacagaggaagctgaaggatatcgtgaaattgttaaactaagaagatgtttgatgccatctatattgaagtctaaggaggacaaactgacacttgcaaagaacgaggaaaagctttctggagatgtgaaattgtttcaacgggacgtttctgccgcaagagcttccttgcaggaactatcttcaagaaagtcattctcagaactagaaacggaaaagaaagtttctactgctgcaagaaatttcaagaaggctgcacgaatagctactgaagcaaagtcattgtgtgttgaaaaagagagcattcagatagacatgggtacgactatatttaatcttgaactactgagagagaagtttggacttgtcaaccactga

SEQ ID NO: 30092 - DNA, 234 bp, Glycine max
  Peptide Sequence Number=SeqID_121777
ccagacatcccacaggttccagtggcatttgacccccctcgacatgcagtggatgattacgaaggctatgaggtgattacagaaaggttggagtgtgtgctcaaccttaggacggtcattgtagggatagagttacatgatatcatgcaagattgcctgaggatcgctaggggggtgccagtgcagatggaagtgttagggctcgacaaagacgacgcacagagcattgatgat

SEQ ID NO: 30093 - DNA, 252 bp, Glycine max
  Peptide Sequence Number=SeqID_121778
atgaggaaaactctatgtttcctcctccgtccaaggtcaagactaaagggtttcattgaggatgttgtggatgtcaaagtggacggtaactatggatatcgttccattgacgctttattaggtatgggcgaagaatcttggtcgatggtccgcaacgaattgatcaaagaacttggcaaatggttgcatgactacatcaacctcttcggtggcacacagagattcgaacaattacgatgtcgctacatgtga

SEQ ID NO: 30094 - DNA, 624 bp, Glycine max
  Peptide Sequence Number=SeqID_121779
cagaagctcctggctgagaagaccaagaagaagctggaggaagttgcacagtcaagaagcattgatggcgtcatcgaccctccatccccggattcctttgaggagcaggcgacacagggatccttcgtcccccacggacgtcaggatgttctcaccgctgctattggacgtccagagcaccctggacgtgttcgtgctgctggagttggtgtcaccatcaagcaatactttggatcggctccacagctcttccccttgcctcctgaagaattacagcagctgacccaacaaatcagggaccagctagaggagaccatcacagaaaaatcccagaagcaatctcagggacttgcattgcctcccgagcctttggttggtccctcaggtcctcaagtaagcacaaagaggagttgtgttgatccctcaggaaacgatcctaagacgggtgactcagataggtgcgacttgtacatcgaagcagatcctgcccgcctggttgccttagggagagtttatgagggatccactgttgttcataacactcctttgttgcctggccaagtaaaggtgggtgtggaggaggttacagatgcagatgctccagttcctgtacccactaatgag

SEQ ID NO: 30095 - DNA, 860 bp, Glycine max
  Peptide Sequence Number=SeqID_121780
tacttttctatgaaggacttgttaatgggaggccggatgagcttcgtgggtgtaactggcaccctatagaactggcagagatctgtgatcaaggccaaaaatctcagtgctctgttggacttttccaggggaagatcagaattatgatcgctaggaaaaatgttgctgaggagcagcgtcatccaaatttgtgtcaaggtggtcatgctagtgcgcatgatctgcacccgtcttcctatcacactgcatgcaaagtcctatcccggaacgcacaacagctggcttatggcctcctcgtcaaatcccgaagcctggctcctcttttcactaaactcgcaacgttgtccctcttccaggaccaatggatgccccaagaactgattaatggtatcttcatcaaaggggacccattggcctcacactcaagagcgcttatccctgactccttcctctgtgggccatgcattagcatagaattccatgactatttctgggtcatatttagccatgggccctgtgagttgagtccattgcctcttggcaacttcctcctggaacttagtgtattctccctctctcagtctgacccgtctctccttgaggaaagaccaactcttgattgcttcaaagcgacgttggtgttcctcacttcggaatcgatgtccgtcaaattctatgtccgcttgtggagcagcactggatccttctcccgtggcgtccttccttgccctcttagagaaaatcttctttggagccattgcatgcaaagacacatccataaaaagaatggagaacaatatgacatgccaatctacaataggatcaaggataggcctagggccatccattgcagcccctaa

SEQ ID NO: 30096 - DNA, 384 bp, Glycine max
  Peptide Sequence Number=SeqID_121781
atggccttggattcattcggttggggtggtcccgtcaacactgcaccagaaccgcgctcatctggtgccgctttaatggtggctcaggttatgttggggcacgtatatgagcccagaatgggtttaggccgaaacgagaatgacatagcgagtttggtggagttcacggagaatcacagaaggtttgggttgggatatgagcctacacgcaccgaaaaaagcttcgtcagtgcagggtggatgtgcgagggacgggttgttatgttaaagaaagaaacccctcaagaccaaccagtttgggtgcggccatgtcctccagagtttgaattggggaattggcaagtcgtgaaacaacctgggatttccatggcaaattcaatgtaa

SEQ ID NO: 30097 - DNA, 381 bp, Glycine max
  Peptide Sequence Number=SeqID_121782
atggggttgaaccaagtgccctcttttaaaaaaaggttctatcatgtcaaagtcaagagcctagaactagccagcttgcgagagctagggcagcggatggatcaagttcggcgtcaagcctttcgcaaggcatatgggaaaatctgggatttggctatgatagaagtgtccgttgaagccatcgcatccctcgcccagtactacgaccagttgctcagatgcttcacgtttagggacttccagttagcaccaaccatagaagagtttgaagggatcttgggatgcccgctaggaggaaagaagccatatcttttttttccggattctacccttccatggcaagagtaccaaaagtggttaagatcttggcacaaaagttag

SEQ ID NO: 30098 - DNA, 294 bp, Glycine max
  Peptide Sequence Number=SeqID_121783
atgaggttgtttttaaattatttccaagagggggcagttttttacgtgaaaagcatgcatgcaggacccaaatcgccagaaccagtagcgagtttggtgtccttgaacaaatcgccagtgttaatggcgataccagtgaccaaatcgccacttgaaatggcgacatgcgcagcgtttgggaaccgtcagtcaaactggcgagttccatggattaagctgcatgaattggaacctgacctcgtaggctacgagagtggaatattcaacgatacgtgtcaggttgggaagcagtaa

SEQ ID NO: 30099 - DNA, 219 bp, Glycine max
  Peptide Sequence Number=SeqID_121784
atgggttgcttgaggactggatttattgagggcacttttccaacagatgagagtgataatcagtcttatgaaagtgagtatgatcttgttggtgagtatggagattggagtgataaaaatcagagtgattgtgttagtgattttgaggaaacccgcgatgtgattaggaatcctcattttgatgatgatatgatattaatgttgagagaggagttttaa

SEQ ID NO: 30100 - DNA, 171 bp, Glycine max
  Peptide Sequence Number=SeqID_121785
atgctactgaaggactcgcttagtgagccagattggctaagcgagacttatttgcctagtgaggcagccctagaaaatgttgagctagagagtagccctcttagcgcatatccatttactctcgctcagcgagacatgcttgttgagcacgccttcgagaattataagtaa

SEQ ID NO: 30101 - DNA, 1119 bp, Glycine max
  Peptide Sequence Number=SeqID_121786
atgacgaaccaaaatgtggtgactcatgaggttattaacacgttgattgccgtggcagcttccatttcaaactcaaccgcgttgccaagtgcaacagtgccagaatccatggctgtgcttggtgggttttgggggctgccccataataaaaatcttgtgaaaaggttggaaggagctaaagttagtgcttggattgattcaatgagagcttcttccccaactcgtgccaaatcagaaagccaagaaaaaagatcttggattctttatcacccttcagctctgaacacgtttgagcaaatagtatgtagtgccaaaggaaagcaagtcgtagtttttcttgactacgatggaactctctccccaattgttgcagatccggataaagctttcatgactagaaagatgagagcaacgctaaagggcatagcaaggcattttcccacagcaatagtgaccggaaggtgcagagacaaggtatataactttgtaaaattggcagaactttactatgccggaagccatggcatggacatcaagggtccaacaaaaagccaaagtccaaagcaaggtaataataataaagcagtgctgttccaacccgcgagtcaattcctgccaatgatcgatgaggtgtacaagatcttgttagaaaaaacaaagactgtcccaggggctaatgttgagaacaataagttttgcttgtccgtgcactttcgttgtgttgacgaaaagagttgggcagcgttggcggagaaagttagattggtgctcaatgattacccacaacttaggctaacccaagggagaaaagtgctagagattcgtccaaccatcaaatgggacaagggcaaggctcttgaatttttgttagaatcattaggatacgagaattcgaatgatgtatttccaatatatattggtgatgatcgaactgatgaggatgcttttaaggttttgcgcagtaggggtcaaggaattgggattcttgtttctagagttgcaaaagaaacagatgcttcctataccttgcaagatccatcagaggcaagtgctatatattccatccagttgagcaattcttgcggcgtctggtggagtggaaaagaccgagtactgtga

SEQ ID NO: 30102 - DNA, 570 bp, Glycine max
  Peptide Sequence Number=SeqID_121787
ggtgaaatcgtcgaaacaatgcattttatggtgtcgcctcttgggaaaatggtttgtacttttgacggtttactgccatgtattaagaagatcactcttttgtctgacgaagaggataggatacttgaggcacatgaagctgctcccccttctcagccaaaatttgaacatcaacaatttaatatactacaacgaagtgtggagactcaaggcttagcacgacgtcgggaaactgttgatgcagcaccatatagtttcccttcgatgccagaacaacatcatggaatgtattacacaccacaggcattcacccaagaaccgtcgcagctaccgccgattggtgaactatcgaccccaaatgccctacttggtgctctgtggaatgtacctggaaatatacccgacatgaatgacttattaggggtctatttacgtcatgatttctctgccgaggctgaccaagtggatgaaaggacgaatcgtagaagaagaaatcttgatagggcaactaggaattgggaccggtcatgtaggactttgtcgcggcatcacagacatagtgatgattga

SEQ ID NO: 30103 - DNA, 882 bp, Glycine max
  Peptide Sequence Number=SeqID_121788
atgatgaaattaagagaaggcaaggcattagcaccctctgctgatctgttagtatgcttcccatctcgggctcatcttacgctaatgccaaagcccatctgcagcccggcccggcccgcggagcccaacaagcgccaccaccgtaagaaatcgttctccagaggaggcgggggcccagcgagtcctctgttatgggccaaaacaaagtcaatggggtcggaaattacagaaccaacctccccgaaggtgacgtgcgccgggcagatcaaggtacggcccaaaacgacgtcgtgcaggagctggcaatcggtgatggaggagatagagaaaatccacactgacaagaaacagaggaagcgtctgggctgggccgagacgctcggtttcaagaaggagataatgcagttcttgacgtgtttgcgaagcataaggttcgaccttagatgcttcgggtccttctccgaaaccgacatcgtcacggaagaagaagaagaagaagaagaagacgtgggtgtggaaagcgatgacaacgaggcatcgaggactgttttctcgaaatggttcatggtgttgcagcaagagaatgagagcaagaaccggagagaagagacagaggagagagattatggtaatgaggaggaaagtgtgtcggttcctcctccgaacgcattattgctcatgcgatgtagttctgcgccggcgaaaagttgggtgagagagagagaaaaagaaaaaggggaaaagaaggggcagagtttaaagtcgttgatggagaaggagaatgttgtggtgatgcgatatgattctgatttttacgacatttcttctgaggttggcggcaccagtgatctcatgttcaggagtcgaagttggaaaacatga

SEQ ID NO: 30104 - DNA, 1965 bp, Glycine max
  Peptide Sequence Number=SeqID_121789
atggcagggaaaaccaagaacaaagtggaggttcaattgggttgcggtttggtggggagaattttccatctcaaaaccaataataggcctagaaaatcctctgttcattcactacccctgaagccttgcaacactgcacaacagagggatcagggcaaaaacgaatccaaagcccctccaaaccatgaaccaaaagatagctccattgaaaccattcctacactgaaaggggagcagaatccagcaagaaagagtagacaacaacagaaagatcaccctgttgttaactctctggaacttgccaggataagtactagtaccagtcatcatcaaaactacgggacgaaatccccggccaaagaatttgtgttaccaatcactgggaatttgcttgtgaatagcagcccaagaactagtgtcacaaagagcaaagagttgaactctttgtccggttcctgttcttacaacagtaatagtactaacaaaggcatgatggggaacatcatgaggaagaacagcgatgagcttgggcaatttcggagtctgaggaacagcagagtggaccctgaggtgttgaagtccatggggaatgaagcgtacaagcagggaagatttgaagaggctttggctttgtatgacagagccattgctgttgactccaagaaagcaacatatcattgcaacaagagcgcggctttgataagcttgggaaggtttctgcaggcaattgttgagtgtgaggaagctatcaggttggagccttcgtatggcagagcccacacccgtttagcaacaatttatttcagattgggagaggctgaaaaggcactgaattgcaatgaaacaagcccatgtgttgattccgtacttgctttccaggctcaggctcttcaaaatcaccttagcaaatgcactgaagctcggaaagtcaaagattggaaagttatattaaaggaatcacaggctgcaatatccttgggtgctgattcagctccactggtctattgtttacatactgaagccttgctgaagctcctaagacatcaagaggcacacgctacctacgagaaaatgccaaaatttgaccttgattattctaacaaattatttggcccggttcgtagtgcttacctattgatgataggcacacacatttacttggcaaccggcaggtttgaggatgcagtgatagcatctcagcaagcatctaagttagatccaagtagctttgaggtgaatgcagtggtaaggagggccagagcagtggcatcagccagaatgagtggtaacttactcttcaaggcatcaaaattcacggaagcatatgctgtatacaatgaaggactagagcatgatccattcaactcagttctgctatgcaatagagcagcatgtcgttctaagctaggtcaattcgagaaagcaattgaagattgtaatgtggcacttatagttcagccaagttatagcaaggcaaggttgaggagggcagattgcaatgccaagttggaaagatgggaagctgcgattcaagattatgaaatgctgttaagagaaaagccaggagatgaggaggtggccagggccctgtttgagacccagctccaactcaagacgttgcgtggtgaagatattaaggacttgaaatttggctcaaatttgtttttcatctcaagcaatgatcggtttagacattatgtaacatcacctgggatgtctgtggtgcttttctgtaacaaggcaacccacaaacaagtgttattggtgttggagcaaacctgcaagagatttccatcagttaattttcttaaggttgagattgaagaccacccttacttggcaaaatcagaaggtgtgaactgcatcccagcttttaaaatatacaagaatggatcaagggttaaagaaattccaggcagcaaccacgacttgttggaaaaattagttaaattatatagcaactga

SEQ ID NO: 30105 - DNA, 378 bp, Glycine max
  Peptide Sequence Number=SeqID_121790
atgttgttaatggcagatggcggaaagtcaaaaatccgccataaaaatatggcggatggcgtagcggaaaatgacggatgtcatggcggacagaaaaaagggatgtcaaacagcaaaaatagcatgccgccgttcgtgacaggtgcgtttctgtcggagctcgtcgccgccgttcgtgccggtgcgtcgctgccggagctcgtcgcagctgcgtgcgcgtgcggattacaggtgtcgcagctgcatgcgcgtgcgaactgcgggtgtcgcggttgtggctgggtgcggcggggtgcgggagggacgcggctgggttcaggggagggacgcggttgggttcaggggaggctcgcggttgggttctctcttagatggtag

SEQ ID NO: 30106 - DNA, 196 bp, Glycine max
  Peptide Sequence Number=SeqID_121791
atggaggaagatcaatggacgtatgactatacgatgtcacaagaagttcatatggattatgataatgaagaagaatgtggtgtgaatgaaccacatgctgattgttcaaatgcttttaatacctgtcagtgggctcgaacaattgcccatgaaaacgaatttgttgcagtgattatgaggtctgacacagatactg

SEQ ID NO: 30107 - DNA, 1080 bp, Glycine max
  Peptide Sequence Number=SeqID_121792
gtccgtgcggagagacacggtggtcgacgtgtgatggttgatgacatgcatggggccaaattggaggcttgtgcggccatggcacttagattggtgcctcacacggtcgtggggcccaaattagaggctcgtgcggcgaagctggcgttcttcccttcgtccctgatgtcgtgcaaggtggtgaagcaggaggcgacgacacttctattgatggagtcattcccgcactgcaagaatctggatcatgttgaggttctccagttcctgaaccgttgcagcacatgtatgtgtgttgctctacttgcacgggcacatgggagaagagaggttggacagaaggggtgggtgggggaagaagagaaaagaagagggctagagggggtgagtggggaaagaggagagggtcaaagcgaagagggtgggtgggggaagaagaaagggttcaatggttgttacaagcaagctactgctttgaagaaaagtggttacacggagaatgatgtgatggaacaatgcaaagaagttccttcaaaaagaacaaagttgaatgaaaattggaattactcattgtcatctaatatggaaacaccgattgatgtttccgaaagtgacattcctacaccactggctcgcccaatgggacaaaaggcaaccaaaaggaaggtcaaagttataggagcatcttcttctacactgcttgtgaacttgtttagcattgaaaaagaaatgaaggaaagaaatgttgtccaaaaacaaataacaaaggtagtggagttagataatgtcgtgaagatgtacgatattcttacgaaagaaaagtctaacatgattgaagatcaacacaagcatcataaaatggctcgaaactctggcttcgatagagtttggcaacaaattgttgatgaagcacttgaagacaacattgttgaagaaatcatgagatatttatgccagttgcaacaacaagcaaatagtagcagtcggcccaaacggacaagaagaaacataaaccagaaccgtgaagacggacatagtctcttaatgaatgactatttctctgaaaattgcatatatgcatag

SEQ ID NO: 30108 - DNA, 495 bp, Glycine max
  Peptide Sequence Number=SeqID_121793
atggtgatgatactgacggtgctccccaacgtcgaaggccgaccgcatcggcacgcagacttgcctgcggtaccagaggcagaggctgctgtagctggggatgagcccatggtagatgctgccacacaggacaccagtgcagagattgacgcacaagataccggtgcacaagatattggggacgagcctgagggatttcctagtggacccagggacccatcagtgcttacagagtatgttgaccatgttgcggccagcgtatggtctggacaagaatgtcctgagttgaagttatcctcccatgggaggaaggtgcataacttaggcaggcctgttcctacaattgaggacatggttgctgggacaggattaagtactttgatcgcgtgttctattgacactggcgatcggagacttatatcctcctttgtcgagaggtggcaccgggagacttctagtttccacttcctgtgggggagatttcgatcacgctag

SEQ ID NO: 30109 - DNA, 585 bp, Glycine max
  Peptide Sequence Number=SeqID_121794
atggattctggcaacagtggaagcatctcttctagcgatgatgaatacgattcatcatcacacgctcatccatcgttcctcaatcattttggttccatctccgacccgcaacaaccatctcttgttccttctcatccctcaatgtttgatctttcctcaaactatctccactctctctcacaatcccacccaaacccccataattccttcttaaacttagactctcaaggccaaagatctgaacccaattgcaccctccatgaaagcctcccatcttcatcagcaataccaacaacaacaaatcaatacttgttgggccacgacaaccttaataataatgcaagacaacaactcccatcatccccacagaccaacaacctcatacgcaactcgaagaaacgaagcagagcttcaaggcgtgcacccaccaccgttctcaccaccgacaccaacaacttcagatccatggttcaagagttcaccggaatccctgcaccccctttctcaccttccttctctcgccgcatccctcttcgcccaaaccctttgctttctacaacttcatcaagggactttgttacataa

SEQ ID NO: 30110 - DNA, 1170 bp, Glycine max
  Peptide Sequence Number=SeqID_121795
atggagagaagcaatccggtgaggaagccacacacttcaactgcagatctgcttacgtggcctgaaactcccatttctgattccccagctcctccttcctccgccgttcgttctcaccagccgtcggatgggatcaggaaggtggtgtttggtggtcaggtcaccgatgaagaggtcgagagcttaaataaaagaaagccttgttcggattataagatgaaggagataactggtagtggaatatttgtagccaatggagaagatgacgcctcagaagctggcagtgacaacccaaataagactggagtgcgtatgtatcagcaagcgatttctggaatcagccatatctcctttggcgaggaggagagtgtttctccaaaaaagcccactactttgcctgaggtggccaagcagcgtgagctaagtggaactttggaaagtgaagactctatattgaaaaagcaactctctgatgcgaagtgcaaggagcttagtggtcatgacatatttgctccaccaccagaaatcaaacccaggccaataactcctcgcatactggagttgaaagggagcatagacattgctgacggagatcaaggcgataccaactctgctgggaagacagcaaagaagatctatgacaagaaatttgcagaactttcagggaatgacatattcaaaggggatgcaccgccttcatctgctgagaaatcattgagcggggccaaactacgagagatgagtggcagtaacatctttgctgatgggaaggtagaagctagagactacctaggtggtgtacggaagccacccggtggcgagagcagcattgccttgtgcaacaacaaagactataaccccgatacacttcacgttcccctcattaagcttcctcgtgctctttgtcatgaacggctaggacgcaacagggttcgtaagccgttagatcaaggcttaatgttgtcaatgtcgcagaacaaactgcttggccctgacgcaggcggtggagaagccattgttgttgggtggagccgtggaggtgccatagaccaaattgggatcatcatgtacaaaggagaatttcagcaagggttgcaaaaatcagaagccaagattgaaggggtttcaggaattttgggtggtgtaatattggacacggattcggaatag

SEQ ID NO: 30111 - DNA, 1205 bp, Glycine max
  Peptide Sequence Number=SeqID_121796
atggccggtggggtggttcctgtcgattcatcaccattttccaatggctttgctggcaagataacgctctcagttatcatcacttgcatcgttgctgcatccagtggactcctttttggatatgacatcggaatttcagctagtcgagtcacggcggcattgggtcggagaaacaccatcatcttgggtggtgtcatctttgttgttggtggtgcccttaatggaggtgctgaaaatattgctatgctcattttgggtcgtatcctactcgggtttggggctgcgccgttgtacctttctgaaatcgcaccaccgaaatggcgaggagcattcaacacagggttccaattcttcctatcacttggagtgctggttgcaggttgcatcaacttcggaaccgcaaagaaaacttgggggtggcgtgtctctctgggccttgcagtggtgcctgcagcagttatgacaattggtgctttcctcataaccgacacccccaacagcttggttgagcgtggcaaaatagagcaagccagaaaagccctacgcaaagcaagaggatcctccatcgatgttgaacccgaattggaagaactcattaagtggtcacaaattgctaaatctgtggagcaggaacccttcaagaccatatttgagaggcagtatcgaccccacttggccatggcaattgctatcccattttttcagcagatgacagggattaacatcgttgcattctattcacctaacctctttcagtctgtgggtttgggacacgatgccgctttactttctgccgttatacttggagcagtcaaccttgtttctctcctcgtctctaccgctattgttgatcgctttggtcgaaggtttttgttcataaccggtggcatatgcatcggtgactggtgttcatggtacaaaggacgtgtcgaagggcagtgcaattgtggtgttggtgttactctgtttctactcggcagaaccactggacaaagcatagctgttggtgtacagttcataattgtgtttatattatcccagacattcttgtcaatgctatgccactttaagtttggtgccttcttgttctacgggggttggattgtaatcatgacaatctttgttatattcttcgtgccagagactaaaggaattcctttggagtcaatggacaccatatggggtaaacactggttttggcgccg

SEQ ID NO: 30112 - DNA, 1374 bp, Glycine max
  Peptide Sequence Number=SeqID_121797
atggtaccatttctggaaaaattcttcccagatatattgagaaaagttgctggtactgaagtgaacatgtactgtgtgtatgatagtcaagtgttgacattgttcacatcttctctataccttgctgggttagtgtcatctctcgcagctagtcgagtcacagcagcatggggtcggcgaaacaccatcttaattggtggcgttacatttcttattggtggtgcccttaatggaggtgctgaaaatattggcatgctcattttgggtcgtgtgctacttggttttggggtcggtttcactaatcaagctgcaccgttgtatctctctgaaatcgcaccaccgaaatggcgaggagcattcaacacaggcttccaattcttcttaggagttggagcgcttatcgctggctgcataaacttcgcaaccgcgaaacacacgtggggatggcgagtctctcttggccttgcagtggtgcctgcatcagttatgacaattggtgcattgctcataactgacacccccagcagcttggttgaacgtggcaaaatagagcaagccagaaaagccctacgcaaagcaagagggtcctccattgatgtggaacctgaattggaagaactcattaagtggtcacaaattgctaaatctatgaagcaggagcccttcaagaccatatttgagaggcagtatcgaccacacttggtcatggcaattgctatcccattttttcagcagatgacagggattaacatcgtcgcattctatgctcctaacatcttccagtctgtgggtttgggacacgatgcggctttactttctgccattatacttggagcagtaaaccttgtttctctcctcgtctccactgctattgttgatcgctttggtcgaaggttcttgttcgtaaccggtggcatatgcatgcttgtttgccagattgcggtgtcaattttgctagcagtggtgactggtgttcatggtacaaaggacatgtctaacggcagtgcaattgtggtgttggtgctactctgttgctacacagcaggttttggttggtcgtggggacctctgacgtggctaataccaagtgaaattttccccttaaaaatcagaaccactggacaaagcattgctgttggtgtgcagttcataatcatatttatattatcccagacattcttgtctatgctatgccactttaagtttgcctctttcgtgttctacgcgggttggattatagtgatgacaatctttgttatattcttcgtgccagagactaaaggaattcctttggagtcaatgtacaccatatggggcaaacactggttttggcgtcggtatgtgaaagatgttgagcaagaaaatcttccatga

SEQ ID NO: 30113 - DNA, 132 bp, Glycine max
  Peptide Sequence Number=SeqID_121798
atggcgccgccatcttcaacccatcacgccaccgctattcggtggcgttttttcaaaaatccgctacgcaactccgccatagcgccgccatggccgccatttaacaacactgggtatccagaattgaaatga

SEQ ID NO: 30114 - DNA, 279 bp, Glycine max
  Peptide Sequence Number=SeqID_121799
atgggcccgaaatctaccctaaggctcataagaaccctagggccttctcttgcatctctggcccaatctacttggagtttttctatccaatgcccttgcggagtaggattgcatcaacaacctacacattcttctattttgcaggtcacaagttgtaccatttatggtgaagctcatgagacaggccaatgctttcccactgacgataacactcaagaaattcatttcatggggaatcagcagagacaagggtacactcaagtattgagtcagcactaa

SEQ ID NO: 30115 - DNA, 291 bp, Glycine max
  Peptide Sequence Number=SeqID_121800
atggagtcgttaaggtgttggaccttgaaacgatctcaagaaaatgccatttggtgcaggggaagctcgcccaggcgagtggcttgcttagggctaaagaaatttcatggctcaagcgagccagatgctagcctgggcgagtttaggtccaaaaaaataaaggcgaggatgttgagtcttatgaaaaataatggtgaggacgttgagtcctatggaaagataaaggttaggatgttgagtcctatgaaaaataaaggcgaggatgttgagtcctatggaaagataaagtga

SEQ ID NO: 30116 - DNA, 558 bp, Glycine max
  Peptide Sequence Number=SeqID_121801
atggatcatgctgctgaagaggttcatgagcagcctcaggagccaattacggatcatgttgatgttgatacaaaggaacatactgagttaaagttggcctttcatgggagcaaggtagaaaattttggaaggcctgcagctgagattgaaggcatagtggttgctacaagattaagttctctgattacatgttcgtttgagacagactacatgaacaagttctataggatatctcatcgattcacgagtctgcttcaacttgtggatcctcctagacatccacccatggtgcatgatgatacatttattgtaccagatccacctgtgttgcccattcagtcagcaactatgccacaaccacttgtacttgtggctgccaatgcagacatgcctcggcatgcagtggccacttgccaaaggatagtagaaagtttggaacgcatgatccacaagaggatggtcactgctgaaactgatgcatacactctaactaagcactgtctaagattagccagaagtgtcactaaccaaagaaatgtttatgttcaatacagataa

SEQ ID NO: 30117 - DNA, 390 bp, Glycine max
  Peptide Sequence Number=SeqID_121802
atgtgcaataggatttacacacataattgcatccacttttgcttacggaagtgtggtgatccagtgcgttgtgagcgttgtgctggaaatcccaggtggagctggaaggaaatcccaattggagctggaaagaggcggcggagacgacgacttcgagctagaatagtcacgcgacggagaaaatacaggggagaaggtggagaaagggtaatgggaagaggagagaggaggaggaggagaagacagcaagcgagtggagagatgaacagacccgagatttatggagagatgaacgagcatgacatttgtggaaagaagagaaatggacgcgaggggttaaaaattaaaatggcccgcattcaaagacggttttttgcacaaccgccttag

SEQ ID NO: 30118 - DNA, 711 bp, Glycine max
  Peptide Sequence Number=SeqID_121803
atgaaagatcatcttcacctgaacatcagtacccctacattagagtcttcctcatcaactcgaccaaacgagcctaacttcacaacaaagccaaacttacctaatggagaactcagtccctttagtgaggatgaagatgaagttcttcacaatcaaccccaagagaaagatgatgaggaagaagctcagtctgtttcaccaatcacaatcgtaccaccatactacatatcaccccttatgcaaaattttgaagaatcctattttcaagattttgaatacgagcatagcttggattgtaaagaagtccaacatccagtggggactctcttcaaaaggatgtgtttcctgaaaaaacaagatgtacaaaatgctttgttgcagtatcatgtgagcaaatggactaactacaagacacaactatcaaacccaaaaaagatcgtaccacgatctaccgagattgctgcaagttatgcatcaatttcttcttggtatggtggtgaagaagggaaacactgcaatgccaccacaaagaggtcaaccagtaaagggtttcgtcatgttccatcatcttttttggagtttcagaccatgtatcggtggatttcaatattgttgtacagtaagtacaaggggaccctccttgtggcagttgcacaagatgacaacaacaaaatctttttgatagcctttgctgttgttgagagtgaataa

SEQ ID NO: 30119 - DNA, 243 bp, Glycine max
  Peptide Sequence Number=SeqID_121804
atggtgtcctcaagaagactgtgtcctattgcctttggcgttgatagaggaggatctgtaaggatgccagctgctctttgtggtgttgttggtctaaaaccaacttttgaacgtatacctcatgaaggagttcttcccctaaattggaatgttgggatggttggaatacaagcagtaaataaggatcgtcatttgaagcatgttcttgacaggaaactttggacaatatcaatctctacttag

SEQ ID NO: 30120 - DNA, 1719 bp, Glycine max
  Peptide Sequence Number=SeqID_121805
atggctttgcctttttggcaagcttcgggaggaacctggacaaggatgctagcctatcattcagcttctaaacttcttggacctgaggaacttgcctcagcctaccccgaaagtgcatttttcggggttgcggcgcatgtcatatttacggagttccccaaagacttcttccaggcccgtcacatgtcgggctatgctttgagacttgacaactatgtcgtccacatatacctcaatcctgctaatgctaagccgagggtatgcgtctttggggcacaccctgttcagatcaatgtagttgatgcacattttccatttgccgttggcctttttgaccatgacaacattggcgagccaggtagaaaacctgacttctctgatgaacacgttggcgatgtgccggtgctcataactggtgaggtccctactgagccacgtgcattgtccgggtttaggtctgagttgcagcttgacaagcccttcgatgggtttcgggcctcttttggaagtgtcatctcacggatctatgtcaaatccatcgcccaggcttgcttggtagacggtcagggcttggatttgagacccttcgtccatgcttatgacttgagtgcctttagccgttgtggggtgaggcatgccttgacgattacgatttcccttatcaaggtagggaatttcattttcaaatgggctcctggagagcttgccttaactgaaggtggtcatcaagtccacaagcctctggatatcaatggaactgtcttggtcgataaggaccctgaacaccatgaagtttgcaataatgatggagacgaccacgaggccgtcttggttgacggggttgatgcccttgaagtccctatccgtaaagagatgacatcttcaagactggttgtcactcggactgttgttactggtgtctttgtctaccttggtcttccgctcttcttttgtctgctccgtggttcctatgtttctcctcttggtgtcctccaggagcatggaatgcaatgctaccttggggttaagatttcagatttggacggcagtgcgcccaaatctatccatgaattttttgaggaacccgttgtctacttgtggcagactggccaaggtggccgaggtcatatagtgagacctgctggtggcgtattacggactaaatcattcgatgagggtgtcaaagctatctatggtcctaggtgggagttcaacgtaccagggtcacccaagtcaggaaggcgtccagatgctcgtctagatttgttgtcccatttgtaccactcgaggttgagtggtttccaccccaaggactttgtaaaagacattttacaagatgatggaaatctcaagtgggttgcttggggactggacgtaggcacagggcgtggccgaaccagtcacttgtctaacaaacatgagcctccagctgatcatggtcagcctttagctttcttagttcttccttatggcgtcgctccatctccacaatgcgggcgagaccgagtgctaaccacggatgaaaaagagagagttgatgagaaaccacggggactttacatgtcggctttgaggatggcctttgttgagcggacaagaggagggacttgcaaaacaaaggactctgacgctcaagctcgagtgagcgagaaagagagagagaggcacatgcttgttgctcgtgtgttgaagtgtgtaaaagatgtgtacagggtttga

SEQ ID NO: 30121 - DNA, 987 bp, Glycine max
  Peptide Sequence Number=SeqID_121806
atggaaggtccttggcctttactgccaacgttcactgcaacttttgcgaacttcgaagggaaacagcatggactatccgagtccaagtacaagttgaatcctttatcaattttgattggactggttgtgattctggacacagaaagtgggtttcttttcaaatttgaattcaagcttgtagcagcacgttcttcgtccagcactggtaaggggaaaaatcatgaaggctcaataaagtatggtttcagccttgtaaaagggaaagctaatcacccaatggaggattatcatgttgccaagtttgcgcagatacaggataatgaattgggtttatttgcaatttatgatggtcacgtgggtgaccgtgtgcctgcctacttacagaaacatttgtttaccaacattttgagggaggaggaattttgggaggaccccactctttctatctcgaaagcatatgagagcacagatcaggaaattctatcacatagttctgatcttgggcgtggtggatcaacggcagtaactgctatattgatcaatgggcgaaggttatggatagctaatgttggagactcacgagctgttctttcaagaaaaggtcaagctgtacaaatgactacagaccatgagcctaacacagaacgaggcagcattgagactagaggtggttttgtgtctaacttgccaggtgatgtgcctagagtaaatggaaaacttgctgtttctcgtgcatttggagacaagagtctcaagtcccatttgcgatcagaccctgatgtacagaatactgatgtagatgttgatactgagattctaatccttgcaagtgatggaatttggaaggtaatgactaatcaagaggcagtggatatcgctagaagaacaacgagagacccgcagaaagcagctaaacaactaacagctgaagcattaaaaagagatagtaaagatgatatatcttgtgttgtggttaaattcagatga

SEQ ID NO: 30122 - DNA, 327 bp, Glycine max
  Peptide Sequence Number=SeqID_121807
atgatcgcactgagtggaacctttgacgctgctggtgacgttgaggaggcggtggccgccctcggggatgaaggcgtcggcgtagagggagagcccgcagaggcagaaggcggcggagagcgtgacgtcgacggggaacaaccgggggagcgccgcgagaaggaggcagaggagggtggagagttgggagagcgaggcggagacggagaggcatttggcctttggagcgagacgcgggcggagcctctagagggattgggggttagggttcctggctgcgctgcgcatggaccactctcacatatatatctaaggcttttgttttaa

SEQ ID NO: 30123 - DNA, 2124 bp, Glycine max
  Peptide Sequence Number=SeqID_121808
atgtccaggcctctgcaccgaggggtatctattcggatccctgatagcaacaataatgacttgtgggactctcaatccaaagataaaacagaaaaagaaggtttggatagaagaggttcctttggtcacccctcacccttgaggtctccctttaagttgcttttttcggataattctaattccaaatatggcatcggtgagaatggtttctcatctgatcccttcattattggcactccaagaagtaggcacaagttggttcttcttttcttgaagtttagtttagtgtttatagttattcttgctcttgctggatctttttggtggacaatctcaatttcaactgcatcaagaggtcacatttaccatggttatagaagactccaagagaatcttgtatcagacctgttggatattggggagatttcttatgctccctcaagactgaaagaattggaattctgttctgaggagtttgaaaattatgttccttgctttaatgtttctgacaatctagctcttggtttttctgatggaaatgagtttgaccggcaatgtcaccatgagctcaggcctaattgtttagttctctctccaccaaattacaaaattcctcttaggtggcctactggaagggatattatctggattgctaatgctaaaataactgcacaggaggttctttcttctggaagctttaccaaaaggatgatgatgcttgatgaagagcaaatttcctttcgttcagcctctcttatgtttgatggtgttgaagactactcacatcaaatcgcagaaatgattggactcagaaatgaatctagcttcatacaagctggggttagaaccatactggacattggctgtggttacggtagctttggagcacacctctttcagagtcagcttttaactatgtgcattgcaagctatgagccttctggcagtcaagttcagcttacacttgagaggggtcttcctgctatggttgcttctttcacttctaaacaattgccatatccatctctctcctttgacatgttgcattgtgcaagatgtggcattgattgggaccgaaaagatggcattctcatgattgaagctgatagacttttaagaccggggggctactttgtctggacttcaccacttacaaatgctcgtgacaaagacagtcagaaaagatggaagttcatacaaagttttgctgaaaacctttgctgggatatgctgtcacagcaagatgaaactgtcgtatggaagaaaactagtaaaaggaattgctatagttcaagaaagaatagttctccccctcctttatgtggcagaggctatgatgtggagtctccgtattatcgagaactgcaaaactgcataggaggaacacatagcagccgctggatttctgtccaagagagggaaacttggccttccagagatcacttgaacaaaaaggagcttgcaatctttgggttgcaatctgatgaatttgctgaggactctgaaagctggaaagcagcagttcgaaattattggtctcttctgtcacctttaatattttctgatcatccaaagagacctggtgatgaggaccctccaccaccttataacatgctaagaaatgtgctagacatgaatgctcatgttggtggttttaattctgcaatgttgcaagctggaaaatccatatgggtaatgaatgtggtccctctgagtggactcaactatcttcccttgatccaggatcgaggttatgttggtgttttgcacgattggtgtgaggccttcccaacgtaccctagaacctatgacttggtccatgcagcaggacttttatcccttgaatttgctcagcagcgcagctgtaccatgcttgacatgttcattgaaattgacaggttacttcgtccagagatagcagttgcagagttgatctttgctgtcaacattgagatcctgccgaaaggttggattataattcgtgacacagttcctttaatagagtcagcaagagctctaacaacaaggctaaagtgggatgcgcgagttgtagaaattgaaagtgacagcgatcagagactcctgatctgtcaaaaacctttctttaagagacaggcaaattaa

SEQ ID NO: 30124 - DNA, 111 bp, Glycine max
  Peptide Sequence Number=SeqID_121809
atgtcggggaagctagttaccccacaagtgcagatagagtttgcaaaaaggattgcaatgaatgtggttcttccatgttccatactcaaacgtggacgattggggaagtaa

SEQ ID NO: 30125 - DNA, 429 bp, Glycine max
  Peptide Sequence Number=SeqID_121810
atgaaaaaaataagtactctagttcttactcaagactatgacgaggcttccccgcgtgcgtgcaggtgggttgcgacgaagaagaccgtaaagagcattcgcacgccgtcgtacggggagcgcctggaccgactccggattccggatgtctgttggatcccttatggggagcatcgggaggtccgggacttccacctcagattatgctattccggtctcttgcgctgggggcctgttgctgtttattaccgaccggagagggtcgtgcggcaatttggctacacgcagaccatttctgctcctcctgtcgattcatgggtctcgtatgatgatattcacgacaggtggatgcactacaaggatcatatcgtaccagcaagtgaggtgtgcgttgtgccaggggcgtgttccagtgactacatggactga

SEQ ID NO: 30126 - DNA, 438 bp, Glycine max
  Peptide Sequence Number=SeqID_121811
atgtacaacccacagattcagcaaccacaatactatcaacaactttatggagcatcatcttctaccatgagcaccccatattactatggttattctgtgcaagcaccaagaaacgcattttcttcaccccaagcaaatcgcctatcacctggaccatcctatctatactaccctacaccaatggaagtctcattctctggatatcgtccaccccaacaaacaccaatgaggcaaacctttgcttcccctaatgacttggatcttgctgatggtatgaaagtaatgattgaaacgcatttggtttctctgacatacatgagaaaatatattcaccagagtcagcagcgtacctcctctgaaacagcagccggggtagctataacatcagagaagatcgaatacccgggggaagaactaataaatatatatacctgctaa

SEQ ID NO: 30127 - DNA, 184 bp, Glycine max
  Peptide Sequence Number=SeqID_121812
gttggtagttccatggggacatgatgtagggagaggcattgttgctgctgtgccgttggttattatgggaggagaattcatcgtcgtcgtggttggaggtgtaaagcgacgtcgtttcggagtgcaacaaggctccgaacttttgtctgtgtacgctgttgctgtttgttttatgctctactaa

SEQ ID NO: 30128 - DNA, 1269 bp, Glycine max
  Peptide Sequence Number=SeqID_121813
atgggaaaacaacccactggcctcaacttcaccaacgacgccgacgtggagcagagcagccaccacaatactcgtaaaactactctaaaactaaaaccctattcctctgtttttgttattcccacgatgatgcctccttctcagccacctcattgggccccatctcccacaccaatcctcagcaagtctttcctacccccgacgtcaaactcgccggcggttgacttcactccgcccttaatagcaatggtcgtcgtcgtcgccgccgcgtttcttgtcgtcacctactcccgcctcatcgcgcgccacctcagaccacccgtccaccgcctcctccgccgcttccgacgccgccgcttcctcccctcctccgtcggcgacctcgagtccctcccctacgattctcccttcgacggaccgcacgtgttctccccctacggtttggacgaaacggttattaaaacaatcccgttctcgctttatacagcgaaatacgacgcgcgttttgatgagtctcgctacgactgcgccgtttgcttgctcgaattcgaagacgaggattacgtaagaacgcttcccgtttgttcacacacgttccacgtggactgcatcgacgcgtggcttcgctcgcacgctaactgtcctctctgccgcgctggagttctctgcaccgattcacctttcactccgatgatggccgctagaatccgaccgagcctcgacgacgacacaattctccaccgtatcagtatagatcctctcatcgatctgccgccgcagcctgcgtcggcggtggctatatcctccgtgtcggagattactccctgcgtcgacgagaacactccgaggaggaaccagaaccatgcgaacgttaactcagaggattgttttagggattttctgctgaagaggtcttactcgtttggatttgaacggagtctggcgtcggagaggatggtgatggaaccggcgacggcgtcgccgtggcggtaccggagagggagtagtagtttctggagcaagaggccctcgccattcggatcattggggaagccgagggtgttttcgttcaggggttttttcccgttgtcggagtcgagcgtgaggtacggcagcggggggagctcgtcgcggcggagcaagtcgatagcgagtccgatgtttctgcggtcctcgggggtggcagccgcggcggcgttctcgtcgagccggctgaggtgcggggatcccgaggcgctgctgtcgccggagaggtttaaccggaggtga

SEQ ID NO: 30129 - DNA, 1947 bp, Glycine max
  Peptide Sequence Number=SeqID_121814
atggacgattacgcgagcagcgacgaggattaccattacgactccgatcaggaggactccgtcgaggcctacgaaaacgacgagaattacgccttgctttcttccaagggccccactactaaggtatacgatacgccgttttggggttattccaatttttattcttcttcttcttcttcttatgtgaaaaaccctcacttattgaattttcttctcgcgatgatttacgtccgtgtttgtttatgtgattacaaaggaatcactgctggctgcacaggtttttctgagatcacaacccacatttttttgcagaaggaggatttgcgcagagtgatggacatgctatcggtgagagagcaacatgctcgtactctgcttatttttcatcgttgggatgtggagaatctgtttgaagtgtatgtagacaaggggaaatcatttctctttgctgaagctggtgttagtgtggatgaacatcgtgactctgactcacctgttcctcctgatttcatgtgcaacatttgtatggatgaagttcctagtagcaaaacaacgagaatggactgcggtcactgcttttgcaacggctgttggatagagcattttattgtcaagataaatgagggtcaaagtaagcgcattagatgcatggaacacaagtgcaattccatatgtgatgaagctgttgtaagaactctactcagtagagagcactctcatatggctgagaaatatgaacgctttctgcttgaatcttacattgaagacaataagagagttaaatggtgtcccagcacacctcattgtgggaatgcaatacgggttgaggatgatgaactgtgtgaggtagaatgttcatgtggtgtacaattttgttttagttgtttgtcagaagcacactccccttgttcatgtctgatgtgggagctttgggctaagaagtgtcgagacgaatcagaaactgttaattggataactgttcatacaaaaccatgtccaaagtgtcacaaaccagtggagaagaatggtggctgtaacttggttagctgtatctgtggccaagctttttgttggttgtgtggtggagctaccggccgagagcatacttggtcaagtatagctggtcatagctgtggtcgctacaaagagcaagaaaaaacagctgaacgtgcaaagagggatctatatcggtatatgcactatcataaccggtataaagctcacacagactcctttaagattgaaagtaaactgaaagagactatacaagggaagatttccatttcagaagaaaaagattctacactcagagattatagctgggtaaataatggactctccagacttttcagatctaggcgagtcctatcatattcatatgcatttgcattttatatgtttggagatgagctttttaaggatgaaatgacagacgctcaaagggaaataaaacagaacttatttgaggatcaacagcaacagcttgaagcaaatgttgaaaagctctctaaaattttggaggagccttttgaaaccttttcagatgacaaggttgttgagataaggatgcagatactcaacctttctacaattattgacaaactttgtcaaaaaatgtatgaatgcatcgagaatgatctattgggttctctcaatcttggcattcatagtattgctccatacaagtcaaagggcattgagagggcatcagaactttcagtttgctggaacaacaaagtcaataatactgaaatcttactgagtgaaaaggattattgtatatatgctgcaagcgtaggtgtaacagaagaacttgatcgaccatctggatcagggagttcagaggatagtggatgctcttctcgtaagcgtcctagaaaagagggtcttggaggaggtggtttttttgatctaaacttgccagcagagtttgtagacagaaattga

SEQ ID NO: 30130 - DNA, 1110 bp, Glycine max
  Peptide Sequence Number=SeqID_121815
atggcctgcacttacacaactcaactccccctcatcaaggtttcaagaaggcctaagttgtttcatagatggtcatttttgcactctgctgaggccatacgtaagcaggaattttcagaatcgttgcccagaccatcaatccaagatgttagtactatattgatgggagctggatacgaggtattcttgaaaggaccatctttatatgcttttcaaggacttgctggtcgtctggcccctgttggagtccatatagcattgctactgataatggctggaggaactcttagtgcttgtgggagcttcagaggttcagtcactgtgccccaggggctgaattttgttgtatatgatgttctggctccttctggctttctatcctctccaaccgatgcttttaatacagagattcatgtcaacaaattctacatggattattatgagagtggagagtccttgcaaattgcaattgaattctgctgtgtattcacaacatttcagcctgaaaaggtttcacagttccacactgatctttcccttcgtaacatggatgggaaagaaacagattggagtatttccgctctgcaaattcttaaggacaatgaaggaccttataacttagctatggcacctctacagatcaatggagataagcaactttttggtacttatctaccggctggagatattaactctcctgacgttaagggaatatctatgcttgctcgtgacctgcagtcaattgtcctttatgataaggaaggaaaatttgcaggagttacatggccaaattcaaagctcccaatcaatattgatggttcagaaattgtcattgttgatgcaataggaagtagtggcttggacttgaagactgacccaggtgtgccagttgtatatgctggatttggtgctctaatgatcactacttgcatcagttatttgtctcattcacagatttgggctttacaagacggcacagcagtcttcattggagtgaagactaacagagcaaagatggaatttccagaggagatgaaccgtttacttgataaggtccctgaaatagttgagtcaagtctacctaagcaagctgatagcattagtggttag

SEQ ID NO: 30131 - DNA, 1806 bp, Glycine max
  Peptide Sequence Number=SeqID_121816
atggaggctttctccgtacaatcactcaccgccaccaccattccctcctctctgtcacgtagaggtgccactgacaaaccttctgccacctcccatgttaacctttcccatttcatgagtacgggtagtgcagaggggatttctgagaaaacagattccaaggatgacaacttagtatttgttgccggtgctactggtagagttggttcacggacagtgagggagcttataaagcttggatttagagtcagagctggagtgcggagtgctcagagggccggtgcattagttcagagtgttgaacaattgaagcttgatggtgcaagtggagggggacaagctgtagagaagcttgaaattgtggaatgtgatttggagaaaccagaaacaattggatcggcgttaggggatgcgtcaacagtgatatgtagcattggtgccagtgagaaggaagtttttgacatcactggaccctttcggatagattatcaggccaccaaaaatctaattgatgctgtcctagtttggaaaaggaaggcagaagaagcactgctggccagtggacttccatacacaatagtgagacctggaggtatggaacggcctactgatgcttttaaggaaactcataatataaccctatcaacggaagatactttatttgggggtctggtgtcaaaccttcagattgctgaactcttggcagtcatggccaaaaatcgtgatctttcatattgtaaaatagtggaggcaattgcagagacaactgctccactgactcccatggaggaacttcttgcaaagataccttctcaacgtccttacatttcttcacccaagaaaccagatattgcagctgtcagtgttccagatccccctgctaatgttgtgactgtggaacctaaagttgccactcaacaagaaactgcacaacctaaaccagtggcaaaacaaccactttctccttatatcgtttatgatgatttgaagccaccatcatctccttctccatctcagcctggtggtgggaaaccaacaaagatcagtgagacagtgccaaaaccaagtgcttcagatactccaagtagtgtgccaggagtagatggcatctctcagacaacatcgtcatctaaagtggagaagcctctttctccttatgtagcatatcctgacttaaagcctcccacatcaccatctcctaatgcaccaactgtatcagtttccacacctgctgcagctggggtgccggagatagacacaatatcaagcaatggaccggcccaactttcagcagcagatgaaccaaaggaagaacatctccctgaacccaagtcaagaccactttcaccttataccatgaactatggaagattcggcaacaccttcaactgctttggcttacctcaatccttcctattgggacgaaaggttctcgaaggaggagcaatacgagtggttctaggattattcctattttcgccacttgattcaaccccatctggaactatggatgtattgttcgtggacagtggtaacccatggaatccaaagcctgaaactatatccaaggtcatggccacgttgaaaggtgttcacggggttttgaaagctggtggcacatttatctcagtaacttttggacagccacatttcaggcgccctatatttaatgcaccagatttcagctggtctgttgagtggactacttttggtgaaacctttcactattttgtctatgttctgaaaaagataccaagacttgaacacgagttgcaccaaatccccattccattggctgccttttaa

SEQ ID NO: 30132 - DNA, 1056 bp, Glycine max
  Peptide Sequence Number=SeqID_121817
atgactcttgatatccttcaaggtaaagatatgatatcctcaactttctcccagtctgtgattgcttttgatattatcgcctatggctgttcttacacccgtaagttcttgctttggagcaaagtatcaggctctagcaccattgagaattttaaggggtctgctgtgtctactggtgctgctttcaacagcatttatgattgcgagtttttagcgtcagttacagcaggagagcaacttcctttatctttggtgcttgatattgttccttcaagagaacgaatcttattgatcgcaaatcatagaactgaggttgactggatgtatctatgggaccttgccttgcggaagggatgccttggatacataaaatatatacttaagagcagcttgatgaggcttccagtttttggttgggcatttcacatactagagttcatcccagtgaaaagaaagtgggaggctgatgaatcaatcatgcgccatatgctttctacattcaaggatcctcaagatcctctctggcttgcgcttttcccagaaggcactgatttcactgagcaaaagtgccttcggagtcaaaaatatgctgctgagcataagttaccggttctgaaaaatgttttacttccaaggacaaagggcttctgtgcctgcttgcaagagttgaggagctctctcactgcagtttatgatgtaaccattggctacaaataccgctgcccatctttcttggataatgtctttggggtggatccttctgaagttcatattcatatccatcgcttcccccttgacagtatcccggtatctgaagatgaaatttccatgtggttgataaatagattccagacaaaggatcagttactttccaattttcaaactcaaggtcagtttccagatcaagcatcagaaagggacctctctgctgttacgagcattttaaattgtatgacaattgttacagtgacagtctgtgcgtatttggttccggccacatatttcaatactcggccgcagcccattcttagctttttgaagatgagagcaaggtag

SEQ ID NO: 30133 - DNA, 741 bp, Glycine max
  Peptide Sequence Number=SeqID_121818
ttcaatggtcattgcaagaaagttgttgatttgaagaaaaacggttacatgaagaatgatgtcttgattaatgcatgtcatttggaaggaagcaattttgctttagagtatacatggagactattgaaatggttagaacaatgcatagatactagttcaaaaagaataaagctttctgatatcaaggattactcattgccaacaacaactgggtttcagaaagtgatacacacaaatcatccacccaatgggacaaagaacggtgaaggggaaaggagttgcaacctcttcaccgattgtgcacttgtttggcatggaagatgcaatcggggaaaaaatgttgtcaacaaaagaacaacagaggcaaaggagacgaataaagtaaaggtcttgtatgaaatcatgatgaagaacacatctatcatgtctgaagatcaaatttcactctgttcgacgtccattgccaacgtctcgaagctttcagaatgtgcgatggtgccgaccaccagcgtgagatttcgctgccaccggatatggcatggaactcaatctcatttctgcactattcgatcttattggcgtcgtgctagaagtactggcggaagactcctgcttgtccttcttcttgattcggaggacgagagcatcggcgtcggtgtctttggtccaataaagcttggcaacagtgaaggtttccagcaaggtgtgattagagtggaggtggaggaagatgtcatgtga

SEQ ID NO: 30134 - DNA, 243 bp, Glycine max
  Peptide Sequence Number=SeqID_121819
atgcgtgtggatgtaggagtggtggtggttggaggaagaggaggtgaagaggaggaagatgcaaggaggaaaaatagaggagaattgggagagaggaaagaaggaggaggtgacggagaatttgcgcatggaggggtggaggggggagcggtggcgggcagagaaacaaccgaggaaggaggaggaggtaagaagggaataggggaggacaatggcagtggagttgtggaaggaggggtttag

SEQ ID NO: 30135 - DNA, 375 bp, Glycine max
  Peptide Sequence Number=SeqID_121820
gccattttggatgaaaggctaccaccattattgttctatctacagtctgtggagatgtgtactacagaaactgctgaagaaaaagaacaaagaagaaaacagcaaaagaagatagcatctaagagatcaaggatgaagataaagatggaacgtgaaaagttaattgattccttggagagtcttgatgatgaaaaggctgcgctcagggaagagcttcatgaccgtactattgagtgtgagaagatcgaaaaagaaaacaatgccttactggcagaactcattgaggaatatggtgaagaaacaataatgaaccttctgaatgcacagtctactgactcagttgctggtggtggtcaaggctcaaaaaacagttga

SEQ ID NO: 30136 - DNA, 225 bp, Glycine max
  Peptide Sequence Number=SeqID_121821
atggagagtgtaaggaaaccgagacaggacagcgtacaccaccatacccccaaccacagcattcagtcaataacgcaaggcatgacctatgccctttacgctagcgagcccctccaccgcatgatgggcagcgacgaatgctctcctgactggcaggtgcaattctacatgtccccttacgcctgcacccaatcatgctccgcgagttcagctagtattttttaa

SEQ ID NO: 30137 - DNA, 288 bp, Glycine max
  Peptide Sequence Number=SeqID_121822
atggctgcgaaggttatgttcggcgcactcgatgacgtttttgccaacaccaaggtcaagccaaaggacattaagatcgcccttgtgaattgcagcttgttcgatcccaccccttccctcactgctatgattgtcaacgggtacaagatggggggtgacgtgagaaccttcaacttggggggcatgggttgcagagccattgatcttgcaaaggacatgcttcagcttcacgggaacagcagagccatgctgataccaaattgtcatgataagcaccatgattcctga

SEQ ID NO: 30138 - DNA, 213 bp, Glycine max
  Peptide Sequence Number=SeqID_121823
atggatcaattacgtaataatgtgaatgctaggtcgttgcccggaagcaacgtgctgtatggctcgagtacagtgtcaaaagagaaaaatcagatcaagaaatggggtagggattattgtgaacaaggagtggaagaaggatgtcgtagatgtaagaagagtaagagatcgtatcatagccttaaaattggtagtgggacaggacacctttaa

SEQ ID NO: 30139 - DNA, 1080 bp, Glycine max
  Peptide Sequence Number=SeqID_121824
atgttgcattgtctcaacacttcctgttcggacatcacagtcttggaaagacaacgggaagcaaccatcaagtgccagaaccaccaaccaccctacttaacggactttaacgccgtcttcccttcttcttcttcttcttcttcttcttcctcttcttcttctcatagtcagggcttgctcatgatgtgctcggattcctcgctcggccaggtcctaactcactccgtcaaacccgatccgggcgtctggcccgaattcggttttctacccgccatttcgagaacttgtagcagagacggagacttggtttcgcccaaggaaaacatggccagtgggaaagaaaatgctaagaagagaaagcctcagaactccaaggttgttgcggagattgataataacaaggacaaggacaagagagtcaaagtaactggcgaggaaggagaatccaaagtaaccgagcaccataccagaaacaagaatgccaaatccaacgcaaataagaacaacagagaaacctctgcggacacttccaaaggctccgaggttcaaaatcagaaaccagactacattcatgtccgagcgcgtcgtggacaagccacggatagtcatagcttagctgaaagagtaaggagggagaagattagcgagagaatgaagtatttgcaagatttaataccgggttgcaacaaagttgcagggaaagctggaatgcttgatgaaattattaactatgttcagtctcttcaacgccaagttgagttcttgtcaatgaaattagcggctgtaaacccaaggcttgacttcaacattgacgaactgtttgccaaagaggtgtttccttcttgtgctcaaagttttccaaacatagggattccctcagatatgagtattagtaacaacccttcgtatcttcagttcaattcagcgcagcaacttcaaattctaccctcctcaaattgggaaggtggtgatttccaaagcctttacaacgttgcttttgatcaagggcgaacagcatcttttccccctcagccatttacaggtctagttgaagctagcaatctaaaaatggagatgtaa

SEQ ID NO: 30140 - DNA, 975 bp, Glycine max
  Peptide Sequence Number=SeqID_121825
atggcagcctctcaattgaacacaaaatccaatttccatgctcgttcaaacagcttaccctctagaccacaccctctcatcctacaatgcaatgagcacttggaaaggttaaggtcttccaatgaagcctcctcttcctcttcatcccttagccataagctaggagggttgcaagatctgcatgaatgtgttgaaaatttgttccaactttccctcacccaagaagcacttcatcatgagtgtcaagaaaactgggtagatgagcttctgaatggatccttaaggctcttagatgtgtgcacagccgcaaaagactctctactgcatacaaaagagtgcatgcgagaacttcaatcaattatgagaagaagaaagggaggtgaagtggagctcaaggcagagattaagaagttcttgacttcaaggaaggtggtaaaaaaggccatctcaaaagccttggcaaatttgaagagtactacaaaaagttgcaacatctcatctacaaacaaagacaatcaattgattagcttattggagaatgtggaagtggtcactctatcaacatttcaggcattattgcaattgatctcagggactacacaatcaaagtcaagcagctggagtttggtttccaagctaatgcagagcaagaaagtaagttgctcacaattagcagatgaaaatgaattttcccaacttgatgaagcattgcaatcctacatgttttcccagacaagtaaatttgaaaacatgaataagctgcaaacccaattggagaaagtggagtcacttgttcaagatcttgaagaagtgagcaatgataatttcgtgactcaagttattcaaggcaaccctacaaaattacataacaggaagcttggaagagagttgaagaactggagcagcgcgcttagcacgtcaacatccgctcaacgcgaggagccaacttggaggccaggcttagtccgcatctga

SEQ ID NO: 30141 - DNA, 777 bp, Glycine max
  Peptide Sequence Number=SeqID_121826
atggaaacaagcacaaagaactctcttcacattcggtgcaacagtttaccctctgcacctcacccacttgtatcacaattcgacgagcacttgcagagattgaaggactctgaagccaccatcacttctttgtcatcatcttcaataacccaaaaactaattggcttgcaggatttgcatgactatgctgataagttgctccagttgcccacaacccaacaagcctttggacacaaatgcagtgacaagtgggttgatgtcctattagaagggtctctggggcttcttgatatctgtagtacagcccaagattgcctcttgcaatcaaaggaaagtgttcacatggttcagtcagtaattcgaaggaagtgccctgacactgaattcgcagttgagggtggaaaatacttggcatcaaggaaaaagatgaagaaggcaattcaaaaggccttaggcaatttgaaaggaatgaaaaatgagttaatggattcttcctcaagcaatgatagcgaggttttgtttatccttggcatcttaaaagaagcagaagcagtcaccatgaggttgttagaatctttgttgatgtttgtctctgacaccaagggacaatcaaagcagagaagatggtcaataatctctaagctgatgcagtctgatagaatgacttgcgactctcaagaatcagaaacaaatgaatttgcaaaggtgttgaacacctttcaaggaaactcattagaacaagagtttccctacttaacatcttcagccactagttag

SEQ ID NO: 30142 - DNA, 411 bp, Glycine max
  Peptide Sequence Number=SeqID_121827
atggagatgtcttcaggacataatccatctttcacgtggcgaagcattgtctcttttaaggtggtcttgaaggaatggttttggtggaagctaggggatgaggttagtattgatgtgtggaagcaaccatggttgaggtctactaatatagcttatatccagactcccatgtacccagacatggaacatttaaaggtgagtgacccattgataatcattcgggctattggaataatcctctcattgatcattcatttgaggcagatgatgtgcaagctatccaacgtgttcctatcctggatagatcaaagagagataattaaacacacatgggcacattccaagtgtggtacgtatactgttaggaatgcgtatagaattattccgcaaaagttcactaattataatacg

SEQ ID NO: 30143 - DNA, 312 bp, Glycine max
  Peptide Sequence Number=SeqID_121828
atggattttgctacaaatcagaagaagaatattccctccctatgttctataaatttgaacaaaaacaactacatgttgtgcaaatctctcctgtcattaattaatcaaaggaagggaggtcatggcacggacgaggagctacaagaaggagtattagtcgccagcaacatcaaatttgaagaagctagagatgaaaatcatagggctggggctaggccaatatcgacgaagaagaagacatcgagggagggatgcaaaggtggtgccttgttggagtcgacactgagagtagaacactttcaaggattttag

SEQ ID NO: 30144 - DNA, 3555 bp, Glycine max
  Peptide Sequence Number=SeqID_121829
atgtatccaaaacggtcaggccaagatggccctgattccagacaggtgcgctcaagtgataggatcaagacaaggccaaacgtttatggccggccatatttgtattacaaccaaaaccttaggcgcaccaggaaaagcaagatcaagacaaggacggcagcttcacagattgctaagatgttgcgtccggggaatcgaaaatcaaaagattctaatactaattctggctctgccaaccttcgacgttcaacaaggaaaagaaggcttaatgtaaatcttgaagattttacggacagctctggagctgaagacgaagacttaatggtgagatatgaggccatgtttcagagaccacctacatatccatcattgagaaaccggatgaaaaatagtgacagacgggatggtttgatgtctaataagcgcaaaagagtggcggagactaaacaaacacctcgacgtgaagggctgcgtcctcgccgttcaaagggtgctgcaatagaacgattaattttagaatcagatgatgagcaagacctttcagaagaaaaggttgatcaggatgaaacagaaaatggaaatgatgttgaggaaaatgatgcagatgatggccaaaaggagattgagggggatgctgagggggaagatgaaggtgaggacgaaggtgatgaagatggggatgatgaagagggtgaagaagagcaggatggaagaaggcgctatgatcttcgaaatcgttcagatgtccgcaggttctctatggaggaagggaaggcccagccaagatctcctcgaagagtgttacatcaaggtatgggaactaaggtcagcagggatgtaaggaaaggtggatcacgagttcataagcgtcatcgtttagcgaggcctgaagattctgatgactcccttcttgtggatgagctggaccaaggcccagctattccatgggggcgaggtggcaacagatctggtcctccttggctatttgggggcttagacatgcatggaacaacagctttcggattaaatcttgctgcatcaggttggggtcatcagggtgatgcggtggctactctaacttcggggattcaaactgctggaccaagctctaagggaggggcagatatccaacccttacaggttgatgatagtgttagttttgatgatataggtgggctctccgaatacattgatgctcttaaggaaatggttttctttccattattgtatccagatttttttgcaagttaccacataactccacctaggggggtattgttatgtgggccccctggcacagggaaaacattaattgcaagagctttggcttgtgctgcttctaaagctggccagaaggttagcttttatatgcgtaaaggagcagatgtgttaagcaagtgggttggtgaggctgaaagacaattgaaactactctttgaggaagcacaaaggaatcaaccttctattatcttctttgatgaaatagatggacttgcacctgtgaggtctagtaagcaagaacaaattcacaattccattgtgtccactttgcttgctttgatggatggtcttgactctcgtgggcaagttgttttaattggagctaccaacaggattgatgctattgatggagccttacgacgccctggtagatttgaccgtgagtttaactttcccttgcctggttgtgaggcacgtgccgagatattagacattcacactcgtaagtggaagcatcctcctccaaatgagctgaaaaaggaacttgcagctagttgtgtaggttactgtggtgctgacctgaaggctctttgtactgaagctgccatccgtgcattccgtcaaaaatatccacaggtttatactagtgatgacaaatttgtcattgatgttgattctgtcaaggtagaaaagactcattttattgaagccatgtctactattactcctgctgctcataggggagctatcgtgcactctaggccattgtctctagtagttcaaccatgtcttcagagacatttagagaaagccatgagtattatatctgatattttccctccagcttcaattacatcagagttgaccaaactttcgatgctctcctacgggtctgcaattccacttgtgtatcggcctaggcttatgctttgtggtggtgaaggtacagggctggatcatcttggccctgcggttttacatgagctggaaaaatttccagtacattcattgggacttccatctcttctgtcagatcctagtgcaaagacaccagaggaggcattggtacatatatttggtgaagctagaagaacaacaccatcaattctctacttaccacaatttgatgtttggtgggagactgctcatgaacagctcagggctgttctcctgactttgctagaagaattaccatctgacttgcctatcttactgcttggtacatcctcagttacacttgctgaagttgaggaagtgcccacttccattttccctcatcgctcaatttataaagtgaatatgccatgtgccaaagataggactttgtttttcaatcttttgatagaagctgctatgtcaatattgttggagggaatcaacaagaaatctcaggatgcaggatgcctccctgaacttcccaaggctccaaaattggctagtggtccaaaagtgtctgagctaaaagcaaaggtggaagctgagcaacatgcacttcgtagattgcgaatgtgccttagagatgtttgcaaccggattctgtatgacaaacgatttaatgccttccattatccagtgacagacgaagatgcaccaaattatcgttcaattatacagaacccaatggacatggctaccattctgcagcatgcttacaatggagaggattacaatggtgctaggattgttagtagagcttgtgagctccgtgatgcggtgcatggaatgctctcacagatggatccagcactggttgcatattgcgacaagattgctagccaaggtggcccagttcagttgtctgatgaattaggggattctactttccctgctactcctgttgtgcagctgggtcagagtactagaatgagtgctcgacttcgtcatgtccaaccagaggttaatatggatcagagttatgaagtattgaagcgaactaagaagattgccgaagtgcatgcagaagaaaagtcacaacaagattcggtgccatcaaagtcttccctggagcagcaggcaaatgacacaaattctgaaaggctggaacatgtgtcaattgaaggagatttgcatggaacttttacaaataaccttgctgatggcaacagtcctgatgatgtcacagtgctagacggtgaatttttaggagaagtagagtctgtcaagcagctttttgtgaagcgtagtgaaaattacagcattccacaacttgaaaggctttacacgagaattatgaagggcgtgtttgaaaccaaaaataaaggagtgagtggggatcttaagtcttcggttttgaagtttctgttgaattttgtagaggatgatgcaaatttctaa

SEQ ID NO: 30145 - DNA, 2391 bp, Glycine max
  Peptide Sequence Number=SeqID_121830
atgggggttatgtccaggcgggttgtgcccgtctgtggtaacctctgttgcgcctgtcctgctcttcgggcaagctccagacaaccggtgaagcgttataagaagttgctagctgatattttcccacgctatcaggaggctgaacttaatgatagaaaaattggaaaactatgtgactatgcttctaagaatccactaagaattcccaagattatatcagtgactttggagaattacccgagtctccattctaactccagacctgccaatgaagataaactgaattcagagtccctggacctgttagtacagggaattcccaaagtagaagaccctttaacagatatcactaagaaggatcctttgttgctgaaagctgtgactggaactgagatagactgtgtgttggatactgctaaagatcctacatattggtcaaaggtttgcttgtataatatggtcaaattggcaagggaagctacaactttacggcgtgtccttgagcctctttttcactattttgatactgaaaatcaatggtcttctgaaaaaggagttgctgctcatgttttgatgtacttagaatctcttttagcagaatcaggagataactcctgtcttctgttgtccattttggtcaagcacttggatcataagaatgttgctaagcagcctatccttcagattaatatcattaacactacaacaaaacttgcacaaaatgtgaagcaacaggcttcagttgcaatacttggtgcaatatctgacctcattaaacatttaaggaagtgtctgcaaaattcagctgaagcttccagcattggaaatgatgggcttaagctgaatactgaactccaatttgccttggaaatgtgtatattacatttttccaacaaggttggagatgttggacccattcttgatttgatggctgtggtgttagagaatatctcaagtacaaccatcatagcaagaacaacaatctctgctgtttatcaaacagcaaaattaatcatgtccattcctaatgtatcatatcacaaaaaggctttccctgatgctttgtttcaccaattgctcctggcgatggctcatcctgaccatgaaacacgagttggagcacacagcatcttttctttagtgcttatgccatctccattttctccccagttagaccaaaaaacaaaggggtatcagaaggtaccaagcgaaagcttctccattcagcatgaaagctttttaggagcagaacagatcaatgggaaacctatggaaggaaaggcagtagttggtgttagtgggaaatatgcagttcatccatatcatggtcacatcttttctggtgctctaactgatggaaaacatgagctaagttcttttcggttaagcagtcaccaagtgagttttttgctttcttcaatctgggttcaagcaacatctgtggagagtggccctgcaaattttgaggcaatggctcacacttatagcattgctttattgttcactcgttcaaagacatccagttacatggctttagtaagatgtttccaattggcattttccctcatgagcctctctttggaccaagaaggaggtttacaaccatctcgcaggaggtctctttttactttggcatcgtacatgcttatattctcagccagggcaggcaatttccctgagctaattcagaaagttaaaacttccctgactgagacaactgtagatccttttcttgagttgattgatgatgtcaggctgcaggctgtttctagagaatcagagaacataatttatggatctcaagaagatgatgtttcagctatgaagataatgtcagcagtaaaattggatgacaaacagttgaaagagactgtaatatcatgcttcttgactaaattttcaaaactatcagaggatgagttgtcaagcataaaaaagcaacttgtacaggggttttcccctgatgatgcgtatccactgggacctccattgtttatggagacaccagggaagtcttctccacttgctcagattgagttcccagattttgacgagattgtggctccattagctttgatggatgaagagacatggcccaaatcaagtggaagtcagtcagatcataaatcatcactatctagcaatagcccggacattctaagtgttaatcaactcatacaatcggttttggaaaccgcacgacaagtggcaagtttccccatttcctcaactcctgtatcttatgatcaaatgaagaaccagtgtgaggcacttgtaactgggaaacaacagaaaatgtcgattcttcacagtttcaagcaccagcaggagactggggcaatagttctttcaagtgaaaatgaaataaaagtttcccctctgccaattaag

SEQ ID NO: 30146 - DNA, 579 bp, Glycine max
  Peptide Sequence Number=SeqID_121831
atgtctacaaacaagacagtccctcttctcagtcccaataaccttcaggcattgcaaggctcgtatcgaattgatgggcgcaactacctccaatgggcccagttggttcgcactactctcaagggacaaaagaagttgaactacatagaaggagaacctccagcccaaacagatcctaaattttgggcaaagaaaaacttccttctttctcagaggtgttctacactgtacgaggagaagaaactcggaaggtcagtaatgttggaaggaagcagttctgttgatggttcagccttagctactggaaagggttccacaaaaggctcatcctcttcatttgggaagcttcttgcaaaggctaactgtgatgatcactggtgcagctattgtaggaagccaggtcatactaaggagacatgttttaaacttcatggaaaggagaaggtacttgagcgcatcggaggattcagaggtgccacacaaaggtgtgctaatcaagcaacatctgcttccgaaagtgtagaaaacacacttatcccacaggctgaaaaggagatcctagctctcagcaaagcataa

SEQ ID NO: 30147 - DNA, 1254 bp, Glycine max
  Peptide Sequence Number=SeqID_121832
atgagagacagcacagtgcaaaattgtcaccaaaataatagcggagcagtagaagcaggtgcaccttcagtcgagaaagatcttgcttcttcagtaaaagcagctactgaagttcctccatcctcttttcagttctatgtctggtcagatgtgggaattaatcttcatgttgatttaaatctgtcctcatcagattggattaacaggtttagaaatgaggtttgcataagtgagaatatgcatcgaaacaaatcccgaagcctttggcaggatctgagcagcttaggagagaattatatgcaaggtaaatcttcctttttatggagtaaaaattcttgtcaaattgaggatcatgatggacaggccagatcttcctcaagctctaaacttacaaaagatggtgctacagagtcaggtcaacagaataaagatggcattcctttgagatgtgattcttttactccatgcaacatgactatagaagtgaaagataatatactggaaaatcattcaactgtctcagctgaactaaatgtaaatgtggtagacaatttaatgcaagagcaatcaactgtctcagctgaggttagttgtgctatagacacatctaagaaaattattgattcagatgctaccaatatgccattcatcaagtcactttgtgattctgttgtcaactcactgtcagatcctggcacactggaacttcaaaattcaaagcctgataatgaatgttctgagtattgtgctctgctaaatggttcttgctttgtgaaccctggtgtggtgtgtgctggagcttcattaagtagttctgtgggactacaaaattcagaagttataagttgtcataaatatgaatcagtttcactctgtgacaatgatggttccctggatttaagtgatccaaagagtacttctgacatggaacaggatagactagtcaaaactcggattatttttgaaactgacagtaacaatttcacatcagtaactgatgaatgggaggtggacaagattgttgatggaagggagagttcagaatgctcccagtttgatgatccacttaagaaatccagcctagactataataatcaggattctaaactggagctctgcaaaaagagaaaaaaccgagactctgagattcaatgttcaaatggtgaacctactactacaagagttttgcggagcatgaagaatactgctacaagagttttacgaagcatgaagaatgtgaagcttcctagataa

SEQ ID NO: 30148 - DNA, 954 bp, Glycine max
  Peptide Sequence Number=SeqID_121833
atggccttatggcacggggttaagggtttcctgagtgaaattcgtatcatctacgacggcattagtattattcacgctggcattgcgagctttggttcagatgaatgtgctcgtatttgtgttgcttattctctatctttaggaaagaagtgggttttgcgtgtggccagatgcgagacaactttgcttaaggaaaggtcttctgttccatgtcttagggacaattatgcatatcttttacacgatgtggatacggggacagttggtgttgttgatccttccgaagctgcgcctatcatagatgcgttgagcaagaaagatttaaatttgacttacatactgaacaccaaccaccatcctgatcacactggtggaaatgcagagttgaaagaaaggtatggggcaaaggtaattggttcagaaatagacaaggaaagaattcctggtattgatatctatttgagtgatggtgataactggatgttcgcaggccatgaagtgcatatattggccacacctggtcacaccgaaggtcatgtaagcttctactttccaggttctggggcaatttttactggagacaccttgttcagcttatcatgtggcaagctcttagaaggaacccccgaacagatgctatcttctcttaaaaggatcatgtctttgccagatgatacaagtatttactgtggtcatgaatataccttgaacaattcaaagtttgccttgtctatagaacctgaaaacaaggaacttcaatcctatgctacccatgtatctaaccttagaaataaaggcttgcccacgattccaactacgctgaaagtggaaaaggcttgcaatccattccttcgcacatggagcatagaaatccggcaaaaactaaatattgcagccacggcagatgatgcagaagccctgggtgttatccggcaagcaaaggataatttttag

SEQ ID NO: 30149 - DNA, 3687 bp, Glycine max
  Peptide Sequence Number=SeqID_121834
atggctgtcaacgacgccgatcaatccaataaggctcatagaactcgtcaatctggtgccaaaaccaacaagaagaagactaagaagaagcagaagctgaatcccgatgacgtcggaggtgaggatccgaagaagcaaaaccctaaggcattcgccttttcttcctccaacaaagccaagcgcttgcaatcacgcgccgtcgagaaagagcagcgccgcctccacgttcccgtcatcgaccgctcctacggcgagcctgctccctacgtcgtcgtcgtgcagggccctcctcaggttgggaagtcactgttgataaagtctttggttaagcattacacgaagcataatttgcctgatgtgagaggtccaattaccatcgtatcagggaagcaaaggcgggtgcagtttgtggaatgtccgaatgatatcaatggcatgatagatgccgcgaagtttgccgatctagcacttcttcttatcgatggaagttatggtttcgaaatggaaacctttgagttccttaacatattgcaagttcatgggttcccgaaggtcatgggggttctcacccatcttgataaattcaaggatgcgaaaaagttgaggaaaacaaaacagcgactcaaacaccggttttggactgaaatatatgatggtgctaaactattttacttatcgggccttattcatggaaagtatgtcaagcgtgaagttcacaatcttgctcgatttatttcagtcatgaagtttcatcctttatcttggcgaacttcccactcttatgttatggtagatcgttttgaagacatcactcctcctgaaaaagtgcacgcaaataataaatgtgacagaaaagtcactctttatggttatcttagaggctgtaatttgaaaatgggcaataaggtgcacatagcaggagtgggtgattatagtttagctggtattactgctttacctgatccttgtcctcttccatctgctgcaaaaaagaaaggactgcgtgataaggaaaaattattttatgctcccatgtctgggcttggggatcttctatatgacaaagatgctgtatacataaatattaatgaccaccttgttcaattctcaaaagttgatgatgaaaactctgctatgacgggcaaaggaaaaggcagcgatgtaggggaggatttggtgaaatcactacagaatatcaaatactcaatcaatgaaaaactagagaacagctttatcaatatttttggtcaaaaggcaaatgtgtcatcgggagctctaggtgatgcacatggcacaaacaagaatgttgaacagaatgacaaaacagaagctttggataaatatcagcctgggactggtgaagataataacaaaacggatttggatgtttcagaatcatctgatcgggatgaagatgatgccactgacagcgaagcctctggttctgatgaagacaaagatgcaccaaatagtaatgctaggaatggagtccacttgcaagaacatattgattttcaagatggaagatggaggagaagagcaatatttggaaatgatgttgatcaaaatgatctgatggattcagaaggggatgaggatggtgctaccagtaatgatgatgtagaatcttcagaagaagaggaggaagatggcaatgataatgatgacacaaatgaagatgacacgggtaacgtttccaagtggaaagagtctttggcagaaagaactctctcacggaaaactcctagtttgatgcaacttgtgtacggggaatctactattaattccaccactataaacagagagaatgataatagtggagatgaggaaagtgatgatgacttttttaagcccatagaagaagtgaaaaagctaaacatgagagatggattgaatgatgatgggatgttcaacactgaggattgtgcgaagtgtacacaatttgtggttcagagatgggatgagaatgataatgaggagattcgcaaccgatttgtgtctggcaatgtggcaaaggctgcacttagaaatgctttaccggcagctaatactgaagaggacaatgatgacgtctatgctgactttgaagatttggaaacaggagaaaagcatgagaatcatcggacagatgctgcttttgctgcaacaactcacaagggagatgatttagaagctgaggagcggaggctcaagaaacttgctcttcaggaagatacgggtaatgaaaatgaagtcaagttccatcgtggtcaagctaatgaaagtagctattttgacaagttgaaagaggagattgaactccagaaacaaatgaatatagccgaactcaatgatcttgatgaggctactcgattggagatagaaggcttccaaacaggaacatatctaagattggagattcgtgatgttccttgtgagatggttgaatactttgatccctaccatccaatattggttggagggattggtataggggaggaaaatgttggatacatgcagctgcatgccaggatggtctgcataggagttcctgttgatgctgaagagacaaaacattttctctgttttgtgaatggtaacatggaccacctatatgccaggttaaagcggcacaggtggcacaagaaagttttgaagactagagacccaattattgtatctgttggatggaggcgttaccaaacgaccccaatttatgccattgaggatagtaatggaaggcatcgtatgctaaaatatactccagagcacatgcattgccttgctatgttttggggccctcttgctcctcccaacactggggttgtagccattcagaatttatcaaacaatcaggcaacatttaggattactgcaactgcagttgtacttgagtttaatcatgcagcaaggatagtgaagaaaatcaaattggttggttatccatgcaagatattcaagaagacagcacttatcaaggatatgtttacttcagatcttgaagtagctcggtttgaaggtgcagctattcggacagtcagtgggatcagggggcaggtcaagaaggctgcaaaagaagagataggtaatcaagcgaaaaggaagggagggcaaaccaaagaaggaattgctaggtgtacttttgaagacaaaattctgatgagtgacattgttttcctgcgtgcatggactcaagttgaagttcctcagttttataatccattgacaacagcattgcagcctcgtgacatgacctggaaaggaatgagaactgtcgcagaattgagaagagaacacaatcttcctattcctgtaaataaagattcactttacaagaaaattgaaagaaaacctagaaagttcaatccattggtgattcccaagtctctacaagcgagtctaccctttgcatcaaaaccgaaggatatatccaagcgtaataagccgttacttgaagagagaaggggaaggggtgttgtcatggaacctcgagagcgcaaagttcatgctcttgttcaacaccttcagttaataaatagtgagaaggtcaaaaagagaaagcttaaggaagagaataagaggaaagcacttgaggcagagagaaccaaagaagagcagttgttgagaaagcgccagagagaagagagacgagacaaataccggaaggaagacaagcagaataagaagattcggagagcagaggtttga

SEQ ID NO: 30150 - DNA, 279 bp, Glycine max
  Peptide Sequence Number=SeqID_121835
atggtgcccataaacgtgagtgctcaaaacattggtgatgacatcgtcacacaagaattcttcaacagcataatcgatcaggctgatgctagttgtgcagggaagaacttctactcacgagatgttttccttaatgctcacaattcctacaatgagtttggtaggcttggaaaccaggatgactccaagcgtgaggttgcagcttcttttgcccatttcacccatgaaactggacatttttgctacatagaagagattaatggagcagcaggggactag

SEQ ID NO: 30151 - DNA, 747 bp, Glycine max
  Peptide Sequence Number=SeqID_121836
atggggatggatgaattttttgccatgtccaagatgaggaaagcagatttggtgaaacgggtggtggtcattgccgtgatggctatgtttgttgcagatgcagctgatacaaatgatgtttatagtccatgtcttgatgctaaagttcagagaggagatggttttacatttggtattgcattttcggacaagcaatttttctcccaaggtaatggtccacagctttcaccttgtgacaaacgcctcgacctcgcgaacaaaggagcccagctttctgttttcaggccaacggttgatgaggtctccctactcaccatcaataggagcacctcaaacccgggcaacaatgcatatatggttgcatttgctgggcagaaatatgcagcaaggtcactacctattatgtttgctgacaacagtcacacaattactagtttcactttggttcttgaatttcaagagggaacccttcaaaacttgtattggaagagtttcggttgtgatggatgtcctagtggaagcatttgcctgaatcaacaagactgtgcagttccaaacaaagagtgtcaaaagaatggagggactgcctgcaacatgggaatacagttggcattttcaggcactgacaagaatctcgatgctcttaattcttggtacgaagtgcaaaatctacggcagtactccctctatggtctattctccaatcttcgtgactccatcattgggccatatgaaaatctcttttaa

SEQ ID NO: 30152 - DNA, 1401 bp, Glycine max
  Peptide Sequence Number=SeqID_121837
atgccgcacccttctttccacaagcttcttctaccctccactgtccaacccaaccaacaactgtggaatgctccttcttcagtctgtattactaacaattaccaatatttggaatctaacttgacttgtgaattgcagaggcttccagataattttatgaggaaatatgggggtgaactattgccaattgttaccctctctgttcctgatggtagtgtctggcgtgtaggattgaaaaaggcagacaacaagtattggttccttgatggttggaaagagtttgttaaacactattcaattagcattggatacttgttggtattcaaatacgaaggaaagtcatctttcagtgtccatatttttaatttggctacctctgagataaactatcaatcagccacgcgaagcagtaatgaagggcttcacttcacaaatcgtcttaaattatttgaagaaatagaagatgaagattccattgaaatctcggattcatcaccttcccaccttgctcccagttcattgcaaaatcaagctcttactggatcagtagataaaatgatgcctgggaagagttatacacctccagcattgcagaatctgttcaatggatctaaacttaatagcataaactggggagagggtggtaatgcccattcttcaagaattgccaattcactagataatcgattgaccagagacataggacttcagtttaatgcagtcgagtttaaaagatctactgaagaattgaaattgcgtgcttccatggaggaaaggatgaaaaaaactacaagaaagaagcgaaaatcagtttgtgcaagtgcagatggccaagatccctctgctgaacatgaagaggaggtagaaatgcgcttgagattttatgaaagtgcttctgcaagaaaaagaactgtaacagcagaagaaagagagagggccatcaatgcagcaaaagcatttgaaccacctaatcctttctgtcgggttgtcctgcggccatcctatttatataggggatgcataatgtatctgccatcctgctttgcagaaaagcatttgaatggagtttcagggtttattaaacttcagatctctaatgggagacagtggcctgttcgctgcctctatagaggaggtagagccaagttaagccaggggtggtttgaattttcattagagaacaatttaggggaaggtgatgtctgtgtgtttgagctgcttagaatgaaagaagtagtgctgcaagttactgtctttcgtgttattgaggatgtgggattgttgagccctcctttgcagcagaaccaaaacatgagctcggctaaaatgctgaacactcccttgcagcaacacctcacttcgactaaaatggttagaaatcagcagcaggttcattcctga

SEQ ID NO: 30153 - DNA, 1422 bp, Glycine max
  Peptide Sequence Number=SeqID_121838
atggcatatgaattgttaaagatggccatccccaaaggcaccactattggcttagcatctattattgtgattatagcattaattctccaccaaaccgtggcacaagctgtgtctcccaatggttccgttgcaaataatgtatcaaaacccattaagccggacaatactgttagagtagatccattagatcatttaaaaaaatacagaggaggatttgacatcaccaataagcattattggagtgaatatatggatatgcaattggggtgctttggcttttatgtggaatgggttgccagtgtgttagtttatgttgggagttcaaaattccattatcaagcaaggacttcagttaatgttataatcaagatagcagatgatgcatcagaaatcatacacaatgtaacaagagcattagaagacatccaagaaaacttggtggattccggtattagtgctgaggtttctgaaaatcttaactccacggctaagaaaatggataatgctgttgataatatcgtaaagaaaactaggaaaaataagcgcactgttaacagggctttcaaatttgtgtttataataaccattgtgatcataagcttgaatttagttgcagtaccaattttgtcaggtatgtctaactggtatgattctcataatatgttggaattttctgttgaacagtttttggagtacacatgttttggagggcattttacctgtaggtttgttatactgtgctggctgatggcggtgatatgctggctaatctttggattgtatttcttcttagaaaatttttctattgatacgtgcacagttctttgcaacttcgaagaaaatccatataataacagcctaacctccatcctcccttgtgacgaattgcgctcagcgaaagcaattctccctgaagttggtgcagggatctccttcctcatcactaaggtgaattcaaacttggggccaatgtttccaaataatgttgatctgtgcaaccctttctcagcaccacctaaatatttatatcagccagagttttgcccacctaatagtattcaaataggggatatccccaaggtattgaagccttatacctgttttggtgatagtgatgaaaattgtggcagtgatcatttaatgaatggaggtgaatataaggtagttgaggcttacacaagttcaactcagaacttattgaatatgtaccctggtatggaaaacttgataggatgcaagttggtaaaagatgcattctctcaaatccttttcaaacactgcaaggctttgaacaattttgctcgaatggcatgggtagctatggtgtttcttgcagtcatgatggtgttttatgttgtgctaagcacaataaaggcttgtcaagaccatagtagttatcatccttcagatgattctgtgtaa

SEQ ID NO: 30154 - DNA, 417 bp, Glycine max
  Peptide Sequence Number=SeqID_121839
atgtatgctggggagaggtttaaatgtgcgaagtttatcaatagccttcgaccagaagtgaagatgatggtgaactaccatggcatgcataactttgcacaattgaccaacatgcgtaggatctttcacgaggatcagcgagagaaggtcgcattctacaggaatgccaatgccagtcatgggaaaaagaagaagcatgtgactcacagttgtgctaagttgtattcttcccttcttgggcaatatgaagaatcaaacaaggttgcttcaaaggctaagcattgcttcaagattaatacaaggttgcttcaacaaacaaagccctgcttcaagattaactcaagatcaagccttgcctcaaaacaaagtgttttcaagacatccaaggctctggtaatcgattaccaggcaatgtaa

SEQ ID NO: 30155 - DNA, 1059 bp, Glycine max
  Peptide Sequence Number=SeqID_121840
atggcatcaaagaagagaaaggcacttgccacaccttcccaagtccgatatgaccgatctaggttcacttctcctaaggcttgggaaaggtacactgatattgtgttacccagaaagatactccttgagcaaaatgtggtaatctaccacactgagtttgatgagttcaaggaagaactagagagaagaaaatgggatgaggaattgaccaattttgatgaaggcagcattgatgttaccattgtgaaagaattctatgctaacctctatgatccagaggacaaatcaccaaaacagggggaaaatttatctgcttattccaggtttgcactcctaaggcctaatcctcaagagttggctactaagctctgcatcccagggaggggatttgagctgaatgctgatgatgatccaacagtgacattcagagggccaaggaaggctaggggtaaaggatctgaggctccccctacttcagcaacaccagatgcttctactccttcttcatctactttaccagatccttcagcactatccacttcgactccacatcttccacaatttccaattcagctcccagcttcttatgctcctgcattagatttcttgtttaccgtagagatgcttcactccatgatgcatagcctccatagaggacatgttattcttatgcagagttttcagagtctaggcctgccttctattatgcctatggaggatttccatgcacagggggggggggccttggcagcccaagaacttgactctgctaagccagtggaggagcacacagaggagcaggcagcagaggagccaactttagcagaggatgagctcattcctcttgagcccttttcatttgctgcaaatacatctatggctcaggaagaggagacttctccaaatcccatggcagagccattccttgcacctatatctgaggacaccatgctatcagcaccagccatggagccagagcagcccattcttcaggatgtaccagctgttctgatgttggatcttaatgagcatgcagaggactactcgcaggaggattga

SEQ ID NO: 30156 - DNA, 134 bp, Glycine max
  Peptide Sequence Number=SeqID_121841
atgatgacaaaaagcccaagagaatgacttcaagattgagtcaagaacaattcaagaatcaagagaaatttgatttcaagaatcaagaatcaagtttcaagtttcaagaatcaagaatcaagaatcaagaataa

SEQ ID NO: 30157 - DNA, 699 bp, Glycine max
  Peptide Sequence Number=SeqID_121842
atgccctcgccttcagaggactacacgtcctccccttcagagaattacgggtcctcaccttcagaggactatacgtcctcggcttcagaggactatagaggactacacgtcctcggcttcagagtgctacacgccttcacctttagaggactacatgtcctcgcctttagaggactgcacgtcttcgccttcagatggctgcatgccctcactttcagagggatacacaccctcaccttcagaggactgcacgtcctcatagggctacacgccctcacctttagaggactacacgtcctccccttcaaagggctacatgccctgacctttaaaggactgcaaatcgccgtcttcagagggcgacacgtcctcaacttcaaaggaaggcacgtcctcaccttcagagggctatgcaccttcaccttcagaggactgcaagtcgtcactttcagaggactgcacgtcctcgtcttcagagggctactcgtcctcaccttcaaaggactgcacattctcaccttcagagggctacacgccctcgtctttagaggactccacgtcctcgccttcagaggactgcatgtcctcgccttcagagaactacatgtcctcccctttagagggatacacgtcctcgcctttagaggacttcacgtcctcgccttcagaggcctgcacaccgtcgtcttcaaagggtga

SEQ ID NO: 30158 - DNA, 675 bp, Glycine max
  Peptide Sequence Number=SeqID_121843
atggcccagtctaactactctagactcaggttccctactcttattacggctctatatgatccaacagttattattaggggggccagaagaccaagggcaaggccaactgaggctccttctacatcagcagctcctcatccagcttctacatcagcagctccttctaccctacctcctacagattttcaacgtttcgaaaccatgctttggagcatacatcaggggcagattattttactacaaagcctacagctggtagtgcctccagactccatcccgatggtagagcaatttaatgaatgggtatcctggccagggactcaacctcctcttcatagggaagatgaagatctcgccgctcaggtaccccatcagtcagaggatgagtcatcagagtcttccactcctgagcccttgaacaggaagaggagggtagttgtaacccaagaagttgcagccacctctgaaaagtctcctgaagccactccagagcctccgacaccagtggcagataccacttctccacagcaggaagcagacccttccacgcctgaggatcaaaccacctcagtccagtctccgaacgcctctcctttagctactcctgtacttcatttgtcggaagatgaggaggttcggacacaggacaccctggaccaatcacaggacttttaa

SEQ ID NO: 30159 - DNA, 687 bp, Glycine max
  Peptide Sequence Number=SeqID_121844
atgaccggccatctcgatgagtcgatctcttgctttctcataaaggtggacccttgggtactagtacctatcacctttagaggactatatgtcctcgccatcagaggattgcacatcctcgcctgccgagggctgcatgccctcgcctttagagggctacgcgtcctcattttcattcctgggccaccccttgatattggagagcgaccaattgtgcgagcacatccagatgagggaggctatcagcatctactatgtaccgggagcgcccacaagattcgcccgtgggccctgaagaagtccaaccgggccctggggtttccagctctggttactgagcctctgtcagtccaacagggtgcccgtccccccaacgagggatcgcgcccacaagacacccagtggacccgaagaagtccaacagggccctggggtttccagctctggttatgggcctctgtcagtcctacagggtgcccattccccccagcgaggtcatgccatcgtgacataggaatcgcacccacaaagacacccagtggaccaggagaagtccaacagggccctggggtttccagttctgggatcacgcctgcaagacacccagtggacccgaagaagtccaacagggtcttggagttgtcaagctctaattacgggtctctgtcagttctacagagtgcctga

SEQ ID NO: 30160 - DNA, 215 bp, Glycine max
  Peptide Sequence Number=SeqID_121845
gtgtcgagggaaggagcccagagtatgaagaaccttgggatttgaggtcaaatcctttccaaggtggaggggatgatgcaatcctaccccccaaggctctagcttctcatctcaaggaggtgagcttagctattagagagcttctcaaggaagttttctcaaagaagcttctcaaggaatttttctcaagaaagcatctcaaggaagctacctag

SEQ ID NO: 30161 - DNA, 774 bp, Glycine max
  Peptide Sequence Number=SeqID_121846
gatttaggtgtgactatatcacttcctaagtctttagtctcagatgtgggtggcgctgagtttgctaagaagtttaggcttctttgtaaacttaaccacactaagtcgtctacagtcttacggctgaaggcgatttggttaaaggctaagctacctttcgagttgtggcttggccagtgctgtcctgtcgacccttatttaaaaggtcgattgatctggaagcttcaacaagctttcagacctaaggatcttgtggtgcctccaacgagtacttataagtctgagacttttgagtacttagaggatatgacacttctaagatcttggactgaagcctggctcaagtacgtcaggtggtattacgctactgctttatccccagatgtttccatcgaggattttatccaagctcctgttgttactactcgctctttccagcgagtaaagagttccacttctgacccgtttcggtctggtcagtcccaaggtgatcttgttgggtgtctgtttctgatcaagctgaactttctttgttggaagggagtgagaacctctttgatgctgaggttgcggctcatcgagaactgttgcggggagaccatagctgaggctgggcttgatcctaaacctctaactatcctaggttctaggttaggtggaagtgaaaagactaagggagatgcagattacagcattgctgattcagaggagattactgatattgtggggacaaatttaattttcatgacaggccctgttattgatctccttctg

SEQ ID NO: 30162 - DNA, 542 bp, Glycine max
  Peptide Sequence Number=SeqID_121847
ttgccaccaaggccttggaacaagagaccaagagggctcgtacagaagagcacgaccagaacaagttccgaggggctctgtggggcagcaacagcgagcttaagctccggagagaggaaagggaccaatcacgagtagatagtttgatcttgaaagatgagttgaaggtttgctcaaggtccaaaagaaacctgtctcagcggttatgcgagacagagaccaacatgttaactatcatcagcaagtaccaagaagaactaaatctagccacggcccacgagcatagagtggcggacgagtatgcccaagtgtacgcggaaaaggaggctagaggaagggtgatcgactcgctacatcaagaggcaacgatgtggatggaccgatttgctcttaccttgaacaggagtcaagaacttccccgattgctagccaaggccaaagcgatggcggacacctactccgcacccgaggagatccacggacttctcagctattgccaacatatgataaacttaatggcccatataattagaaaccgctag

SEQ ID NO: 30163 - DNA, 264 bp, Glycine max
  Peptide Sequence Number=SeqID_121848
atggaagctaaaaatgaatcactatttttggacgatggagacctcagccggcctatggcaagctgccacggcgtagcatgggtggtcgctaaaatccgtcactacatgatttctactactactctgttttgccacaagcaaaagtggtcgctaagtctgtcgcaaaacattattcacagcaaaacacccaaaactgaaacaggggaagcgcttaataggaaaactgaaatagaacacacactaaacaaaataccaggatattaa

SEQ ID NO: 30164 - DNA, 129 bp, Glycine max
  Peptide Sequence Number=SeqID_121849
atggtcactcctacgagcactgcttgctatctggataaagatgaagccggtcaatcaatagacataaagaaatatagagatatcaagcaaatcctaaagaatctcaccttagtaccattaaaagaataa

SEQ ID NO: 30165 - DNA, 375 bp, Glycine max
  Peptide Sequence Number=SeqID_121850
atggcacgcagcgtgtttgcttcgtgcccctattttatgggacctataaggagggaactaactaggcttttagcaataatccccaaggtagttatatctctcttgatggtttctagagtggagtcgccaactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 30166 - DNA, 255 bp, Glycine max
  Peptide Sequence Number=SeqID_121851
atggatttcagaaacaaagctaacaacaatgctctgggtcaaacacccatgtcactacatgaaagtgctgagagcattttgggttttacaaagggacatcattttgaaattccgattacgccaatgcgaccggggaagcataaaacatgcaatggcggtttccaaactcagaatgatgcaaagtggagtttcaatggaggaaaacggcgattcatggggctaatggtggctgtgggtgatggagaaagagcttga

SEQ ID NO: 30167 - DNA, 306 bp, Glycine max
  Peptide Sequence Number=SeqID_121852
atggtctctggtaatcgattaccacagggtgtaatcgattacaggcttgaaaacgaagtcaggaaactaagggagcctctgagggatgggtcactggtaatcgattaccagatcgtgatggcggcgcagctaatccatgatcgagtagagatggagtgtctagagggagcttgggagaccctcgaaggcaacacgaggtgccgatttcggggcaccattcgatttgcggctacttctttggtgcatccagacgaacctgcacggacgcttcagcgcacggtggagtggacagcctttttggattag

SEQ ID NO: 30168 - DNA, 118 bp, Glycine max
  Peptide Sequence Number=SeqID_121853
tgactacatggactggttctttcgcatcttgcatcctttcatgacaccaggccacgcatcagatcctttgccagatggtcatgccccgcaaccccgagtcgtccctcaggccccatag

SEQ ID NO: 30169 - DNA, 918 bp, Glycine max
  Peptide Sequence Number=SeqID_121854
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagagagtctctcgcctctccttgtgagggatctaggcgcgcaaagtctcaaggttatacaaagagtccacaaggcgtggagaagttcgttgaggaaagacaaggagcttaggggcatccgtaatggcgtcatcggtggttatcatggatggctaagagttcacacgcgagggttagattggttctccaagtttaaagttatcgatgaggagaacttcgaagctccggaggaagacgaagaagtccgagctctaaaattagagctagggaaggcaagactcgccaaggagaagttcaaatcagccactacacacatccggaaagagtgcaccgagttacaagaggaaaacacggccactgcaagagcccttgaacaagaaaccaaaagggcccgcaaggaggaacatggccgagagaattccgaggagcattgtggggtagcaacaatgagctcaagctccaaagagaggaaagagaccggtcacgggtccaagaggagtttggctcaacacttggaagccacagagcaaggcatgctagctatcatagggcagtacaaggaagagttgaaccagtctgtgacccatgaacaaaagctagtggaggattttgcacaagtgtacgccgaaaaagaagcaagagggagggtgattgatgcattgcatcaagaaacgactatgtggatggataggtttgccttaaccttgaatggaagtcaagacctcccgcgtctattagccaaagcaaaagccatggccgaa

SEQ ID NO: 30170 - DNA, 469 bp, Glycine max
  Peptide Sequence Number=SeqID_121855
atgatcggccctatcgatgagtcaatctcttataagggtggacccttagagggctgcacgccctcgccttcagaggactacacgccctcgccttcagagggctgcatgtccttgccttcagagaactacacgtcctcaccttcagagggttgcacgtcctcgccttcagaggactatacgtcctcccctttagaggactacaagtcctcgcctttagaggactacacatcctcaccttcaaaggaccactcatcctttccttcagagggctacacgccatcaccttcagatgactacacgttctcaccttcagagggctactcgccctcaccttcagaggactacacgtcctcgctttcagatgactacacgtcctcacctttacacgactacacgacctcgaccttcagaggactacacatccctcgccttcagaggactacacgccctcgccttcaaaggaatacac

SEQ ID NO: 30171 - DNA, 96 bp, Glycine max
  Peptide Sequence Number=SeqID_121856
ggagtgatggctggacggaatgatcgtgcgatagcggatgcgcttcaagccttagctcaggctatagggaatccgaatagaggagatttctggtag

SEQ ID NO: 30172 - DNA, 534 bp, Glycine max
  Peptide Sequence Number=SeqID_121857
atgggcatagattatgctataaggaaagacgaatcacctgcaatcactgatgacagtagcccaactactgttgcactatatgagcagtgggagcaatccaaccaactgagcgtgatgttcattaagatcaaaattttggttgagatacgtggttctatcaaccagcatgtaaaggttcgacacttgcttaaggttattgatgaccggttcatcacttcatataaggctttagcaagcatcctgatcatgaaattctcctcttttcggctcactagtgtgaaaggtgtgtatgagtacataatgcaaatgcaagacatttcagctcaacttaagaaactggaggaagaagaaaggcttgtaatggagatgggtgagagtgcattgttgacaactgcttgttggaagaacaaaacaactaagtctcaatctaatcataaggggaatggtaaaatgccacctcaagctaatattaagaaggtgacaaagtgtttcttttgtaagagagaagggacacatgaagaagaattgccctag

SEQ ID NO: 30173 - DNA, 192 bp, Glycine max
  Peptide Sequence Number=SeqID_121858
atggagtcaagaatgactaaggttgaagaagatatgatgacaaaggcgatgaacaaaaagctcaaagatcaaagaacaactcaagtgaatcaagaacagtcaagagttcaagaatcaagaaggattcaagatctcaagaatcaagatcaagattcaagaatgaagaaaagactcaatcaagataagtattaa

SEQ ID NO: 30174 - DNA, 254 bp, Glycine max
  Peptide Sequence Number=SeqID_121859
acaagggcaaaagaaaaagaaccgaggagcccaagaatgaagctgctaagggtctagcacaaaagaaacaaaatcaaggtgacaactgtttcttttgcacttcagtgtctagaaacacttggttgttagattctggtgccactactaacattggtgtttcaatgcagggttgcctaagctactggaagccaattgattctgaaagatggatctatgttggagatggtaaatcgatggaagtggaagctatatag

SEQ ID NO: 30175 - DNA, 720 bp, Glycine max
  Peptide Sequence Number=SeqID_121860
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccctgctgctgaacctgtccagccagctcgaagcggaactgagcagcgcccagatcaacctggacaagatccgcgcgctgggcaacaaggaccacttcatgctcaagcccgcggaaacgcaggtcgtggccctgaagaaacggctcgccagcgtgcgccagcgcctgagcggcgaaggcaacacggaagcgaaacaactgaaatcctacgaggcgctgcgcaacacccaggcctttgcggattcgaacctgacgctggcgcagcagtcgtaccagcaggccgtgaccgacgccctgcgcctgcagcgttacctgtccatcatcgcgcagccggtctccacggaccggcccagcagtccgcgcaccggcgtgctgctgttgcaggcgctggcgctgggcttcgtgctcatgttcgtcctgcgcgcggcgatggccttgcttag

SEQ ID NO: 30176 - DNA, 255 bp, Glycine max
  Peptide Sequence Number=SeqID_121861
atgacatgcgggggtaccttatggttatccacaccttttgtcaaccagaggaaggcgagcccgttgacacgcggagatttatgtcatcttccgcgtagactacctctgtcaagcactaacccagacagcaggtccaatgacatgcgggggtaccttatggttatctgcaccttttgtcaaccagaggcaagcgagcccgttgacacgcggagatttacgtcatcttccgcgcagactacctctgtcaagcactaa

SEQ ID NO: 30177 - DNA, 417 bp, Glycine max
  Peptide Sequence Number=SeqID_121862
attaaggtcatccgtacgttgatccgtaagacacttacggatcaacttgattcgattgtgggtgaaggtgtaagtgacatgaaagaaggggacttggtggtgccaatcttcaatggggaatgtggggattgcaaatattgcaagtgtgagaaaaccaacaagtgtgagagatttggggtggatcctatgaagaaggtgatggctagtgatggtgccacaaggttttctacaatggatggaaaacccatcttccatttcttgaacacttcaactttcacagagtacacggtggtagattcagcatgtgtcgtcaagattcacgttgatggtaatggtgaactcaaccaccacatcaaaagactcaccttactcagttgtggggtatcttcgggtaaggaacttggtcaacctcaataa

SEQ ID NO: 30178 - DNA, 804 bp, Glycine max
  Peptide Sequence Number=SeqID_121863
tggtggaagacctattccaattgtgttgatagaatgtggagcttttttattctatcacttcagtgtgtttgccttgttaaggctgcacatgtttatgtatggatgccaccagttcatgtggaagaacacaagaatcaattacatttgcttctaagggctgaaaacttttctcctagccaaattgatgccatttctggagttctgcttctgatgatgagatgcaatgatttgtttgagataaagattccatgccctcttgagtggggtgctcctacatttgatgctggccatgcttttggaatggtggttactgcatacaaagctgcatcacgtctaacaagtgccacaccacctcctgctcacgtgctaagccgtggtattggttggcaaggaattggaatcttgctgaatagcctttttggaacactcactggttctacagtttctgttaatacaattttatataaaaaggagataggcatatcaaagtatttttctgtaggggtctctctatttttctcaacgggaagcatctatatatatagtgctgaaagtgacaatgtgcagcgcacagaaaaactaacttccatcaaccagcagccacattgtgctcagacggtttccaacattatatatttggattcccctgctagtgttgggctctcttactccgagaacacaagcaaatatgccactggggatctgtgccactggggatcccctattcctatttctctcagctttgtcattttactcatttatggatataccaaggttctaatttctaaatggtcacaatgttaa

SEQ ID NO: 30179 - DNA, 261 bp, Glycine max
  Peptide Sequence Number=SeqID_121864
atggtcttaaaggaggagttagttgcttgctcaagatccaagaagagtttggcccaacacttagaagccacggagcaaagcatgctagctataatagggcagtacaaagaagagttaaaccagtctttgacccatgagcaaaagctagtagaggacttcgcacaagcatacgccgagaaggaagcaagagggagggtgattgatgcattgcatcgagaagcgaccatgtggatggaagtcaagacctcccgcgactactag

SEQ ID NO: 30180 - DNA, 297 bp, Glycine max
  Peptide Sequence Number=SeqID_121865
atgatcaataggaaacatatcatgcagcagaaacgacatcctcatgctcagtcattgattgtgtctgattcatcagaaagtgtaaattccgaatccacacaaggttcaggctctaattttttaactacctatgaggattgtcaatctccaactaatcagcctgtaatcaacactgaagataccagagcacatgctcttagattaatattcacaattgttatcgtcatattgtactatgatattaaacaatttcaggatattctgatcttggtgatctacaacatggggagcctctag

SEQ ID NO: 30181 - DNA, 1443 bp, Glycine max
  Peptide Sequence Number=SeqID_121866
atggaagctgataaaaattatcatcgaaataatgagttactattaatatcgacacatctgagatcgctaaatgttcaggagttcttctattcaatccttttccttctccttgttgctggatatctcgttcgtacacatcttctctttgtttctcgagtctatagtgagttacagacagagttcgaaaaggtaaaatctttgatgattccatcatacatgattgagttgcgaaaacttctggataggtatcctacatctgaactgaattctttctggttaaagaatctctttctagttgctctggaacaattaggagattctctagaagaaatacggagttttgcttttggtggcaacatgctatggggtggtggtcccacttatggggtcaaatcaatacgttctaagaagaaatatttgaatctcatcgatctcataagtattataccaaatcccatcaatcgaatcgctttttcgagaaatacgagacatctaagtcatccaagtaaaacaatctattccttgataagaaaaataaaaaacgtgaatggtgattggattgatgataaaatagaatcctgggtcttgaacagtaattcgattgatgataaagaaagagaattcttggttcagttttctaccttaacgaccgaaaaaaggattgatcaaattctattgagtctgactcatagtcatcatttatcaaagaataactctggttatcaaatgattgaacaaccgggagcaatttacttacgatatttagttgacattcataaaaagtatctaatgatttatgaattcaatacatcctgtttagcagaaagacgtatattccttgctaattatcagacaattacttattcacaaaccttgcggggggctaatagttttcatttcccatctcatggaaaacccttttcgctccgcttagccctacctccccctagtaggggtattttagtgataggttctataggaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgtgaatgagtcgaattacttatccctcggtcttttagtgaactatctctccagggattgtgaaagatgttctactagaaatattcttgttattgcttcgactcatattccccaaaaagtagatcccggctctaatagctccgaataa

SEQ ID NO: 30182 - DNA, 381 bp, Glycine max
  Peptide Sequence Number=SeqID_121867
atgagtcttcattcttcatctagtgttaatggtgagggttctagtcctaaggacctctttagtcataactcttgcaagagcctaagtgaagaacttcgtgactattatgaaggcaggaataagtcacatcttagacctcactctcataggagagaaaatgaaagaaagcctcaagaggctaacattaacctcccatacttccatgggaaggacaatgtagaggcttacttagattgggaaataaggatagagcaaaaacttaaaagaaagcctactttaaaatcttatggatctcattattatccaaagaaagaccaaggtctaggcatcttaggggcaacaccttctaagcccaaagatgataaggggaagacaatataa

SEQ ID NO: 30183 - DNA, 366 bp, Glycine max
  Peptide Sequence Number=SeqID_121868
atgggtaagggctggggtcctagcactgctggtgcagggtatactggtagaagttgtcgttcaactgcacatgtcccctatagttggttgcctgctggtcagccaaatgctacatgcagagctccatcctttgcatgtgagctgagatggactctagagatgatggctactatagaggtggcggtggtgtgtctgcggtcgacagctactattggtcttgccccgactgctgtgcctgccttggcatgcaatgagctttgtgggtgtaactggcaccccatagaactggtagagacctatgatcaaagctggaaatcccagtgctctgtgacttttctaggtccactaggtgtcttgaaagtctga

SEQ ID NO: 30184 - DNA, 963 bp, Glycine max
  Peptide Sequence Number=SeqID_121869
atggcagaatcatccaagaagtgcaaggtttcatccacctccgttgcggcacatagaacatcacgtcccagagccaccggagcatccccgacaccaattccaccatccttgtcatcttctacactattttcatctgatgaaaaatgtatccagtattcctctctctttcaatctcatcaaattcttgatcccaaatatcttgaccttgaattctttgatggggaaatatttgattgctatcaagtgtttcaaaacattggtttgattccttttatgtcattaaaattaccatattatcctgagttagtacgagtcttttactcaaatttgaaaattcaagatggaactttaatttctgaggtgcatggtatccctatgattattgatgaatcacttttcttttctctgacacaactacccaatcagggtgcaccttttgagggtacccttgttgacaacaaaaagtttgattactcctgtcatgatgcccgccgcatggtctgcattgaccaggtggatatgaccggcagactgcttgccgggtcattgacatttgattgtcgcatcatgcactatatcattgttagaattttgatgctccgttcttctaatctcgctcaagcctttgaggaggacatgattctgatgtgggctttcttgaccaattgtccaatcgactgggcccatttgattcgttaccgcatgcataaggcattgcggtctagtgcacctctaccttactctcaacttgtgactttgtttcttcgactttttgaaattcctttggattctgagccttttgtgcaagttaaacgttcctttgctattggtgtcgatgcggtaacttcctttggctactatgccattgatgcttgctttgaaggaatggatacccgcatcactcagcttgaagaggatgtgagttatcttcgtcggtgcttcgaccttccaccaccttcctag

SEQ ID NO: 30185 - DNA, 381 bp, Glycine max
  Peptide Sequence Number=SeqID_121870
aagctcctggctaagaagacgaagaagaagctggaggaagctgcacagtcaggaagtgttgatggcgtcatcgaccctccatccccggtcagacgctatgtgaagtggaagatggcccgcacgaagaaaacgggggagatgacgactgaggccgcaaaggaaatcgctgataagattgattcctttgaggagcaggccacacagaatcgttcgtcccccatggacatcaggatgttctcgtcgctgctattggacgtccagagcaccctggacgtgtctgtgctgctaaagtcggtgtcaccatcaagcaatactttggatcggctccacggacctctcacagcgcttcctctctgcctcttgacgaattgcagcagctga

SEQ ID NO: 30186 - DNA, 698 bp, Glycine max
  Peptide Sequence Number=SeqID_121871
atggaggctgtcatatccctcgcccaatactatgaccaaccgttgagcaagattgcagctgtggttggagattcagcaaaagagttggatcacatgaagcaaactcggaacggcgtagtgggcctacctcggaaatacttggaaggcaaggcaagggatatggcgagccaagagaagtggggcccgtttgcggatatactagctttattgatttttggggttgtcctctttccgaacgtggacggtttggtggacttagccgccattgacgctttcctcgcgtaccaccgtagcaaggagagtccagtggtggctatcttggcagatttgtttgatacctttgaccggagatgtgagaaaaacggtgcacggattgtctgttgtttacccgctctctgtgcgtggttggtttcacacctattccaacaagacacaagacacccgtgtccgcttcaaagctatcgctcatgcgccgaaaaaggaagagtcgattgggaccaacatttggctggaataggaggcaacacaatcaattggtttcctcgttggaaggaaggcaaggaaggagttcttttctcgcgcgcaaggtctcaaggttatacaaagagttcacacgcgaggaaagacaaggagcttagaggcatccgaaatggcgtcatcggtggttatcatggatggctaagagttcacacgcgagg

SEQ ID NO: 30187 - DNA, 223 bp, Glycine max
  Peptide Sequence Number=SeqID_121872
atggcatctaaggaatggaaagctccttctataccgacccaggtcagatttgatagatccaggttcacatcccaagaggcttgggaggggtatacagacattgtggtacctaggaagattttgcctgaaaggaatgtcattatccatcgcactaagttcgatgaatttactgaagaactcgagcatagaaactggcataaggagttgacaaactttatggatg

SEQ ID NO: 30188 - DNA, 270 bp, Glycine max
  Peptide Sequence Number=SeqID_121873
atgtttggtggcgactccacgcattttcctcccatggaagacgcacccgtgagccctcgcgtcgccctcccgctgaagggagaagttattgggcttagtgcgaaggtacgtgctgggcgagttctgcaactctcgcttagcgggccaaagccgtgcttagtgaataaaatgatcgttgaatgcaatagtggcccatgcttagcgtgttcgtctcgcttagcgctattccaaatagagaaggaattgggcttagcgagagcattcacttag

SEQ ID NO: 30189 - DNA, 246 bp, Glycine max
  Peptide Sequence Number=SeqID_121874
atggaccttttcaggtcatggagaggatcagtaataatgcctataggttggacctgtggagctgatatagaggaggaggaaccaacagatttgaggtcaaatcctcttcaagggggaggggatgatgcaatcctccctaggaaaggaccagttaccagagccatgagcaagaggctccaagaggattgggctagagttgataaagaaggccttagggttctcatgaaccttagggtagatttttga

SEQ ID NO: 30190 - DNA, 342 bp, Glycine max
  Peptide Sequence Number=SeqID_121875
atgacgattagtctctgcgtgctattagccttttcgtcttacagacagcaaaaagtttatacggataaccactcagacagcaaaaagtttatacgtataaccatctcgggtatttccgcccgtcagcgtgactcaaaagtaagtatgacagatcttgtgagcgcggaagatgacgttaaatctccgcgtgtaaacgggcttatcggccgcgatagacgaagggcgcagaagacgacgttagtctctgcgtgctatcaggcttttcgtcttacagacaacaaaaagtttatacggataaccactcggatattccgcccgtcagtgactcaaaagtcagtatga

SEQ ID NO: 30191 - DNA, 318 bp, Glycine max
  Peptide Sequence Number=SeqID_121876
atgcgtttaccggggaaggagagtctgctgatgaaatcccccataaccttaactgagattttggatgttagcatttcgtttctaaatgaccatttagaggaaacactgggttcgacaatagaagaaaatcactcaaagtgtatcaatctcgcacagggtaaggattggcattctcaccctgggtcaaggtttatggtgagtcaggattttggctcaaagcttgtagaatgggtagacatgatacatgtcaggatttggtttggttcaaggataaaagggatgccccacattatctccatgacacaaatgcaaaaatga

SEQ ID NO: 30192 - DNA, 303 bp, Glycine max
  Peptide Sequence Number=SeqID_121877
atggcagcccaagaaatcgagaggcgtcaaaacttcaacaatggaagaagatcacaagaagactctcaagttcttagatgttacaaatgcaaccaacttggtcacatcaaagctaattgtccttcaaatgaagaatggcttgagaaaagtgataagaaaaggtatgatgaaagaaggactaacaaggcctacattgcatgggatgacaatgattcatctgatggttcagaaaaggaaatcaaccttctaaccaaggattatgagaattatgagagtgatgagaacatatctcaagaagattaa

SEQ ID NO: 30193 - DNA, 198 bp, Glycine max
  Peptide Sequence Number=SeqID_121878
atgatgacaaaggtgatgaacaaaaagatcaaagatcaaaaaacatctcaagtgaatcaagaacaagtcaagagttcaagaatcaagaagaattcaagactcaagaagaaagcctacaatcaagattcaagattcaagatctcaagaatcaagatcaagattcaagactcaagattcaagaatgaagaaaatacttaa

SEQ ID NO: 30194 - DNA, 537 bp, Glycine max
  Peptide Sequence Number=SeqID_121879
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggaacacccaagtcgtgtgcatgctgctgaagccgatgtcacgatcaaacaatactttggaccagctccaaggacctcttgcacgtctttgtccatggctcccaaagacttggagcagctgacgcaaaaaataagggaccagctggaggagtcgatcacagaaaaaggactcgcactgcctcttgagcttgaggttggtccttcagctgctcgtgtcagcacaaaggaaagttatattgatccctcaaggaatgatccagacacgggtgactcagagaaatgcgggttgtacgttgaagaaaatcctccctgcccggttgccataggaagactttatgaggggttgacaaccgttcacaacatcccttttcaccatgatcaagtcaaggttggtgtttag

SEQ ID NO: 30195 - DNA, 492 bp, Glycine max
  Peptide Sequence Number=SeqID_121880
atgaccgcaggaccaaactaccttatcaacagatctaaaattggttgcatatcagaaatagccatagagggggataaggagaaggatttgcctcttgaggtaattctgcctcatagcagcaattcgaatataaagaagaaaaacagggtcaatgttccctttggtcaatatgacttaaaggtagcaagtgaggaagtgggccagcggataagtggcccaacttattctgccacaaaggtttatgtgagaagaaaggaggtgttgagaagtaatggaaaggcccaacagtttaaggaaccagctgtggactcaaactcagtttcaaaaactgattccatgccttcaatacaacaggacccaatagagctacaatgtgctcttttaaaggaaatgggcttgacttatggggaagatgccaataaggttaaggggcttatattggatatggaaaatagagatgatatgatggcagctgagaggggaattaaataa

SEQ ID NO: 30196 - DNA, 193 bp, Glycine max
  Peptide Sequence Number=SeqID_121881
atgttatggaactttacgaattgcgcattaacacttcctttcaactctcgacatgtcgcaaaacttcacggattgcctaacgatgggtgtcaagtacctcgaagtggtcaagcgaaggtcgcatcccaccaaacagatggtccccggacgaaattagggtatgacaagaaggaaaaccattttgcaacaaaag

SEQ ID NO: 30197 - DNA, 411 bp, Glycine max
  Peptide Sequence Number=SeqID_121882
atggccacgcgcactgccttcggacggcggatttacgccatcggcggcaacattgatgcagcgcgcctgtcgggcatcaacgtggcgcgcaccaagctggcggtgttcgccatcaacggcgtcatggtggctatcgccggcctgatccttagctcacgtcttggtgctggctcgccctctgcgggcaatattgccgaactggacgccatcgctgcctgcgtgattggcggcaccagcctggcgggcggcgtcggttcggtggccggtgcggtgatgggcgccttcatcatggcgtctctggataacggcatgagcatgatggacgtgccgaccttctggcagtacatcgtcaaaggggcgattttactgctggcggtgtggatggatacggccacgcgccgccgggtgtaa

SEQ ID NO: 30198 - DNA, 407 bp, Glycine max
  Peptide Sequence Number=SeqID_121883
cggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccctccagactcgaaggtggaggacacatgaacagcgctaggaaatga

SEQ ID NO: 30199 - DNA, 462 bp, Glycine max
  Peptide Sequence Number=SeqID_121884
atgccgatctccccctgcggaagtatcagttggtctgtgccgtcccgacataggggtcgcgcccacaagacacctagtggacccggagaagaccaacagggccctggggtttccaactttggttacgggcctctatcagtcctacagggtgcccgtaccccccggcaagggatcgcgcccgcaggacacccagtggacccaaagaagtccaacagggtcctggggtttccagctctgattacggacctctatcagttctacggagtgcccgtcacccccaacaaggtcatcaggccccctactaatcgagctttcatcaagaggtactgcgcctcccagtcaggcgcaaggcaaaacaccacaacagcctggggatggccaacaacaggcaacaaatgcaccgtcgccacctttagagttcacctcagctcatccacaaaaaggttagagtgttgcctatga

SEQ ID NO: 30200 - DNA, 366 bp, Glycine max
  Peptide Sequence Number=SeqID_121885
atgaaaaaggaaaagagaagtagtcataactcttgcaagagcctaagtgaggaacttcgtgactattatgaaggaaggcataggtcacatcttagacctcactccaatagaagagaacatgaaagaaagcctcaagaggctaacattaacctcccatacttccatgggaaggacaatgtagaggcttacttagattgggaaataagggtagagcaaaaacttaaaagaaagtctactttaaaatcttatggctctcactcttatccaaagaaagaccaaggtctaggcatcttaggggcagcaccttctaagcccaaagatgataaggggaagacaatagaaaagcaaccccctaaggctacctaa

SEQ ID NO: 30201 - DNA, 303 bp, Glycine max
  Peptide Sequence Number=SeqID_121886
atggacgttgataagatccttccatctagcagcaccttaggatggcatagccttaaagttaagggcgaggttcaaacgaagaaaggcttatggtggatacctaggcacccagagacgaggaagggcgtacgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccgtga

SEQ ID NO: 30202 - DNA, 93 bp, Glycine max
  Peptide Sequence Number=SeqID_121887
atgggaatacttgtttatgattatttggttgacactgctgcctctgttcaaacaagagagagcatcaatgagttcttaacaagtgttaaatag

SEQ ID NO: 30203 - DNA, 480 bp, Glycine max
  Peptide Sequence Number=SeqID_121888
atgtgggcttttcataaaggtctacaaattgattgggcacatcttgttagatatcgcatgcataaggcattgcgattaaatgctccattgccatatccacacctagtcaccctcttccttcaacactttaacatcccttttgattctgaaccttatgttccaatcaagagatcctttctaataggcgcttcagtcattgcatcctttggttatcaaaaagagcatgatgactcttgggtgaaaaagggtgctcatgttgatgaagaaggacatggtggagaagattcatctcttcttcaaaagattttggataggttcgatggtcttcaaacctttgttggtgaaaggtttgatactttggagttacaaaaggacatgtgcttcaatgagatggagtcaagaatcaccaaggtcgaagaagatgtttcttatattcgttcaagctttgatctaccaccaccgctgccaccatcatcttag

SEQ ID NO: 30204 - DNA, 363 bp, Glycine max
  Peptide Sequence Number=SeqID_121889
gtcgactctagaggatccccactcgctgcgctcggtcgttcggctgcggcgagcggtatcagctcactcaaaggcggtaatacggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 30205 - DNA, 255 bp, Glycine max
  Peptide Sequence Number=SeqID_121890
atggtacctaatgcatggttaactaagaaaagatgtttcttcgggcatctcaatttcataatgacatttgctatgcatagcttaagaaagagcacgttgtacgacacccttacagaggccttgaaagagaaaatggccacaatgatggaggccatgatgagcataaaggagataatggaagtcaatgcggctgcaatagccgctaccagcaccattgctgaggtggacctgacccccccatatggcctcaactaa

SEQ ID NO: 30206 - DNA, 387 bp, Glycine max
  Peptide Sequence Number=SeqID_121891
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccctgcgcagatgacggtccgggcatccctcgcgcgattcgaggtcgaggggatcctctag

SEQ ID NO: 30207 - DNA, 531 bp, Glycine max
  Peptide Sequence Number=SeqID_121892
atgggactcaccctttacttgggaatgaagaggggaaagatagcatgtcacaagagcgaggcgaggtttgtaaccctactgcgagagggacgcctcgcgagccgggcttctagagatgaggccttttggcgaagccaagtcaatttcgggccaccaaaccctgcaactgatgagaaggcctatggagtgcctagaggacgggccataagacgcaagcgacgacccgggagcggattccccaccggcagggggacaggagacggccatctcgaggcacatcacgacctacaggcaagaccggcgagacctgggaaggctacccgattgggagtcagaggatccatagtacctgcagccccgcggacttcatcttcatcatttttgaaagcggggggaagggatctcctttctgcaacggaaaaaaacggagcttatttgactcggcacaacctaacgatgcatccaataccaatgagattaccccatggcccatgtgaaagtgcaccaacacttccaagggagctattttaa

SEQ ID NO: 30208 - DNA, 1179 bp, Glycine max
  Peptide Sequence Number=SeqID_121893
atgatccgctggctggactttaatgacacctggctggctgctgaatggggccatccttccgacaatctgggcggcattctcgcctctgccgactatatgtcccgtaaaaatgtggctgaaggcaaagcacctttgaccatgaaagatgtgctgaccgccatgatcaaggcgcatgagattcagggcgtcctggcactggaaaacagttttaaccgtgtaggcctggaccacgtcattctggtcaagattgcctcgacagccgtggtcaccaaactacttggtggcaacaagcaagatattatcaatgctgtgtctaatgccttcgtggatggtcaaagcttgcgtacctaccgtcatagccccaatacgggctcacgcaagtcctgggcagcgggtgatgccacctcacgtgcggtacgcctggcctggatgaccttgcagggtgaaatgggctacccaagtgcgctaaccgcaaaaacctggggcttttatgatgtcctcttcaaaggcaacgccttcaagttccagcgtccttacggcagctatgtgatggaacaagtattgttcaaaatctccttcccggccgagtttcatgcacaaacggcggttgaatgtgctttccagctcaacaaagaagtcggcaaccgactgcaatccatggatgacattgccaatatcgacaaaatcatcattaccacgcatgagtctgcaatccgcattatcgacaaaagcggcccaatgaataacccggctgatcgcgatcactgtattcagtacatggcggctgtcggcttattgaaaggcaacctgactgcactggactacgaggatgaagcggcagccgatccacgtattgatgccttgcgcgaaaaaatgacatgtgtagaaaaagctgaatacacgcgtgattacatggacccggaaaagcgctccattgccaacgccatacaaattttctttaaggatggtacacaatccagcaacatcgcggtagaatacccgatcggccaccgccgccgccgtggcgaaggcattcctgagctggtcaagaaattcaaagtcaatctggcacgtcgttttgatacagccaagcaggccgatattttggacttatgccagaatcaggcaagactggaagcaacttcagtcaatcagtttgtagatatgctcatggtttaa

SEQ ID NO: 30209 - DNA, 288 bp, Glycine max
  Peptide Sequence Number=SeqID_121894
atggccagcaatataatcaacagcagggacaatggaggaaccaccttggaaattagttcaataaagatcaagatgataacaaaagatgatgacaaaggtgatgacaaaaagctcaaaggtcaattaaagaatgagttcaagatattcaagatagaatcaagaacacttcaagattcaagaggaaagttgatttcaagaatcaagattcaagagatcaagatttcaagaatcaagattcaagagatcaagattcaagactcaagattcaagaatcaagagaaggcttaa

SEQ ID NO: 30210 - DNA, 504 bp, Glycine max
  Peptide Sequence Number=SeqID_121895
gtcgactctagaggatcccccctctaagctcagatatgattttgaaatttccaacggtgagaatgttcagaatttggttgttaacatgatactcaaatttcacgacgatccaacggtgaacgagttcgagattgttgtttttctgagacagatgttacaaaacgcggccactgcaagaacccttgaacaagaaaccaaaagggcccgcaaggaggaatatggccgagagaaattccgaggagcattgtggggtagcaacaatgagctcaagctccgaagagaggaaagagatcggtcacgggtgcatgacatgatcttgaaagaagagttagttgcttacgcaaggtccaaaaggagtttggctcaacacttggaagccacggagcaaagcatgctagctatcatagggcaatacaaggaagagttaaaccagtctgtggcccatgaacaaaagctagtggaggattttgcacaagtgtacgccgaaaagaagcaagagggagg

SEQ ID NO: 30211 - DNA, 300 bp, Glycine max
  Peptide Sequence Number=SeqID_121896
gtcgactctagaggatccccggatcctgctcaatctgttaaagatataacagatttatgtgtccagtattttcgggcaggatgtcctggacattttatgcaagtgagatcagcaactttcattatcagagtaatcaagcacagcggtatctgtagtggcgacagcaaaattctacaagttgcaagtcgtttccaggatgtcaagacatctcacgatgtcaagacatctcatgtgacatcagctttctgctccccctgtctccatgctctagctgcagcatcttctatcagctactcgtag

SEQ ID NO: 30212 - DNA, 444 bp, Glycine max
  Peptide Sequence Number=SeqID_121897
atggctcttaagaaactctccactaagaggtctagaagagacgccacaggagaaggatccagtgccgccccagagtttgatagtcattgtttctggagtgccgagcaccaacaccgcttcgaggccatcaggggatggtcgttccacagggagaggcgtgtccagctcagggaggatgagtatacagactttcaggaggagatagctcgtagacgttggacactgctagtgactcccatggccaagtttgaccccgagatatggattccctttgacgcagatgccctcagccagttcctgggcgatccgctagttttggaggaaggccagcagtgtgagttcagccagaggaggaacagggccgacggtttcgatgaggaagccattgcccagttgttgtgcatattggggcaggatttcgcccggaccgctgtagagaggcgg

SEQ ID NO: 30213 - DNA, 360 bp, Glycine max
  Peptide Sequence Number=SeqID_121898
atgaaggctcaagtggagaaggatgaaggtccagaggcagagacactatcaagacaattaattgttgctgagggccaaactaatttgaaggcccaaacttatcaaggtaatccttgtggcgtctaccccgacttatcttccttcaccggaagtggcgtctacccagacttatcttccttcaccggaagtggcgtctaccctgacttatcttccttcaccggaagtggcgtcatccaaaccttcgtagcctgtatcaaacgatccgctcctactcagtcgaaatcagccaggaaacatgaccgaccgaggtctaaaaaagaagcttcacaagatgatgctgatcgaacttttcctaactga

SEQ ID NO: 30214 - DNA, 501 bp, Glycine max
  Peptide Sequence Number=SeqID_121899
atgtcgatctccccctgcggaagtatcagttggtctgtgtcgtcccgacatagggatcgcggccacaagacacccagtggacccggaggagcccaacagggccctagggtttccagctctggttacgggcctctggatcatgcccgcaagacactcagtggacccggagaagtccaacagggtcctggggtttccagctctgattacgggcctctgtcatcaggcccctaccaaccgagctttcatcaagaagtactgtgcccccaggtaggcgcagggcgagacaccacagcagcccggggatggccgacagcgggcaaccgacgcatcgccgccacctccagggcccctcagctcatctacaaaggctggagcgttgcctacgacccgttgccgactagcgggcgaccaagtccaaagccaaagataagcaaaagtactaggtccgtgaccgacaagtcatcacgcgtccagctcatgacgttaaagaagcgctcctag

SEQ ID NO: 30215 - DNA, 459 bp, Glycine max
  Peptide Sequence Number=SeqID_121900
atggggcctcaccacccatcaatgcatggtgttcttagacttattgttactctagacggtgaggatgttattgattgtgaacctatattgggttatttacacagaggaatggaaaaaatagcggaaaaccgaacaattatacaatatttgccttatgtaacacgttgggactatttagctactatgttcacagaagcaataactgtaaatggaccagaacagttgggaaatattcaagtacctaaaagagccagttatatccgagtaataatgttggagttaagtcgtatagcttctcacctactatggctaggaccttttatggcagatattggtgcacaaacccccttcttctatattttcagagaaagagaattaatatatgatctatttgaagctgcgacggaattgttgaatatcaaaacttattacgcgaaatccgattttttagacggttga

SEQ ID NO: 30216 - DNA, 474 bp, Glycine max
  Peptide Sequence Number=SeqID_121901
atgactctattacagatttatgagcacttccctagtgtgcaccagtgcgtcacagatgatacataccaggagacatccctacgtgcttcccggtggttgacgtcgaaggcgcacatgaagggaatcacaggagcaccttacagggcacgttgtgatgctttgaccgtcacagatgtgtcctggttgccgtacactgagcatcggggggttagggcctttgagctgatttcatcattccagggtcagctgagatggggtactatggtggtcataagtattaggtccctgtcagtgacaataacaatagggaggcgattgtttcttaaaaataggcctcgaaatcgttccaaagcccatacaatattattaacacgcttagcctccagatatgcaaacccagcagagaacgtcatcgccgttggtgtcaccccaacaaagtcaagtagtgagagtctgtacctgtttgttttgtag

SEQ ID NO: 30217 - DNA, 251 bp, Glycine max
  Peptide Sequence Number=SeqID_121902
tggacctcctacgtgccgatcaacgtctcattttcgccaaaagtggcccagggctcccggtatcacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 30218 - DNA, 735 bp, Glycine max
  Peptide Sequence Number=SeqID_121903
atgagtcgatctcttgcttctcataaaggtggaccttgggtactagtacctattgcctttagagggatgcacgccctcgccttcagaaagctgcatgccctcaccttcaaaggactgtgcatcctcgccatcaaagggctacaccccttcgcctttagagggttgcacgccctcgcctttagaggactacatgtcctcgcctcaagagggctgcacatcctcgccttcagagggttggacgtcatcgcctttacaaaactacatgtcatcgcctttagagggctacatgccttcgcctttagaggaccacacgtcctcgccccaagagggctgcacgtcctcgccttcagagggctacacgccctcgccttcataggactgcacgtcctcaccttcagagggctacacgccctcgcctccagaggactgcacgtcctcgccttcagagggctacacgtcctcaccttccgagggctacacacccttgcctttagaggaccacacgtcctcgcctctagaggactgcacatcctcgcctccaaagggctgcacgtcctcgccttcaaaggactacacgtcctcgccttcagagggctgcacgtcctcgccttcagagggctgcacgtcctcgccttcagagggctgcacgtccttgccttgagaaggctacacgtcctcgccttcagagggctacacgcccttgcctttacagtggctacacgtcctcgcttttag

SEQ ID NO: 30219 - DNA, 96 bp, Glycine max
  Peptide Sequence Number=SeqID_121904
atgaagcatggctccaaactcgaaggtggaggacacatgaacagcgcaagctccaaactcgaaggtggaggacacatgaacagcgctaggcaatga

SEQ ID NO: 30220 - DNA, 324 bp, Glycine max
  Peptide Sequence Number=SeqID_121905
gagaaagcaccatgggaattgaatagtaaggagaaaattgaggtggctgggaggatgaaagaagaaggaaatgtattatttaaagttggcaattatcagcgagcaggaaagaaatatgaaaagattcctttagttcatgatttctgccaaatccatgataccttgttctcgcggggggctgctgattttgttgatgaaggtggatcctttgggtttgatgagcaaaagcaagctcagacactgaaagtgtcatgctggttgaatagtgcagcttgtagccttaaacttaatgactttcctggagcaatcaagctatgttcacag

SEQ ID NO: 30221 - DNA, 330 bp, Glycine max
  Peptide Sequence Number=SeqID_121906
atggcaagggacaaactacaatcttcagctgtttgtgacctaaaactaaaactcataagtgataggcaattagatggaagattatataacttgccaaatactgctgaagttgctgctttgattattggtgacgagcatacagttgatggctacactatgattgagtctgaaaaactcaactatgttagagaacatcaacaggaactcagagtttacaagtacatgaatttgaatgcctacaataatgatcccgaaacacatggcaatgagaaagaaaagagaatcatattgtcgagctcatttgttggtagtcataggtatatggaataa

SEQ ID NO: 30222 - DNA, 432 bp, Glycine max
  Peptide Sequence Number=SeqID_121907
atggcagcgcaattaatccatgaccgagtggagatggagtgcctagagggagtttgggagaccctcgaaggcaatgcgaggtgccgattctgtggcacgattcgactcacaactacttcattggtacatccagaggaacccgcacgcacgcttcagcgaactgtggagtggatactacctacacctaatccatatcgactagtggagccagtccaagtgatagaggtgttgtcatctgaagaagaccctgaggaggacctagaggagttacctcccgagcctgttgtggatgctcttgactttccagagggtgatgaggacccactacctgatgtggattctctagaggacgtcatgtcagcatctaaggcagactctacggaggagagcggccctagagggatagtgactagtggagactcttcatcatag

SEQ ID NO: 30223 - DNA, 67 bp, Glycine max
  Peptide Sequence Number=SeqID_121908
gcattcaagctctccttctcctccaagctcttatccatggcctcctatggtggtgagcttcttctag

SEQ ID NO: 30224 - DNA, 372 bp, Glycine max
  Peptide Sequence Number=SeqID_121909
atggaggttaaacagaattttgcacaagtgcagaaaaatgcttgtgtgtggttggctgtggaaagtctagtgcagaatgagttctggatgtttgctagaaagcttgggaggattgatggggacccggtgttgagagaaacgaagatatgggctacgtgggagtacgtgagctcagttggaggtgggcaacaggggatggtgggtttatgcgcgctttgtggatgtggaaaaacttgttgtgcaccatcacccgaccgccacctaagtggtacctggagatatgccgctggggtcaggagaccttggggacgtcaggtggggtgggggtgcccaaaaccaagcttgaccaatcccgacccaacccgggcatag

SEQ ID NO: 30225 - DNA, 291 bp, Glycine max
  Peptide Sequence Number=SeqID_121910
atgatacgcggagataccttacggttatccgcacccttttgtcatccagaggcggcgggcccgatgacaagcagagaccaagtttggtcattctgcacccttgtatcatccagaggcggcgggcccgatgatacgcggaaataccacgaggttatccgtataaacactcttttgtctatctacctttctttggtccttgtgaggtgcttggcacccatcgttaggcaatttgtgaaaatccgggaacgacaagtcatgtcacccgcgactctcgtcaaccgagaggagtga

SEQ ID NO: 30226 - DNA, 474 bp, Glycine max
  Peptide Sequence Number=SeqID_121911
atgatctttgatgattacgatgaacagagctttctatctgcctcatttgcataccaaaatacaggtggtgcttacattgatattggagatcctgtatgggaatgcccacattgtaaagttatgatgtggtatgatgagaggataaataaagacaaacaaacccagaaaccaagcatgcacgatatgcttgatgaacagattatcattgcaattaaagacatgctcgatcatcacaatcattatgcccaaaagtttatgatggctagggacaaattgcaatctgctacacttccagacctaaagataaaattgattagtcaaaggcaaacatacggaaggttgtataacttaccaacaaccattgaagttgctgctttgattgttggtgatgaacactcagctgataaaagagatatcataatagaaaaacaatccggacttctgaagagaatacatgaacttcatcctgcataa

SEQ ID NO: 30227 - DNA, 219 bp, Glycine max
  Peptide Sequence Number=SeqID_121912
atgagggacatcacaccacttttggagatggagatggagcttggaaggtggaaaacaaaagttgaaaatcagacaggtctaaaggttaaaagtctgaaatctgacaatggcgaggagtatgatagtcaggagtttaaagactcatgttcagaacatgggatcagaacgatcaagacataccagaaacacccgagcaaaacggtgttgcagaaaggatga

SEQ ID NO: 30228 - DNA, 141 bp, Glycine max
  Peptide Sequence Number=SeqID_121913
atgactgagaacaagagagggtacatctcttatggatcagttctagtggagggtacatccactaggttattcaaagagaacaagggagggcacatcccttgtggatctttgctggcacaggttgttgccgaaccagtataa

SEQ ID NO: 30229 - DNA, 252 bp, Glycine max
  Peptide Sequence Number=SeqID_121914
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggggagtgatggctagatggaatgatcgtgcgatagccgatgcccttcaagccttagctcaggctatagggaatccaaacagggtaccgagctcgaattcgtaa

SEQ ID NO: 30230 - DNA, 435 bp, Glycine max
  Peptide Sequence Number=SeqID_121915
atgatgatttggaaacaacatgcaaaattagtcatggccacagccaggtgggcactcaagcatcccatttatggcattgtgatactacggttgggagtttacacaaacagacccaaccatttcgtttctaaacgaccatatagaggaaacactgggtccaacaaagataggagaaaatcactcaaagtgtatcaatctcacacagtgcgtggcgagaaagtcgcacaggattttgttggcaaccaaagggagaggaccactttaggtcgtgggcaaggattgacattctcaccctgggtcaaggtttatgataagttgggattttggctcaaggcttgtagaatgggtggtcatgatatatgtcagggtttggccagcggttcgaggataaaggggatgtcctacattatttccatgatacacatgcaacaatga

SEQ ID NO: 30231 - DNA, 225 bp, Glycine max
  Peptide Sequence Number=SeqID_121916
atggccgagagagatggtgttgggttgaacaaaccacaattcaccaccggaatgtcaatgtccttcggatcaatccccgttttggccggctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaa

SEQ ID NO: 30232 - DNA, 200 bp, Glycine max
  Peptide Sequence Number=SeqID_121917
gtcctgggctgagggctcagtggatcccgtttgatgcagatgctatcggccagctcgtgggatatcctttagtgctggaagagggattttgcccggactgctgccaggagacgggtgcggatcatgcgcaccaacatgaccaccctgactcagatctggatgactttgctgctcagcaacatctagctcaacgaccataa

SEQ ID NO: 30233 - DNA, 342 bp, Glycine max
  Peptide Sequence Number=SeqID_121918
atgtccaaatcttgtggatttgggatgaccagccctctcgatgagtcgatctcttgctttctcataagggtggacccttgggtacttgtacctatcgcctttagaggactacacgtcctcgccttcagaggactgcacgtcctcaccttgagagggctacacgtcctcgccaacagagggctgcacgacctcaccttcagaggactacacgtcctcgccttgagaggactacacgtcctcaccatcagagggctgcacgccctcacctccagaggactacacgtacttgccttgagagggctacacgccctcaccttgggtactagttaccctcacctttag

SEQ ID NO: 30234 - DNA, 557 bp, Glycine max
  Peptide Sequence Number=SeqID_121919
agggctacacgccctcgcctttagaggactggacgtcctctcctttagagggctacacgccctcgccttaagaggacaactcatcctcgccttcagcgggttgcacaccctcgccttcagaggactactagtcctcgccttcagagtgctgcacgccctcgcctttggaggactacacgtcctcaccttcataggattacacgtcctcgcctttagaggactacacgtccttgcctttagagggctacacgccatcgccttcaaaggactacacgtcctggcattcaaagggctacacgtcctcgccttcagaggactacacgtcctcgccttcagagggctacacgccctcgccttcagaggattagacgtcctctccttcagaggtctacacgccctcgacttcagaggactagacgtccttgccttcagagggctccataaaccgaggtgcttccgtaacgcttccgtaagcgattctgtggaaattcttcatcattcttcatcgttcttcatcgttcttcattcgttcttcgtcgttcttcattcttcaacag

SEQ ID NO: 30235 - DNA, 873 bp, Glycine max
  Peptide Sequence Number=SeqID_121920
atgcccccgcctttagaggactacacgtcctcccctgcagaggactacacgtcattgcctttagagggttgcgtaccctcaccttcagaagactacatagggctgaacgccctcgccttcagagggatacacgcccacaccttcaaagggctgcacgccctcgtcttcagaggactacacgccctcagcgttagaggactacacgttcttacctttagaggactacacatcctcgcctttagagggttgcgtatccccaccgtcagaggactacatgtccttgccctcataggactacacgtgtcaccttcagagggccacacaccctcgactttagaggactacccgtcctcgccttctgaggactacatgactacacatcctcacctaaagagggctgcacgccctcgccatcagaggactacacgtcctcgccttcacagggctacacgccctcgccatcagaggactacatgttctcgccttcagagggctacacgccctcgcattaataggactacacatcctcactctcaggggactaaacgtcctcaccttcagagggaagcacgccctcgccttaagtgggcaacatgcccccgccttcagaggactactcgtcctcaccttcagaggagtaaacgtccttgccttctaagggttgcgtaccctcaccttcagaagactacacgtcctcgccttcagagggatacacgccttcaccttcagaaggctggacaccctcaccttcataggactacatgtcctcaccttcagaggaatacacatcctcgccttcagagggttgcgtatcctcaccttcagaggactacacgtgctcgccttaagaggactacatgtcctcgcttttag

SEQ ID NO: 30236 - DNA, 402 bp, Glycine max
  Peptide Sequence Number=SeqID_121921
atgctagagaatcttcaggttcctccgtcgacaacggaatcggccccagtgctgaagcgctatgctccacccaaccagaggaaatcctgtatgatatttgcagatttctttaaaaagctgcaagatgcagtatcagatgttaagaatgagatagcacaacatctggttaatttggaagtttctaactttagcatggctccggtcaaggttagctggtgcaaatttgaagtgactgttgactctcctaaacaaataatagtgtggaggagacctgaaaggctgacccgttttactattgttcgtaaacttgatgggattatatttccgatggggttcagcaaggaggttacagacagaaacttacaagcgggttcaaatattctgtgtgctgaaagcaggtag

SEQ ID NO: 30237 - DNA, 722 bp, Glycine max
  Peptide Sequence Number=SeqID_121922
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatccgagctgaggcaggagaatcgcttgaacctgggaggcggaggttgcagtgagccgagatcgcgccactgcaacccagcctgggcgacagatcaagcttatcgataccgtcgacctcgagggggggcccggtaccagcttttgttccctttagtgagggttaatttcgagattggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 30238 - DNA, 612 bp, Glycine max
  Peptide Sequence Number=SeqID_121923
ggatcgcgcccacaagacacccagtggacccgaagaagtccaacaggaccttggggtttccaactctggttacgagcctctgtcagtcctatagggtgctcgtcccccccagcaaggtcatgccatcgtgacgtaggtaaggatcgcgcccacaagacacctagtggacccgaaggagtccaacagggccctggggtttccacctctgggattgcgcccgcaagacacctagtggacccggagaagtccaacagggtcctagggtttccagctctgattaccggcctttttcagttctacggagtgcccgttgcccccaacaaggtcatcaggccccctaataaccgggctttcatcaagaagtactgcgccccccaggcaagcgcagggcgagacaccacagtagcctggggatggccggcagcgggcaatagacgcaccgcctccaccttcaaagcccctcagctcatctacaaaggttggagctttgcctacgacccatggccgaccagcaggcaaccaagtccaaagccaaaggtaagcaaaagtactaggtccgtgaccgacaagtcatcacgcgtccagctcaagacattaaagaagcgctactag

SEQ ID NO: 30239 - DNA, 680 bp, Glycine max
  Peptide Sequence Number=SeqID_121924
agggctacacgcccttgccttcagagggctacacgtcctcgccttcaaaaggactacaccacttcgcatttagagggctccacgacctcgcctttagaggactacacgtcctcgcctttagagggctgcacgccatcaccttcagaggactacacgtcctcgccttcagagggttgcacgccctcaccttccaacgactacacgtcctcgccttcagaggactacacgtcctcgccttcagaggactacacgtcctcgccttcagaggactacacgtcctcgccttcagaggactacacgtcctcgcattcagaggactacacgtcctcgcctttagagggcaacgcgccctcgcctttagagggctacacatcctcacattcagagggctacacgccctcactttcagaggactacacgtcctcaccttcagagggctacccgccttcaccttcatagggctgcacgccctcgccttcagaggactacacgtcctccccttcagaggactacacgtctcgccttcagagggctacatgccctcgccttcagaggactacatgtcctcgccatcagagggctgcacgctctcaccttcggaggagtacaagacctcaccttcagaggcctacacgtcctcatctacagagggctggacgccctcacctttagaggagtag

SEQ ID NO: 30240 - DNA, 156 bp, Glycine max
  Peptide Sequence Number=SeqID_121925
atgatgaagatgaagtccgcggggctgcagccttcccaggtctcgccggtcttgcctgtaggtcgtgatgtgcctcgagatggccgtctcctgtccccctgccggtggggaatccgctcccgggtcgtcgcttgcgtcttatggcccgtcctctag

SEQ ID NO: 30241 - DNA, 1083 bp, Glycine max
  Peptide Sequence Number=SeqID_121926
atgggcaaccctgtcgagcaacctaactcaccacaagaacaacccgccgtcgaggtacaacaaaatgtttctgtagaagaaataccctcgcatgctcgaacatctcctgctcctgagacggatgcagtgaatgttgaggaacagggtgaaggtcaaggcattggacccagcagtcctcatggatcgagtcagaaaagttcatccgaagaaaactttttcgatgaagagggcatagaagaggctgaagctggtggttcggacatttacccggcgtcttcgacatctaagctttccgctagcatagggatcgcagaagatacattcattcaaatgcaagacaaagaccctgctgcagcccttcgactcctgctgaacaccagtcaagccaacacctcaagtgaaaagaatcctggtgcttcgtcctcatctgacgccgaaataaactcttcagtacgccaagattgcctgctcctgaagttatcaatggaatacgcacgggaagacgtacttaaatccattgaagagaacccctctgctgcttttgggcatctgaactttttgaagaaattgcacaacccccttacttctgatgagattctgggcaaagttatccaaatcgagtccattatcgatcaatttgcaagtactgtgcagaaaaaacgcgaaaatggcgccagactcgatgcccagaaacaggcacatatccttctgctcgagaaagcccgagcggctcaacatgaagtcgaacgtctcaccaaagaggcgaaagaaggatcttttgaggtcaaagcgtgcgatgataacatctcctcctgggaagcaactattacggatttgctgtctcaggtcgatgatctaaggcaaaaaattgtgacagagcaggccaaacgccaagaactccaggagaaggccgctaactcgattcagaaactggttgctgaaaaagggagggaaggcctgaaggcctttagcgcatcacaagctgtagcagatgaggcgagagttatggagagtgctgaccaggtcttaagcaaagagatggccaccttgaagaaactatatgaggacttagtcatgcattag

SEQ ID NO: 30242 - DNA, 551 bp, Glycine max
  Peptide Sequence Number=SeqID_121927
atggatgagatcgcgtgcaagctaagacgcgacgctccctatgatatctttggtctttttcccatgctctctgttggtcaacaaccaagcacatctcactttcatgtatcacgtcaggatccgttgctcaaactgaatcacgccaacgttatggaagttcctggatcgtgtgaaataagagtagtaccaaaggcaccctatgatttcataataaaaaatggaaaattggctatggagattccgcgcgacaaaggatatgtcagtgacctagcacgacaaagcactctccgagggcatggaatgtctaatttttcggtcagaatctcgacagtaatgtctctgttagattctccggtcgaaatacgggaaaactccattcaattctcgatggaaacggagttttgcgaattctccccggaactggaagatcatttcgagatcttcgaacatattcgagggttcaatgtgactattgtcacttcggccaacacacaagatgagactttaccaccgtggagcggctttttgcaaaaagatgagggagaaactca

SEQ ID NO: 30243 - DNA, 168 bp, Glycine max
  Peptide Sequence Number=SeqID_121928
atggttgaaccttcaaaggatggaaatcctttcaaattgaaagtgagaaacgagacattagagcagaatgggatggaaataatggagcagaacaaagtcgatgagaaagtgatgcatttggcagaagaacataaggcacaaattctatattcttctttttaccaatga

SEQ ID NO: 30244 - DNA, 916 bp, Glycine max
  Peptide Sequence Number=SeqID_121929
atggattgggaccagctcttggtcgggataggaggtagaacaatcagttggttcccccgatggaaggaaggaaaagaaggagtccttttctcatgtgggagatacccaaacattccgctggtaggaacgaggggttgtattaattacaatcccacgctcgctataagacaactagggtaccccatgaggggagcaccgacggaagaaagcatgtctcctttccttgtgagggatctcggcgcacaaaattccaagactatacaaagaatccataaggcatgggaaaccccgttaaggaaagatcaagagcttagaggcgttcgtaatggcatcattggtggtcgtcagcgaagagaatttgaagcaccggaagaggacgaggaagtccaagctctcaaaagcgagttaggaaaggcaaaactcgccaaggagaagtcaagttggctgctacacacgttcggaaggagtgtgccgggttacgggaagagaatgcaattaccgcaagagcccttgaacgagagaccaagagggctcgcaaggaagagtatggccggaacaaatttcgtggagccctatggggagttagttgcctgttcaaggtccaaaagaagcttgtctcagcgtttatgcgagacggagaccaacatgctagctatcatcgccaagtaccaagaagagttaggtctagccatggcccacgagcatagaatcgcggatgagtatgcccaagtatacgcggaaaaagaggctagaggaagggtgatcgactctttacaccaagaggcaaccatgtggatggatcggtttgcccttaccttgaacgggagtcaagaacttccccgattgttagccaaggccaaggcgatggcagacacctactccgcccccgaagagattcatgggcttctcggctatt

SEQ ID NO: 30245 - DNA, 264 bp, Glycine max
  Peptide Sequence Number=SeqID_121930
atggaggaaagaaaaattatggagaaacttccagaagaagagaagaagttcgggcacgtagagaaaaattgttgcaacaaaaataggcatcaagctaatatcgcagaggagcatgatcaagaacaatgtatgttctatgccactcaagactcaataaaagaaaagggaggaagctggtacttggatagtggatgtagcaatcacaaggccaaggatgagactattttcaaaagcattgaagagtctgtcaaagtcaaagtttga

SEQ ID NO: 30246 - DNA, 267 bp, Glycine max
  Peptide Sequence Number=SeqID_121931
tatcaagctttcatcaagaagtactgcgtctccaggcagcgcagggcaaacacacagcagcattgggatggtcggcagcgggcaacagacgcaccgccatcacctctagagttcacctctgctcatccacaaaaaggtttgagtattgcctacacaacatggccgagcaataggcgaccaagtccaaagccaaaagagagcaaggtgtcaatgctggaagttttcccggacgctcgaaatggtactcggatgaatgcacaaatataa

SEQ ID NO: 30247 - DNA, 612 bp, Glycine max
  Peptide Sequence Number=SeqID_121932
atgaccggtagattgctgcccgggtcattaacatttgataatcgcatcatgcactatatcattgttaggattttgcttcctcggtcttcaaatttagcacaagcctctgaggaggatttgattcttatgtgggcttttcttaccggtcgtcagatcgactgggcccatttggttcggtaccgaatgcataaggcattacgggccaatgcacctcttccttatccacatttgattactctgtttttgcgtcattttcaaattctgcttgatgatgagccatttgttcaagtcaagcgttcctttgctattggtgctggtgttgtgacttcctttggttaccgtaaggatcggaatggtcaatggctgaagaaagacgcactccctcctcaagatgagcgtactccttcacctcctcctcagcgtgaagattcagcactcctgaatgaagtccttaccgaattacgatgtcttcgttcttatgttggtgaacgtttcgactcattggatacacgctttgccggcatggatattcgcctcacacaagttgaagaagatgtctccttcatccgtacttgctttgatccaccaacaccgactccatcatcctcttag

SEQ ID NO: 30248 - DNA, 291 bp, Glycine max
  Peptide Sequence Number=SeqID_121933
atggaaagaaaggaaaaaaatgaaaataaagaaaaaaacagaagaaaggaaaggaggattcctgatcaaggatcggaaagaagtgaaaaaggaaaaaaaagcaattctcgatcaatgaaagatagaggacagaaattcttcaagccagattgccactcaaaatcattctcgactggcaatatcccaccccacatgaacaaagaggaaaagaccgaaacacccaacttcctctccaaaaacactacccttgagaaaattctattggtccgtgatcgtacgtttgatctttga

SEQ ID NO: 30249 - DNA, 362 bp, Glycine max
  Peptide Sequence Number=SeqID_121934
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgaatataccctccaccaccttactgactgagatcttctaccttctcaaccaaggaaccaacatcaacatgccttgtatgccaaaagggccttcagactccctttcaatgcttgttcaaacgccccgtgctttgaccttttga

SEQ ID NO: 30250 - DNA, 315 bp, Glycine max
  Peptide Sequence Number=SeqID_121935
atggatacatttgtcatctttgtccctcatcctctcgtaaattacatctttgctttgtggaagcacagcttcatgatgaatcttagattgattcaaagatgttttgatgataacaaaggtgatgacaaaaagctcaaaatgttcaagattgaatcaagaacacttcaaggttcaagaggaaatttgatttcaagaatcaagattcaaggttcaagcttccaagaatcaagatcaagattcaagactcaagattcaagaatcaagagaagacttaatcaagataagtatgaaaaagtttttgcaaaaactgagtag

SEQ ID NO: 30251 - DNA, 231 bp, Glycine max
  Peptide Sequence Number=SeqID_121936
atggtggagctcatgaatctggatgttgtatccctaatgatgaacaattcacacatgaagtcaattatatggggaactagcctagaaacaattttaatgcaggtggatttttcggatttcagcatggacaacaatacaaccaacaacaaggacaatgaaggaaccatcctgggaatcaattcaatagagaccaggggggtcatccataaggccgcaaccacaagggcctag

SEQ ID NO: 30252 - DNA, 405 bp, Glycine max
  Peptide Sequence Number=SeqID_121937
atggggtttttgcaagatgataaagaattcattgaggcaatcaaagaagcaaaagactggggctcaacacattatataagaaagctatttgtgttgttacttttaactgcaacaatgaacaaacctgaacaagtttgggcccaaactaggcattggatggctgatgacattgtctataattataaaaaatcatcaacaagtccagcattacagcttgatgatatgactcttcaaaatctggtcttgcttgaaattgaacaactattgcaagcaaatcaaagatcacttacagactatccttcaatgtcatatccagaagatgtgaatttcccaacctatctagacaatagccttatattagctgaactcaattacaacaatcaagaactcagatcagagtcttaa

SEQ ID NO: 30253 - DNA, 381 bp, Glycine max
  Peptide Sequence Number=SeqID_121938
atgaccatgattacgaattcgagctcggtacccctcactagtctgtttcctggtacatccttagatttgggtggtttcaagttagactctatgcatatgtttggagttttgacagcacttattattctcccaacggtttggctgaaggatcttcgtataatctcttatctatcaggtggaggggttgttgcaacaattttgattatgatttgcgtgttttgtgttgggacaatagacagtgttggattccatcacacgggtcaattggtaaaatggaatggcattccatttgctattggtgtctatggattttgctttgcaggacattcggttttcccaaatatttaccagtctatggctgacaagaaggggatcctctag

SEQ ID NO: 30254 - DNA, 447 bp, Glycine max
  Peptide Sequence Number=SeqID_121939
atgggtgaagcagaggaggtgcaagagaagatgaaggccgacatggaggccatgaaagagcaaatggccacaatgatggagaccatgatgagcatgaagaagataatggaagccaatgcggttatagttgccgctactagcgctgtcgctaaggtgaacccgatgctcccatctggcctcaagcaaatgaatcatccaacctcaaatatggtaggcaaagatttgggaagtacgaacgaccccatgatgtgcaaattcaaaacgagcacgctttcccatcatatggcttgcctcccaactatacaccacccaatgtggcatacactctcaatgaaaatctcaataaccccactcccatactcattaagagccaacaaccccaaactgatcatgcacatgtctcttaaaccgtggaagagacacatgaatttccacaccacaatctag

SEQ ID NO: 30255 - DNA, 1329 bp, Glycine max
  Peptide Sequence Number=SeqID_121940
atgcgcgaggcgcttccctctcatctctccttagacgactttattgccgcctgccagcgtccgctgcgccgcagtatccgcgtcaacacgctgaaaatcagcgtcaatgattttctgacgctggtcgcgccctaccgctggcagcttacgccagtcccgtggtgtgctgaggggttctggatcgaacgcgatgatgaagatgatgtgccgctgggcagtaccgctgaacatctgagcggtctgttctatattcaggaagccagttcgatgctgccggttgctgccctgttcgcggaaggcaatgcgcctgaacgcgtaatggatgttgccgcggctcctggctcgaaaaccacgcaaattgccgcccgtatgggcaatcagggggcgatcctcgccaacgagttttccgccagccgggtgaaagtgttgcatgccaacatcagccgctgcggtattcataatgttgccctcacccacttcgacggacgcgtctttggcgccgccttaccggaagctttcgatgccattctgctggacgccccctgctccggcgaaggggtggtgcgtaaagatcccgatgcgttaaagaactggtcggtggaaagcaaccttgagatcgccgccacacagcgcgagctgatcgacagcgcctttcacgccctgcgaccgggcggaacactggtttactccacctgcaccctcaaccgtgatgaaaacgaagacgtctccggtgaagcggtcactcccgaaggttttcttcacgtcttcccgcagatttacgactgtgaagggttctttgtggcgcgtctgcgtaaaacgcaggcggtggctcccctccctgcacctaaattcaaggttggcactttcccgtttgcgcctcttaaaggtcgcgatgccgcacagcttatcgcggccgccagccaggttgggctggtatgggatgaaagtctgcacctctggcagcgtgataaagaggtttggcttttcccggcgaatatcgaaccgttgattggtaaagtgcgtttttcgcgcatcgggatccgcctggcggaagtgcataacaaaggctatcgctggcagcacgaggccatcatcgcacttgccgggggcgagaatacttttgccctcacgcatcaggaagccgaagagtggtaccgtggtcgcgatgtctacccggcgagcaccccggcaggcgatgaagcaatcgtgacgtatcaggggtacccgctgggactggcaaaaaaggtcggctcccgactgaaaaacagttatccgcgcgaactggtccgcgatggtcgtctgtttaccggtaacgatcgcaccgactaa

SEQ ID NO: 30256 - DNA, 429 bp, Glycine max
  Peptide Sequence Number=SeqID_121941
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgttgcaggatgtacaatttgtggtggagctcatgaatctggaggttgtatccctaatgaagagcaaattaaacatgaagttaattatatggggaatctgccagaggcaatttcaatacaagtggatttctaggatttcagaacaaccaacagtatcaacagcagagacagtggcaaatcaccctggtaaccaattcaacagagaccagggtggttcatctacaaggccacaactgcagatgccaagtctctatgactga

SEQ ID NO: 30257 - DNA, 938 bp, Glycine max
  Peptide Sequence Number=SeqID_121942
atggcccgcacgaagaagacaagggagatgacgactgaggccgcaaaggaaatcgctgagaagaatgattcgtttgaggagcaggccacacagggatcgttcgtcccccatggacgtcaggatgttctggccgctgctattggacgtccagagcaccctagacgtgtccgtggtattggagccggtgtcaccatcaagcaatactttggatcggctccacggacgtcccacagcgcttcctccctacctcctaacgaattacaccagctgactcaacagatcagggaccagctagaggagtccatcacagagaaagtgacgaggcaggtcatggcatccttcagccaccttcagtcgcagatgcaatctcagggacttgcagtgcctcctgagcctctggttggtcctggtcccttcggtcctcgagtgagcacaaaggggagttgtgttgatccctcgggaaacgatcctgagaccggtgactctgacagggtgagtgtggaggaggttagagatgcagatgctccaattcctgtacccactgatgaggtttccttagtggggcaggcacttcacaccttccttgcttggccgacacatctggtcaagtctttatcacagcaggtagttgtgtctccgccaaaaccacctccgaagcccgatccggaggtcgatgatccgctttatctgatgacattaaccatcccagagcttttcttgaggccttatcaggttagatgggatgccaccatgttcggggtcgttaatccagatttccccctgtacataaagcacgaagacctctccgaaatcgcacacggtggtcaatgtctcagcatatcagtgttacagttgtggattctgcatctcaccgaaacatgtatgcgagcggggaattctgatatctatggattcctcgagcctcagtccattcagag

SEQ ID NO: 30258 - DNA, 153 bp, Glycine max
  Peptide Sequence Number=SeqID_121943
atgacgggagattcatcaaaattcacacatatctctcccatgaaaagtgggcatgttacttatggtgataacagcaaaggtagaattcttggagttggaaaaatagcaaagatgatgatccatggctatggcataaacgtattgctcacataa

SEQ ID NO: 30259 - DNA, 201 bp, Glycine max
  Peptide Sequence Number=SeqID_121944
gcaacacatacaccagttagcccttcgtccattaagcatgaacgcaagttaggctcagaggggaaactgctaggaagccacattataaacgaaacctcaaagagagttgggcttcgtcttcaaaaggaaacaacaccagaaaatgtagccttccatagattcaaacagaaaacgcaaatgaaactaaaagctgaaacgtaa

SEQ ID NO: 30260 - DNA, 162 bp, Glycine max
  Peptide Sequence Number=SeqID_121945
atgggcccgaaatctaccctaagcctcatgagaaccctagggccttctcttgcatctctggttcaatctacttggagtcttctattcaatgcccttgcggggtctgaaaacccatttcttgggcatcttcccatgaaggaacatggttcctcaccaacttag

SEQ ID NO: 30261 - DNA, 219 bp, Glycine max
  Peptide Sequence Number=SeqID_121946
atggaaaaacggctttgccgcggccctctcacttccctgttaagtatcttcctggcatcttccaggaaatctccgccccgttctaagccagtatacactccgctagcgcccaatacgcaaaccgcctctcccccgcgcgttggccgattcattaatgcagctggcacgacaggtttcccgactggaaagcgggcagtgagcgcaacgcaattaatgtga

SEQ ID NO: 30262 - DNA, 261 bp, Glycine max
  Peptide Sequence Number=SeqID_121947
atggcagcgcagttgatccatgatcgtgtggtgatggagtgccttgagggtgtttgggagaacctcgaaggcaatgagagaagacccagaggagtacctcctgaacttgatatggacgcccttgacttacctgaggatgatgaagacccactccctgatgttgattccccagaggatattatgtcagcatctgaggcagactctacagaggagagtggccctggagggacagtgaatagtgacgactcttcatcgtcgtag

SEQ ID NO: 30263 - DNA, 624 bp, Glycine max
  Peptide Sequence Number=SeqID_121948
atggctactccacctgcctcgcctcctcctcctgttcctcttcctccacctcctgcagacgcatcagtgtctctatttacgttgaagcggacacgcaaggcgacacagctacgatcattggccactagaccacctggggcaaaaagacctatggtcaacgtcgattctgctaccggcaaggtcgacggtccccacaagaagaaattaagaacatatttggtgattgtcgctcgtgataaggttgacgtgacatatgacacctggaaggaagtccctactggtcagaaggatttgatatggaaggatattcaggcagaatttgaaatccctgaagcttctgacaccgacaaggacggtgtggacgacattgtctgtgaaaaatatggcattagcaaggagaaatgggcccagttttgtcagacccacagagatccctcatgggaggatgtgcggaaaaaggcacaagtcatccagaagcaaaacactgccccccacgtattgtctcgtgggggttataagtatttagaacaaaagctcatggctgagaagacaaagaaaagactggaagaagctgcccagtctggaagcactgagagcatcattgaccctccatctcccatctga

SEQ ID NO: 30264 - DNA, 432 bp, Glycine max
  Peptide Sequence Number=SeqID_121949
atgacggtgaaaacctctgacacatgcagctcccggagacggtcacagcttgtctgtaagcggatgccgggagcagacaagcccgtcagggcgcgtcagcgggtgttgtcgggttgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccttgttgattga

SEQ ID NO: 30265 - DNA, 1317 bp, Glycine max
  Peptide Sequence Number=SeqID_121950
atgggcaagcacaccaccaccagcacccgcctctatcacctgcccgcgccaggcggagacctgatcgactcgcccggcttccaggccttcggcttgcagcacatgagccgcgaagacatcatccgcggcttcccggaattcaccaagccgatcgagtcgtgccgtttctacaattgcacccatcgccacgaccccggttgcggcgtggtcggggcgctggacgcgggcgcgatcgtcccggcacggctctcaacgcggctcgaagccgttgcgcaacaggtgataaaggttgcgcagcatgccggccgtggcgccccagatgaagtgccggccatacggcatgccgtaatagtgacgcacccggccgtcctccagccgcgcctcgtacaaacggtgattggccggatccatcaggaacgacagcggcacttcgaacacctcggcgacttcgaacgcgtccggcgccagctggaagccgggcgtaaccaaagacacgaccgggatgatggagaatccagtggcggtcaggtacgggggcatgctgcccagcacctcgacgtggttggccggcagtccggtttcctcctgcgcctcgcgcagcgccgcggcgaccggcgtcgcatcgctggtctcgatacggccgcccggaaaactgatctggccggcatggtcgtgcaggtgcgcggcgcgctgggtcagcatgatgtgcacgccatcgtcgcgcgtcaccagcggaatcagcacggccgcgggcaccggggcgccttcgcggccgggatagcgcaggtcattgtcgcgcgacagctcgagcgtccaggtggacggctggctgagcgtgccgcgcagcaggtcgggcgtcagcaagccggccggcaccgccggcagggaatcgttggcgaccacccagggttgcgacgccgggtcgaacccgggacgcgccagcggccggcgcggccgcgcagaagacgaggaatcagacattcggcttttcaaaaagaaaaaggcaccctcgcaggtgcctttttaacccggaaacccgtgccgaacgaaaacgctggatggcgtgtgcgtccgacactggtagggccgtgtgccgataagcgatcaagccgccgaggcttgcttgctgaccagcttttccttgatacgcgccgacttgcccgagcggttgcgcaggtagtacagcttggcgcggcgcacgtcgccgcggcgcttgacttcgatgccggcgatttgcggcgagtacagctggaacgtacgttccacggcttcacccgacgaaatcttgcgcacggtgaacgcggagttcaggccgcg

SEQ ID NO: 30266 - DNA, 627 bp, Glycine max
  Peptide Sequence Number=SeqID_121951
caccggaagaggacgaagaagtccaagctctcaaaagcgagttaggaaaggcgaaacttgccaaggagaagttcaagttggccgctacacacatccggaaggagtgtgccagattacgggaagagaatgcaactaccgcaagagcccttgaacaagaggccaagagggctcacaaggaagagtatggccgtaacaaatttcgcggagctctgtggtgtagcaacaatgaactcaagctgcgaagggaagagagggaccagtcgcgagcacatagcatggtcttgaaggaggagttagtcgcctgttcaaggtccaaaaggaacttgtctcagcgtttatgcgagacggagaccaacatgctagctatcatcgcaaagtaccaagaagagttaggtctagccacggcccacgagcatagggttgcggaagagtatgcccaagtatacgcggaaaaagaggctaaaggaagggtgatcgactctttacaccaagaggcaaccatgtggatggatcggtctgctcttaccttgatcgggagtcaagaacttccccgattgttagccaaggccaaggcaatggcggacacctactccgcccccgaagaaattcatgggcttctcggctatt

SEQ ID NO: 30267 - DNA, 219 bp, Glycine max
  Peptide Sequence Number=SeqID_121952
atgtacaatcgaaggtattccatttcatcgttgcatgacatacataatatatctgaagttagagattcgggtggtgtggtgaagaaaagtgggagtgaggcagcacccaaaaggcccaggaacgaaaccccatcacctttgccagcttttaaggtgagaaaagagaagatgggggacagaatcactgcactccaacaattggtttcacctttcggaaag

SEQ ID NO: 30268 - DNA, 108 bp, Glycine max
  Peptide Sequence Number=SeqID_121953
atggcgaaagacaacgattgtgcctcaaagccttgcactggggcaatgaaggcaccatgtcatgacgaaagatacaattggtacttcaaagtcttacactgggcatga

SEQ ID NO: 30269 - DNA, 249 bp, Glycine max
  Peptide Sequence Number=SeqID_121954
atgaggggcaccgtgcatgagcctcaagtgaacataggggccgatcaaaagttctcacccatcgaggatggacccttgggtactagtaccctcgtctccagaggactatacgtcctcaccttcatagggctacacgccctcaccttgggtactagttaccctcaccatcagagggctgcacgccctcacctccagaggactacatgtcctcgccttgagagggctacacgccctcaccttgggtactag

SEQ ID NO: 30270 - DNA, 318 bp, Glycine max
  Peptide Sequence Number=SeqID_121955
atgccttatggggagcatcgacccgttcaggagtttgatttgatttcatgcttttccgatcagctacgttgggggcccgttgccgtcagacaccaaccagagagggtcatgcgccagtttggatacgtccagagtattcctgtagaggatgctgattcatgggtttcatttgaagaaatagacgacaggtggatgcactacttagaccatcttgcaccaacaggtgagatatgtcttgtgccaggtcagtgtgtgcccgagtacatggactggttcttcgtcatttctcatccatgcatgactgcggcacaacaataa

SEQ ID NO: 30271 - DNA, 249 bp, Glycine max
  misc_feature (25)..(25): n is a, c, g, or t
  Peptide Sequence Number=SeqID_121956
atgtctcagcatatcagtgttatanttgtggattctccacagtccattcagaggtcggggcaatcgcagtttgaggctgaatgttacataaagggttggatgcagagttcaaaatgtgatgtctatcttggagcctacctgaatgggctagacaactaccttaaggggataattaacagtgctttaaaaggtcttgatgatgctccacatcctaaatcaaaggctcctactaggtggattgtcgtcaag

SEQ ID NO: 30272 - DNA, 448 bp, Glycine max
  Peptide Sequence Number=SeqID_121957
atgtcatttttgggagaaacaagcagccagaccattgttaactccagattagccttcatttttccaaatggatcaatcactcacaaccaaactggtgtttattttcaaagccccactctgacactaatgcaagttcctgatgactgttcttttgatacactcaagcttcaactaaccaacgatcaattagtggatgaaatctactatcgacaaccattcatagatgcaagtcaacaatatttttttcaatctctacagttgaaaaatgatgatgatgtttacagaatgttaatttgcaatgagcaatactcgtgtgttggtcctatagaattattatgtatcaccattagaacaccagatgctatactcaacctgcttcaatcaactatcactcctactcatgatgcaattatgtattacaacgagaagtggaacataccacgccaag

SEQ ID NO: 30273 - DNA, 611 bp, Glycine max
  Peptide Sequence Number=SeqID_121958
tcataactcttgcaagagcctaagtgaagaacttcgtgactattatgaaggaaggcataggtcacatcttagacctcactcccataggagagaaaagggaagaaagcctcaagaggttaacattgaactcccatacttccatgggaaggacaatgtagaggctaatttagattgggaaataagggtagagcaacaacttaaaaggaagtctacttcaaaatcttatggctctcactcttatccaaagaaagaccaaggtcaaggaatattaggggtgagaccttctaagcccaaagatgataaggggaagacaatagaaaagcaaccccttaaggctagtatgcaagagaagactagctccatgaagtgctttaaatgtcttggaagaggacacattacttctcaatgccccaccaagaaaaccatgattatgaggggccaagacatttatagtagccaagatgaggctactacttcaccttcctctaatctacccccaagaagaggacaacctttaatggttaaggaggagtgtaaggagacacttgttagcattgccacatctcttaggcttgagtttattcctcaagtaaaggagttgttggatgagg

SEQ ID NO: 30274 - DNA, 317 bp, Glycine max
  Peptide Sequence Number=SeqID_121959
gtgtcaatggagacccagaagtggatcatgatctgctatgccagacacaaatttgtggaagcaatgtcttccaaggttattttgatgatgccaaagaatcaagagttaagaaaattccaaagattcaagaatcaagtttcaagaaccaagtttcaagaatcaagattcaagatcaagattcaagactcaagattcaagaatcaagagaagactcaatcaagataagtactaaaaagtttttcaaaacattgagtagcacaagaagttttcacaaaatcattaccaaagagtttttctctctggtaatcgattactag

SEQ ID NO: 30275 - DNA, 417 bp, Glycine max
  Peptide Sequence Number=SeqID_121960
atggcaaagtcgatccagctggcggaccaagtggccaaggcagtggcggaagaggcaagttccttcttcaagcaagagtgtttagagctgaaatccaagacggagaagctggctgggctgctctggcaggtggctcgcgtgagctctgacctctacgagtggcccacacggcgcatcatcgctgacaccgagctggtcctcgacaaggccctctctctaatcctaaagtgtcgcgccaacgacctcatgaaacgtgtcttcaacatgatccccgccgccgccttccgcaagatgtcctcccagctggagaactccatcgtcgatgtctcttggctcctccgtgtctccgcccccgccgatgaccgtgctgacattgagtatgtgacaacaaccgctacggcgtcagacccttactaa

SEQ ID NO: 30276 - DNA, 312 bp, Glycine max
  Peptide Sequence Number=SeqID_121961
atgggctcgtccaagtatgaggttgaaaaattcacagggcaaaatgatttcgggctatgtcttggagacaaggtgttgaggcaagtctctaaggaaacaactgctgctggggttgctttgaattcaaaggaattgaatgaaagaaagaaaaagaagtcctctacaagtggtgaagggttgacagcaagaggcaagaccttcagaaaagatagtaaatttgataagaagaagcaaaagccagaaaatcagaagaatgatgaaggaaacatcttcaaatcagatgctatcactgtaaaaagaagggttatataa

SEQ ID NO: 30277 - DNA, 525 bp, Glycine max
  Peptide Sequence Number=SeqID_121962
atgccccttcccacacccctgcaacgcgccctgtacctggcactgaccctgcccttggcaccgcttgcccatgctgccgagtcctctactgccgcgcccaaggacctggacaaggtcgaggttcgcggacgtgcacaggcgctgtaccgggtggacgatgccgcggtcggcacccgcacggatacaccgctggagctggtcccacagtcgatccaggtcatcccgcgtgaactgatcgacgaccaggcggcgcgtcaggtaaccgatctctatcgcagcatcagcggcatcagctatttcagctatgccggggtgaccctgcgcggcttccgccaggagaacgtgctgtatgacggtctgcgcggcgacccgtatgcaggattctcggtgccgcagttgttcaacatcgagcgcgtggaagtgctgaagggaccggcaggcgcgctttatggcgggggtgatgcgggcggtgtcatcaactacgtgacccgcaagccaaaagccgctgccgagcgccgcatcgag

SEQ ID NO: 30278 - DNA, 960 bp, Glycine max
  Peptide Sequence Number=SeqID_121963
gctgggtcaattggtggcgcactgccgcgccgatgcgagcgggatgcagccggttcatgcgcgcctccggccgttggccttgaccgggctttcaggcgtgccgaaatcctcttcggcactcacgccggggtaatggaagggtacggggccggtggcgcgtgcgtggatgaactgctgcaccagcggatcgggattggccttgacttcctcgggcgagccctgggcggcgacaccgccgttgcccaggatgaccacatggtcggccacatggaaggtttcctccacgtcatgggacaccaggatggaggtcaggcccatggcgtcgttgagttctcggatcagttgggcagcggtgcccagggaaatggggtccagcccggcgaagggctcgtcgtacatgaccagttcggggtccagtgcaatggcccgcgccagcgccacgcggcgggccatgccgcccgatatctcgctgggcatgaggtcgcgcgcaccgcgcagacccacggcatgcagcttcatgagcacgatgtcgcgcaccagttcgtcgggaaggtcggtgtgctcgcgcagcgggaaggccacgttgtcgaacacgctcatgtcggtgaacagggcgccgaactggaacagcatgcccatgcgccggcgcgcagcgtacaggcccgcggcgtccatggtggtgacgtccttgccatcgaacagcacctgcccctgctgggcatgctgctggccgccgatcaggcgcagcacggtggtcttgcccccgcccgatgcgcccatcagggccgtgactttgccgcgcggcacctgcagcgacaggtcgcgcaggatcacacgctcgccatagccgaaggcaagcccgctattgtgcagacaggtgccgctgcttgctcaccaccgcccgagataaacatacatccgtgtatgtttctcaaaaagtcatggcagaaaccgccataa

SEQ ID NO: 30279 - DNA, 198 bp, Glycine max
  Peptide Sequence Number=SeqID_121964
atggcagcgcaactaatccatgatcgagtggagatggagtgcctagagggagattgggagaccctcgaaggcaatgcgagaggaaccagcacgcacgctttagcgcactgtggaatgaatattacctacgcctactccatatcgtctagtggagccaatccaagtgatcgaggtgacgtcatccgaggaagaccctga

SEQ ID NO: 30280 - DNA, 213 bp, Glycine max
  Peptide Sequence Number=SeqID_121965
atgggcttagcggatctgctcactaagcctgacgtaagctccattggagcttgtaggcctaggagacgccactttaaggagaagatgagtctagaagaagctcactaccataggaggccatggataagagcttggaggaagaaggagatgaatgaagggagaggaagagaagagcatgaaattttgtgctctaaaagagctctaaaatctgaa

SEQ ID NO: 30281 - DNA, 501 bp, Glycine max
  Peptide Sequence Number=SeqID_121966
atgaatgttttacaatgttgggtgtatttgaagcctgcaacactcacccaagcgagtgtggcctgcccgggcgagctgacccacacctcaaattttctgtttcgggattacgcctctgagacacccagtggacccagagaagtccaacagggccctgggtttcctactctgattataggcctctgtcagttcaatggagtggcggtcatccccaccaagctcattcgacctcctattaatagggccttcatccggaaatactacatgccagaggaggaccagcaacagcctattgcagatgcaccaccaccgcctctaggggagagtcaggaccccaatcctttgccttggcctacccccgagcagttcgaggccacggtggcctggcctggggacgagaccgattttgagacacgagcaggacctgcaggagctccgggggatgacgaaggagctcaggaggatgatgacatggctgacgtgttggacttcttcacttga

SEQ ID NO: 30282 - DNA, 210 bp, Glycine max
  Peptide Sequence Number=SeqID_121967
atgccttacaaagaaatggctccaaaaaagctttccgcgaagagatctaggagggacgctgcggctgaaggaaccagtgccgcccccgagtttgatagccaccatttcaagagcgccgagcaccagcagcgcttcgaggccatcaaaggatggtcgttccacagagagagacgcgtccagctcaaggacgatgagtacacggatttttag

SEQ ID NO: 30283 - DNA, 306 bp, Glycine max
  Peptide Sequence Number=SeqID_121968
atgggggaagattcgtggccattagtgcgtaatgaattgattaaagaacttggcaggtggtcgcatgagtacatgaacctcttcggtggcacagagagatttgaacaattaaagttgtccctacctgttgatgggttttcgaagtgtagacaagtggatggatataacggagatgggatatgtgattgcatcacgaccattgtcccttaccgcctccagcgttgttgtggtcaagcaattgttattctcaagcaaagcagtggacaactccatatattagtagaatgcaacaatacacaagcttga

SEQ ID NO: 30284 - DNA, 330 bp, Glycine max
  Peptide Sequence Number=SeqID_121969
atgactagaggcaatccatctgacttacaaccctttgatcctgagatagataggacatttcatagattagttaggcatcattttataccttttgatcattctgagcattccattactggtgaatctatgcattctgttattggtgattttgaacatcctgatcttgagcattataattttgagcattctgattctgagcattctgattttgcacattctgagaacatggcacaacctccaccccgtgagaggactctaagggaaatggctgcacctgatttcacctacgaaagcttgtgcatccaataccctgatgaggatgtcccatat

SEQ ID NO: 30285 - DNA, 453 bp, Glycine max
  Peptide Sequence Number=SeqID_121970
atggggcgtaggccttcccaaaaggtaacggaggcgtgcaaaggtttcctcgggccagacggagattggccctcgagtgcaaaggcagaagggagcttgactgcaagacccacccgtcgagcagggacgaaagtcggccttagtgatccgacggctgatcttccccaagagctcacatcgacgggaaaggtttggcacctcgatgtcggcttcttcgccacctggggctgtagtatgttccaagggttgggcttgttcgcccataaagcgtacgagaggaccgggaaggacgcactctggtgtgccagttatcgtgcccacggtaaacgctgggtagccaaagcctccggtagcacagccgagacagcgatgggttctctgccccagcggggatggagcgaaagaagttttgagaattcaagagaaggtcacggcgagacgagccgtttctaa

SEQ ID NO: 30286 - DNA, 156 bp, Glycine max
  Peptide Sequence Number=SeqID_121971
atgcagtcctactccccaagggcattgcatagaagactcaaagaagattgtgccaaagatgcaagagaagaccctaaggttctcatgagccttaaggtagggtaccctagaaatgtaggatttttcagcccttgtattttagggcacctagactag

SEQ ID NO: 30287 - DNA, 381 bp, Glycine max
  Peptide Sequence Number=SeqID_121972
ggtggacccttgggtactagtaccctcgcctttagagggctgcacgccctcgccttcagaggacaacacgtcctcacctacagaggactacacgtcctcgccatcagagggctgcatgccctcaccttcagaggactacacgtcctcgcaatcagagggttgcacgcccttacctttagagaactacacgtccacaccttcagagggctgcacgccctcgcctttgtagggctacatgccctcaccttcagagggttgcacgccctcgccttcaaaggactacacgtcctcacctttaaaggactacacgtcctcgccatcagagggctgcacgccctcaccttcagaggactacacgtcctcgcctttagaggactacaa

SEQ ID NO: 30288 - DNA, 606 bp, Glycine max
  Peptide Sequence Number=SeqID_121973
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggatgttcccgccgccgccgcagacgaccctcccctccctgccggatctactcctcacggccctctccgtctgcttcctagtctcgtcctcgaagccccacatcggcggctccacccgctgccccttcccgcgtcgcttcctcaaaatccccgccatgtccctcacaaacacaacaacgtcgaaatcctcgaaaaacaacaatctcaacaacaccctcctccctccgcgccgccacagcttcgcgtccccgcagtcgctctcggagtggctgaagccgcggctcccttccgagtcgttcgcctcgtggggcgtgaagccgggcaccaagaacgtgcacaacctctggctcgagctctcccagggggtaccgagctcgaattcgtaatcatggtcatagctgtttcctgtgtgaaattgttatccgctcacaattccacacaacatacgagccggaagcataaagtgtaa

SEQ ID NO: 30289 - DNA, 96 bp, Glycine max
  Peptide Sequence Number=SeqID_121974
tccaagcaatggatcatggtctgctgtcacagacagggattgctggataaaacaaatagcaatgaataagttgaatgctaagttgaaagccatgaa

SEQ ID NO: 30290 - DNA, 207 bp, Glycine max
  Peptide Sequence Number=SeqID_121975
atggtagaagtctccacagaggccattgcctcccttgcccagtattatgataagcccgttgaggtgcttcacctttggtggacttccgagctatcacccatgcgatcgaacgcttttctcgcctatcatgaccacaaggaaagcccggttgtcgctatgctagccaacctatatgacaccttcgaccgaagtgtgacggaagagtaa

SEQ ID NO: 30291 - DNA, 381 bp, Glycine max
  Peptide Sequence Number=SeqID_121976
gggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgaaacagctatgaccatgattacgaattcgagctcggtacccgagttcgatactcggttcttaccgttttatactacttgtgcgatccagtgcacttgccagaatcgaacattaggcgctgagcgcttgagactcgtggcttag

SEQ ID NO: 30292 - DNA, 75 bp, Glycine max
  Peptide Sequence Number=SeqID_121977
ggctatcatttactactgctaattggcgttgcttgcggaagcggtttgattatatctttgaagcctcaaagtcag

SEQ ID NO: 30293 - DNA, 258 bp, Glycine max
  Peptide Sequence Number=SeqID_121978
atggacatcctctcacgaacacatctttgcttattcaacttccaccagaatgagtcatttgacttaatccatcaactgaaagatccttcaactatttctcgtccttggaagattctttttgcaagaatcaactacttctttcattcttcctcactacgaggtcgtgaaaacaagacaacaattggtacctctaagccctacactagggcaacgaaaggcaccatgcaaaaacttcaagcgaacctaggggcagattag

SEQ ID NO: 30294 - DNA, 79 bp, Glycine max
  Peptide Sequence Number=SeqID_121979
atggctacaccaatgagcactgcctgctatttagataaagatgaaatcagtcagtcaatagatgttaagcaatatcgag

SEQ ID NO: 30295 - DNA, 129 bp, Glycine max
  Peptide Sequence Number=SeqID_121980
atggataagagcttgaagataggagaagatgagtggagggacaggaagagaagagggtacaaaatttatgcctcgaatgagcccactaatccaagaataagtccaagattccctactaagtgtgcttag

SEQ ID NO: 30296 - DNA, 489 bp, Glycine max
  Peptide Sequence Number=SeqID_121981
atggcactggtaatcgattaccaaagctgtgtaactcgagtttgggcactgatcgcgatggaagcgcagttaatccatgatcgcgtggtgatggagtgcctacagggagtttgggagaccctcgaaggcaatgagaggtgccgattccgtggcacaattcgactcactgctacttcattagtacatccggaggaacccgaacgcacactacagcaacctgtggagtggatactacctacacctactccatatcgactagtggagccagttcaagtgatagaggtgtcatcctctgaagaagatcctgaggaggacccagaggagttacctcctgaacctgttgtggatgatcttgacttacccgaggatgatgaggacccactccctgatgtggattctccagaggatatcatgtcagcgtctgaggcagactctatagaggagagcgtccctggagggacagcgaatagtgaagactcttcatcatag

SEQ ID NO: 30297 - DNA, 279 bp, Glycine max
  Peptide Sequence Number=SeqID_121982
atggatcacgccgctcctcctacttttgaagggcaacctccccagcccacaggggacgcccgcaaagactctcgagagcgtgcccaacgggacatcgactccttcccacttctcaccactaagggaccagcgcccaatgccttgcctcagcctaatatcgcggtagtctctcaaccccgcccgacgcaaccactactcttctccgtacaaagggacgacttgccccaagaatcatttgaagatgtattaccagaaaatgggggcatactcaaggcatga

SEQ ID NO: 30298 - DNA, 261 bp, Glycine max
  Peptide Sequence Number=SeqID_121983
atgaattgcgttttcattcatgcatcctccacccacgagtttggagccatgcatagtgattgcttagtgcaattctccattctcaaccctttttcggagccccatgaattgttttcgttcatgcgtcctccaacccacgagtttggagccatgcgtagtgattgcttagagcaattctccattctcaaccctttttcggagcaccatgaattgcgttttcgttcatgcctcctccacccacgagtttggagccatgcgtag

SEQ ID NO: 30299 - DNA, 381 bp, Glycine max
  Peptide Sequence Number=SeqID_121984
atgctttgtggtacaagtagaggatacatctacttgggtttgactgagaacaagagagggtacatctcttgtggattagttctagtggagggtacatccactaggttcaaagagaacaagggagggtacatcccttgtggatctttgcttgtaaaaggatttttacaaggaaattccattcacaaaccacccattttcaatggtgagggttaccattattggaaaacccgcatgcagatattcattgaagccatagatctaaatatttgggaagcaataaaattaggaccacatatacccactatagtagatgtaagcacaagcactacaacccaaaaacctagagatcagtggatagaagaagataggagaaaaatctag

SEQ ID NO: 30300 - DNA, 336 bp, Glycine max
  Peptide Sequence Number=SeqID_121985
atgcatagatctcccacaggcaatttagttcctctggacttagaaattgaagctacattgagaaggaactgggatgagagtagaaggaaacttctgcaagacagaacagtcacatccattcttgaggaagaaactcatttttctgattcattgtcacctgattcaccatcatcaagggaatccgctactcaatttcctgaagccactatcatggcagacgagcaacaccagaggatcacccttgaggattattcaagcagctcagtgccgtataagactcaatctattctcattctcattggcaggagaggaaaagaggtggcttcactcgtttaa

SEQ ID NO: 30301 - DNA, 96 bp, Glycine max
  Peptide Sequence Number=SeqID_121986
atgttgatgatgttgaaaatgcactatgttgatgttatgttgtgggaaatagatgttagacaagtggcctcagatatcttaagaagggggggttga

SEQ ID NO: 30302 - DNA, 348 bp, Glycine max
  Peptide Sequence Number=SeqID_121987
atggcagaagaccacccacagaggatgacgctagaggactactctagctttgctacacctcagtacttcaccagcatagccagactagatgtgcaagcggccaacctttcatatccacattccctcatccagctaattcaaggaaatatatttcatggagtaccagaagacgccattcacctcaacctattttctttctctatggcaagtgaagtgaaaagatggcttcactcattcaaggggaatagcctgtggacgtgggaagagatggttgagaagttcctgaagaaatacttcccgaagtccaagaccgctgaggggaaggtggaatctcatttaatcatgtag

SEQ ID NO: 30303 - DNA, 159 bp, Glycine max
  Peptide Sequence Number=SeqID_121988
atggtccatgacatctttgtcaaggtgaaactggaagtaacaaggacatcaacagtcctaaatgtgtttggcagtagacgaagcagcgataaatgggtttatgatcccaacatggttggctcatggtacctaaaacatgcaactaagaatgtagtgtga

SEQ ID NO: 30304 - DNA, 375 bp, Glycine max
  Peptide Sequence Number=SeqID_121989
atggcggcgcaactaatccattaccgagtggagatggagtgcctagagggagcttgggagaccctcgaaggcaatgcgaggtgccgatttcggggcatgattcgattcacgactacttcattggtccatccagatgaacccgcgcgcacgcttcaacgcactgtggagtggatactacccacgcctacaccataccgtctagtggagccagtccaagttatcgaggaagaccctgaggaggatcctgaggagctacctcctgagcctgctgtggatgctcttgactttctagagggaattaatgaagcattgggcttgaatctagcattgggcttgaatctagaattgggcttggacttgaagagggcagactaa

SEQ ID NO: 30305 - DNA, 550 bp, Glycine max
  Peptide Sequence Number=SeqID_121990
atgatcttgaaggacgagttaaaggcttgccttaggtcgaaaagaaatttgtcccggcagttaagcaagactgaagggaatatgtgggccatcatcgatgagtacaaagagaagctgaacctagcagcgactcacgagcaaaggctagaggatgagtacaccaagatatcagcggaaagggaagcaagggaaagggtaatcaactcattacacagaggggcaatggtgtggatggacagattcgcctttactttgaatggaagtcaagagcttccccgactgctagctaaggccaaagcaatggcggatgtgtactcggcccccgaagaaattcatgggctcctcaactattgccagcacatgattgatctagtggctcacataattaggagccggagtaacaccataactaagcacactccaaggcacccctatcgaacccgttctgaatctagggctatgtgtgacgtagaggaggtgcaagaacagatgaaagccaacatgttgactctgaaagatcaaatggcttccatgatggaagccatgctag

SEQ ID NO: 30306 - DNA, 404 bp, Glycine max
  Peptide Sequence Number=SeqID_121991
aaactgacaagaggaaacgaagcatagcactcaaagcctcctcctcaatacaagaggaagaagaagatgaagaagacttctcactctttgtgaagaagtttcacaaatttgtcaagaagagaagaatcgagaggcgtcaaaatttcaaccatggaaaaagattccaagaagattctccaactattagatgctacaagtgcaaccaacttggtcacatcaaagcaaatttcccctcaaacgagcaatggcctaagaagaatgagaagaaaagtcatgaagaaagaagatccaagaaggcgtatattgcatgggatgacaatgactcatccgatggttcggagaaggagattaaccttctatccaaggactatgagagcgatgagaacatctctcaagaagactaa

SEQ ID NO: 30307 - DNA, 144 bp, Glycine max
  Peptide Sequence Number=SeqID_121992
atgccaacctatgataagttcatgaaggaactccttaagaagaagaatacatatatagagcaggatacaattcaactagaacctggatgcaatgtaaagcattgtcggattggagagcaagcattagtcttataccactcttaa

SEQ ID NO: 30308 - DNA, 205 bp, Glycine max
  Peptide Sequence Number=SeqID_121993
aggatcccacagaagtgtcgcaacatgcccttttgcgggcgagcgaaggcgaggctcacgggtgcgctttctaaaggaggaaagatgcgcggagtcgccaccaacgaaggtattagcacctctcacgtcgacaaaagcggggcttttgctcctacgtaccctccatctaagaggaaatcagacctacgtagttctttctttaaag

SEQ ID NO: 30309 - DNA, 426 bp, Glycine max
  Peptide Sequence Number=SeqID_121994
atggggtcggaccaagggtcgtcttttaagaaaaggttctatcatgtcaaagtcaaaaatctagaagtagccagcttgcgaaaactgggtcagcagatgggtcaagttcaacgtcaggcttttagcaaggactttcaattagccccaaccatagaggagttcgaagggatcttaggatgcccgaaaggaggaaggaaaccatacctttttctgggtactatccttctatgcgggaataccaaggaagtgcttggagaagacgaaaactctggcaagccaaggggagtggcgattgacgcttttcttgcttatcaccacagcaaggaaagctcggtcattgctattttagcagatgcgcatgatacattcaacttgagatgtgagaagagcagtgcgaggattgtttgttgtatgcctgctctttaa

SEQ ID NO: 30310 - DNA, 136 bp, Glycine max
  Peptide Sequence Number=SeqID_121995
gtggtgtgatactgaggaggaggaaccaacaaatttgaggtcaaatcctcttcaagggggaagagatgatgcaatcctccctaggaagggactaatcactagagcgatgagcaagagactaagaggattgggctag

SEQ ID NO: 30311 - DNA, 195 bp, Glycine max
  Peptide Sequence Number=SeqID_121996
atggagccgggaaggttccaggttagtataccaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 30312 - DNA, 282 bp, Glycine max
  Peptide Sequence Number=SeqID_121997
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgttgatggggaaagttgcatctgataagtgccacaagtgggtctttaaagagcccacagaatgtgaaccaaatatctccaactactggcagagctcctttgatgctgtatga

SEQ ID NO: 30313 - DNA, 783 bp, Glycine max
  Peptide Sequence Number=SeqID_121998
atgaccaccctagctcagacatggagtgttctttccttctctaacctgattcctacctcccatacttctgatgtcaccctggacagagccaaactcatttatggcatcattatgaagatggacatgaatgtggggtacctcatctcccaccagatctccctcactactcagcatgacacatccagacttggattcccagccttgattatagctttatgtaaggctaggggagttcagtctaactctagatccttggagagcttgagtcctgccattaatttggtttacattaagaagaactgttggaatcttgatgatccaatagtaactttcagagcacctaggaaggccagagggaagagatctgaggccccttccacttcaacatcagaggaagcaacaccttcttcttctacacttcctccctcttccaccacagagctcccagtgattcctcctgcacccacacagataccactaccagctcctctctctgtaggacaaacagaatttatttttactcctcagatgcttcactccatgctccagagcatccataaagggcagtccatcatcatgcaaagccttcagggcttgggttttccctccattatgagcatggaggagtttgatacacatatggtctggccaggagaccaaccttcttcctctggagggggtggggcctctacagctcaggagactgtgagtgaggagccactagcaccagcaccatcgccagcagcaacagaggaagagaccactccagctcagaccccatag

SEQ ID NO: 30314 - DNA, 138 bp, Glycine max
  Peptide Sequence Number=SeqID_121999
atggaggaggaagcggagaagaatacaaaaacaccactgactcagacagctaggatctttattccatgggtcaaatctgtcgaaaatatcaatgttcccacagatgaaattccttcgctaatatatgttggaaaataa

SEQ ID NO: 30315 - DNA, 210 bp, Glycine max
  Peptide Sequence Number=SeqID_122000
atgactgaaacacgtcaaaagagggtacggaaagtaaatgaaaacgagaataaaagtacacaaaacaaatggggaccaccacagggttatgggaaatttacggaagcattacgggtgtcccggaacccccagtatcccaattttttaacaaaacgggggaggtggttgtcacctagctcgcccaggcgagctagattgcttccaccttaa

SEQ ID NO: 30316 - DNA, 138 bp, Glycine max
  Peptide Sequence Number=SeqID_122001
atgggtgccaaagtacctcgaagtggtcaaacaagggtcgcatcccaacaaatggatggtccccggacaatattaggtgaaaaaggtgcgggatcaaatggttccccgcatgccatcgagctcgccgcctctggatga

SEQ ID NO: 30317 - DNA, 739 bp, Glycine max
  Peptide Sequence Number=SeqID_122002
atcatggttaggaccagaggattagatcgtgccttaggtcacgttactagtagaggagatcatgatgattccgatgatgctccgctgcgtcgacggcctaccacatctgcacagaggcagcgagtacctgtgactgcggcgcacgatgagccagtgctccctgcgccaaatgtagaggctgacgtattttcggatgacccgatggcaccagctaatgtagaggacattgggccagacattcctgatgacacaggtgcccaggctgcagaggatgaggatgagggatttctggggggtccgagcgacccatccgagcgtcctaagttgaagttatcctctcacgggaggaaggtccatagtttaggcaggcctgtccctgccattgagggactagttgctgggacaggactaagtcctctgatcacgtgttcggtagacactggcgatcggggacttttgtcctcgtttgtcgagcggtggcaccgggagacgtctagtttccatctccccgtgggagaggtgacgatcacgctggatgacttcttgtcgcttctgcatttgtccgtggttggtgacttgcatgcctttcagcccttgcacgtggatgatgcggttcaaatgctggtggacttattgatggtctctgcagaggctgccagggctgagacagggcagtgttgtggaccgtatgtacggctgcaatgggtacgtgatatctatgagcgccgatgccaggcag

SEQ ID NO: 30318 - DNA, 243 bp, Glycine max
  Peptide Sequence Number=SeqID_122003
atgagtatcaaaggtggtgttggtggagctggtggaggagatagtatctcaacctccgggagaagcaggtggggtctactactagaggttgtgactcagctggtgcagggctttgtccttgttggtataggactggggaggaacaaccctcagggggctcagcccaaaggatgctgggctttcaggccaggccaccttgtccagaatttgttccatggatattattggcctgttgtgagctaa

SEQ ID NO: 30319 - DNA, 198 bp, Glycine max
  Peptide Sequence Number=SeqID_122004
atgcaagacaaagtaaattgcaataaaataaacgagataagggaagaaataattgcaaactcgatttatactggttcggccacttcccgtgcctacgtccagccctcaacggaatggagacggaggaaaggtgattggagacgccacttcaaggagaagattagtcaagaacaagctcaccaccataggaagtcatag

SEQ ID NO: 30320 - DNA, 729 bp, Glycine max
  Peptide Sequence Number=SeqID_122005
atggcagagcaaccccggattaaactgcatgacggcaacatgatgccgcaactcggccttggcgtctggcaggccagcattgatgaagcgcgcaacgccgtgctggaagcgctgaaagtcggctatcgctccatcgataccgccgccgcgtataaaaatgaagaggcgattggccaggcgctgcaggaaaccgacgtggcgcgcgatgagatctttatcaccaccaaactgtggaatgatgaccagcagaacgttgagcaggcgatggagaccagcctgaaaaagctgcagctggagcaggtggatctctatctgatgcactggccgtgtccacagaaagaccactacgtcgatgcgtggaagaaaatggtggaactgcagcagcagggcctggcgaaaagcatcggcgtgtgcaacttccatgaagcgcacctcaagcggctgattgatgaaaccggcgtgtcgccggtggtgaatcagattgaactgcatccgatgctgcagcagcgcacgctgcatgcatggaatgcgctgcatcagattcagaccgagtcatggagcccgctggcgcagggcggcgaaggcgtgtttgatcaggagatcattcgcgagctggcgaagaagtacagcaagacgccggcgcagattgtgattcgctggcatctggacagcggcctggtggtgattccgaagtcggtaacgccggcacgcattcaggagaacttccag

SEQ ID NO: 30321 - DNA, 435 bp, Glycine max
  Peptide Sequence Number=SeqID_122006
atgacgatgtcaggtactagacatagatccgctaaatctgagaacgggttgttgccgaggccttctaccactcttagcctctcttcaagtgaaccaatctttcccttatcttttgcaaagggaacggattcttttacgggtgcgggtgaagacgggacatggcggactatgtttggttggggcaattcatggggggccggatttttgaggggaagcagagggcctagatgggcatctccttcatcatcttctttgcaagggatagtcggcataaggagggagttgcccctcgaaggtaggggcttggctcaaatcatccggagcggtacggggagtgaagtccggagccaaaccataaggttaggcttgagggactatacctccgacctaacaccgtcatgtttctgtctcggcccagtttattgcgggctgtag
